United States Patent 7,560,542 (NUCLEIC ACID MOLECULE SEQ ID NO. 68811 AND OTHER MOLECULES ASSOCIATED WITH PLANTS) - sequence listing, part 8

SEQ ID NO: 44361 - DNA, 482 bp, Zea mays
  Clone ID: LIB3066-056-Q1-K1-E1
gccagcccaagccatgaacgccgccagcaccgtcgccgcggcccccgcgcctgccgcgaccgtgcaggtgccgcgcgggcaggtggatctgatcgacttcatcgactggaccggcgtcgagtgcctcaaccaggactcgtcccacagcatcgtcaacgcgctcaagcagagtttgagagacgacgaggggctgtacctcgccagcgattcggacgagcagctgctgatctacatccccttcatgcaggtagtcaaactgcattccgcgctattcaaaggtcccgaggaagagggccccaaaacagtaaaactcttctccaacaaagagcatatgggtttcagcaatgtcaatgactatccaccaagtgacaccctcgagctatcatccgatcatttgatagagaataaacttttgccactaaagtatgtcaagtttcaaaatgttcgcagtctgactatatttattgaggacaaccaaagtg

SEQ ID NO: 44362 - DNA, 420 bp, Zea mays
  unsure at all n locations
  Clone ID: LIB3066-056-Q1-K1-E10
cggacgcgtgggagaaaaaggagagcgccgtttgtgatagagataatgcggtggtggtgctcatggatggatgaatgggggtgtcaggctatgcgcggatgacgtcctcatcggagcaaaccccttcaccgttggttgcctcgtgccgtggcctgggaagtcgatgactgctcatcatggtaggaggccccgaccgaccgtgcaaccgtgtgccgacgctgtggctgtgcgccaatgaaatcacgagcgaggtcacgagtcatctgaagagcaagttggtacctggaatctcaagtgccaggtcaagaacaggtaccacaggatgaggcgcttggaggatgctgtgatgagttcgtgagtggtctangccggcgtcttccatcaactttgggttgctggaccattgtcttcttataatgt

SEQ ID NO: 44363 - DNA, 433 bp, Zea mays
  Clone ID: LIB3066-056-Q1-K1-E12
cccacgcgtccgcccacgcgtccgcccacgcgttcgcccacgcgtccgcccacgcgttcgcccacgcgtccgcccacgcgtccgctaaaaagaaggttagattagggagcccagcggctcaatggatttcagtttataatgctaggcgacccatgaagcagaggtaccattacaatgtggctgactcaaggctaagtcaacatatagaaaagggtaatgatgacgggctttacgttagttgtgtggcttcctcggcaaacctttgggcactcatcatggacgctggaactggtttctgttctcaagtttacgagctctcaccagtttttctccacaaggactggataatggagcagtgggagaaaagttactacataacagcaattgctggatcaaccaatgggagttcattggttgtcatgttcaaaggaac

SEQ ID NO: 44364 - DNA, 455 bp, Zea mays
  Clone ID: LIB3066-056-Q1-K1-E2
gttccaaagggaagggagcacgcgcgcgcgaggtagagcagcggcggcggcggcaggagtgaggcaggatgtcttcggtatacgtgcttgagcccccgacgaaggggaaggtggtggtgcagacgacggccggcccgctcgatatcgagctgtggcccaaggaggcccccaaggcggcgcgcaacttcgtgcagctctgcctcgagggctactacgacggcaccctcttccaccgcgtcatcaagaatttcctcgttcagggtggcgaccccactggctccggcactgggggtgagagcatctatggggctccatttgcggatgagttccactcgcggctgaggtttaaccacaggggtttagtggcttgtgccaatgctggtacatctcattctaatgggagccaattctttatcacccttgaccgttgtgattggcttgattagaagacacca

SEQ ID NO: 44365 - DNA, 475 bp, Zea mays
  unsure at all n locations
  Clone ID: LIB3066-056-Q1-K1-E3
gattgttttgtgaagacgctcaagaatgatggccctttggcattttacaaaggcttcctgccaaactttgcaagactgggatcttggaatgtgattatgttcttgacattggagcaggttcaaaagctgtttgtgaggaaagcgacaagctgatgatagagtttttgcagtcaggtggcgtacaattgacgcacagggtttttcttctatagacaaaaggggagaaatgacacctcccccctcgagaattggggaacaaggacagatctgacacctcaattgcgagaaataaaaataacagccgacagttgcatgatccctgaacgaataaattcagaactagaaaacagatgtcagtaaacaacatgtggtgaatgttggaacttgaactgctctagttcagtgggcatctgttgatgcatgcttgggatggatntaatgtttcgtantttttctttcttgtactgaaatgctc

SEQ ID NO: 44366 - DNA, 462 bp, Zea mays
  unsure at all n locations
  Clone ID: LIB3066-056-Q1-K1-E4
cggacgcgtggggtccctcatgcgccgcatggagatcgcggccgactccctctacaaagccaagcttatccgtgggttctgccacctctacgacggccaggaggccgtcgccgtcggcatggaggccgccatcacccgctccgattccatcatcaccgcctaccgcgaccactgtacctacctcgcccgcggaggggacctcgtctccgccttctccgagctgatgggccgcgaggctgggtgctcccgcgggaagggcggatccatgcatttctacaagaaggacgccaatttctacggtgggcacggcatcgtaggcgctcaggtgcccctcggatgcggcctggccttcgctcaaaagtacaagaaggaggacacggncacgttcgcgctctatggtgacggtgcggctaaccagggacagctctttgaggctctcaacatttcggccctctggaagct

SEQ ID NO: 44367 - DNA, 474 bp, Zea mays
  unsure at all n locations
  Clone ID: LIB3066-056-Q1-K1-E5
cccaccctcatttgacgctgatgataaaaaggccctcgcggtcgcaccacatacaggcaaccagcctcttgatcacttgatcctcctgcacaccagagtaccagacaccactgcgcatcagtgcaaagaggtagctaccctatctgccatggctcaagagctccacgaaacgtcctcttgctctgccaccaccacctcgtcgtgcaccacatcctgctgctcgtccactgtcacagactcgtcctcttcgcccccgtcaccggcggcggccaatgccgcgcccgcgacacggaagcggcaggcgttggaggccgaggccgaggccgaggcgggcggtgaggaagaggaggaggaggaggaaggctgtgctggtaataaggcggcgccggccaagaagcgaccgcggtgcagcgaggggaagcacccgacgttccgcggcgtgcggatgccggcgttgngcaaagtggtgtcgga

SEQ ID NO: 44368 - DNA, 476 bp, Zea mays
  Clone ID: LIB3066-056-Q1-K1-E6
ggccgctggagcacaatacccgcggcgagcctgactccatcgtcgcgctggccaaatggaggatcctcaacaggttgcacgaccggaacgagacattgtactacagggtgctaattgacaatatcaaggattttgccccgataatatacactcccactgttggcttggtctgtgaaaattacagcggtctgttcagacgaccccgtgggatgtatttcagtgcaaaggataagggggagatgatgtcaatgatttacaactggccagcagagaaggttgacatgatagttgtgactgatgggagtcgcattctaggcttaggtgaccttggtgttcagggcataggtatacctattggtaaactggatgtttatgttgcagctgctggtattaacccacagaaggttcttccaataatgcttgatgtgggaacaaataatgaaaagcttctggaggacaagctatatttaagactg

SEQ ID NO: 44369 - DNA, 385 bp, Zea mays
  Clone ID: LIB3066-056-Q1-K1-E7
gttgaccttgtcaggaaagctatgccccttgtactgacacctgagaacgatccggggaaggatgagctcaagcagctccaggtgcagctggaaaacatcaacaagctggcacacaagcaggtccggcgcatcctctggtctggtctgggtttcttgatcacccaggtgggcctcttcttcaggctcacgttttgggagttctcgtgggacgtgatggagcccatcacgttcttcacgaccactacaggcctggtcgcgggatacgcatactttctcatgacgtcaagggacccaacctaccgagacttcatggagaggatgttcgagtctcggcagaggaagctgatccagatgcagaacttcaacttggacaagtaccttgagc

SEQ ID NO: 44370 - DNA, 475 bp, Zea mays
  Clone ID: LIB3066-056-Q1-K1-E8
cccacgcgtccgcccacgcgtccgcccacgcgtccgcatgacatcctacagggagctctcgaagaaagcacagaaagcgaacaacatctggtggaggctgagcggactgctgggtgaccggaaccggcaggtcatgtacatactgctccaggcgctgttcacagtggcaacaatggcactgaccgtacctatattcctgtcctaccggatgcacgtggtgttcctgatactcaaggtgtgcgcgtcgacatggaacggtggcagcttcatcttggaggtgatgcctcggcaagtagtgcagaagcagctgaagaaactggacatgaagcctatggaacaggggagctcgacacatggtgcgccaggtggtgatggtggcacattgtgtaaccaccaccagcacacatccgaggagcatatccaggagtgaggaaattgaagctggatgtaagattagattttgatgatcactgac

SEQ ID NO: 44371 - DNA, 309 bp, Zea mays
  Clone ID: LIB3066-056-Q1-K1-E9
aaaaaacataacagcacaatggaaaggctccttataatgatcacaatatgaaaaaacataaagggggacatgaatgctagcttctggagccaaaagtcaaggcaataatcagaaagattgtacatcctatactgaaacactaaagggctgcccattttacatacccaagatgaccctcccctgacgtgaaagatgcatttctgtctttagtggccctaaaattaaattagctggcctagattttaacagtattattccgggaaaaccccagggtttactaagctaatggcctttatagaaaatcccttt

SEQ ID NO: 44372 - DNA, 430 bp, Zea mays
  Clone ID: LIB3066-056-Q1-K1-D6
cccacgcgtccgcccacgcgtccgaaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgatcgtcacagatcccagcctagctctgaagctggaggtgttcgacaaggacacgttcagcagggacgacccgatgggggacgcggagatcgacgtggcgccgctggtggaggcggcgaacgcgagcccgga

SEQ ID NO: 44373 - DNA, 450 bp, Zea mays
  unsure at all n locations
  Clone ID: LIB3066-056-Q1-K1-C3
cccacgcgtccgcgctcggcttccccggttcttgagaggggaaagaggaggcggaggagagggatggggagggacgagaggttcccagtgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagcgactacaccctacaggtgttggtaggctactgcgccgtgtacatcttcatgcagaccttcatgatcccagggacaatattcatgtcactgcttgctggtgctctgtttgggcagctccggngcgttgccctggtagtcttcgccgccactgctggcgcttcttcgtgctatntcctgtcgaagatgattgggaagccactg

SEQ ID NO: 44374 - DNA, 452 bp, Zea mays
  unsure at all n locations
  Clone ID: LIB3066-056-Q1-K1-C4
ggcaactccccggcctccgtcatcgtgctcgccgacaacagcttcggcggatgcctcccggccagcctcggcaacatgtccggcacgctcaacgagatcctcctcatcaacaacggcctcgactcctgcgtcccgccggaggtcggcttgctccgggaggtgaccgtcttcgacgtcagcttcaactcgctcgtcggcccgctgccgcagcaggtggccgggatgcgcaaggtggagcagctggacgtcgcgcacaaccgcctgtccggggccgtcccggaggccatctgcgccctcccgcggctcaagaacctgaccatctcctacaacttcttcaccggcgagccgncgtcctgcgcgcgcgtcgtgccttcggacggtgacaggaggaactgcctgcccaaaccgcccacacagcgcacgccgcagcagtgcgccgcgttctactcgca

SEQ ID NO: 44375 - DNA, 455 bp, Zea mays
  Clone ID: LIB3066-056-Q1-K1-C5
cccacgcgtccgcgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgacggacgcgctcgccggctgcctgcgcatcgccgaggacatcaggcaggacgccagcgacacgctgatcacgctgcacaagcagggggagcagatcagccggacgcacgagaaggccgtcgagatcgaccaggacctcgccaagagcgagacccttctcgggagcctcggaggcttcttctccaagacgtggaagcccaagaagacgaggcagatcaagggaccagcgcatgtgtcacgagatgactccttcaagaag

SEQ ID NO: 44376 - DNA, 461 bp, Zea mays
  Clone ID: LIB3066-056-Q1-K1-C6
ggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcagcggcaatggtctggtcaatggacccgcaggtgaccgtccacggcgactgggtgtcagccgtggtgccgctgatgaagctgctgtgcctggcggtgatcggcctgctcctcgccaacccggcggtccaggtcgtgcccagggccaccttcaagct

SEQ ID NO: 44377 - DNA, 474 bp, Zea mays
  Clone ID: LIB3066-056-Q1-K1-C7
cgcggtttcggggcctcccggaaaggcagcaaggggcggcttgggagtgttagtgattactgcgtacaccactgtgtatgtcctgttgtggttgttcgctaccctgatgatgctgcagatgccggtggagatgcatcaggggtgacagatgagttgcacactgtaccagaggacgaacctgtttatcacgatgcacctgaggtgcagaaagaaaactgaggcaacggccacatgcggctgaagaacgaaggaaaacatgaggcttgtagtgaggcaatcctgtgtatctggaagatgggaccggctgtttatctttgcttctatatatcaactgcgtatcatgatcagctgtctgcttcccgttgagtttcatatcagagtcgtagatcatctgagttttttggtggtttgcttgtgagatgtagagtactcttcccgtgggtcgaaggtgtcttgcaaatgcttgaactttat

SEQ ID NO: 44378 - DNA, 478 bp, Zea mays
  Clone ID: LIB3066-056-Q1-K1-C8
gtacctctgttatatggctatgtatctcatctttgtggagtttggaatttactggatgcacagggagttgcatgacataaaaccattatacaaatatctgcatgcaacccaccatatttacaacaaggagaataccttgtctccatttgctggacttgcatttcatccactggatggtattctgcaagcaataccacatgtgttcgcgctcttcctctttccaacgcacttcaggacacatattgcactcttgttcctagaggctgtgtggacaacaaacatccacgactgcattcatggcaagatatggccagtcatgggtgctggatatcacaccattcaccatacgacttaccgtcacaactatggccactacaccatctggatggactggatgtttggtacgctcaatgagccagaagatatcctcaagaaggcttgagtttctcggagctgtggtattcctatggtgctgctg

SEQ ID NO: 44379 - DNA, 456 bp, Zea mays
  Clone ID: LIB3066-056-Q1-K1-D1
catcggtcaaagacaaaagatgattgctgtgagcatcatgtggtcattagtgcaggtgcaggtgctggcggcgatggcactagcatttctggtaggcggtgcctggtgtggtcctcccaaggttcccccgggtaagaacatcacagccaactatggtagtgattggctagatgccaaggcaacatggtatggcaagccaacaggtgccggcccggacgacaatggtggcggatgtgggtacaaggacgtgaacaaggcccctttcaacagcatgggcgcatgtggcaacgtccccatcttcaaggatggtctaggttgtggatcctgcttcgagatcaagtgcgacaagccagcggagtgctctggcaagcccgtggtggtgtacattacagacatgaactacgagcccattgcggcgtaccacttcgacctagcatgcacggcgttcggtgccat

SEQ ID NO: 44380 - DNA, 433 bp, Zea mays
  Clone ID: LIB3066-056-Q1-K1-D10
gaaactatcgccagcaaagggagagcgccgaggtgatagagataatgcggtggtggtgctcatggttggatgaatgggggtgtcgggctatgcgcggttgacgtcctcatcggagcaaaccccttcaccgttggttgcctcgtgccgtggcctgggaagtcgatgactgctcatcatggtaggaggccccgaccgaccgtgcaaccgtgtgccgacgctgtggctgtgcgccaatgaaatcacgagcgaggtcacgagtcatctgaagagcaagttggtacctggaatctcaagtgccatgtcaagaacaggtaccacatgatgaggcgcttggaggatgctgtgatgagttcgtgagtggtctatgccgtcgtctgccactcaactttgggttgctggaccgttgactacttataatgtaatcaattattta

SEQ ID NO: 44381 - DNA, 267 bp, Zea mays
  Clone ID: LIB3066-056-Q1-K1-D12
cagaataaaaaaaaaaaaaaaaaaaaaaaaattaaagaaaaaaaataaaaaaaaaaaaaaaaagaaataagaaaaaataaaaaaataaaaaaacgtacatacaaacaaaaagaaaaaaaaataatggaacaaaaatataaataacaaagggtcgtgtaaacaataggttaaccaaacttaataggctatcatcacacaacacttttgttgataaaactccctatattacaggcctttgccgattacgtatcggccccgtttttgaaa

SEQ ID NO: 44382 - DNA, 452 bp, Zea mays
  Clone ID: LIB3066-056-Q1-K1-D2
cacacgcgtacgacaacacatgcgcgcactcttcctgagatgattcaatacctacagctgtaagccaagcatgagctgatgcttgacaacaggcatggcgcacggtcatgatctatttctgtacgaatggaagacgcatactgattagttccttcaggatcctattcggggcatcagagataaaatgctggtagagatcgcaacatgtgatacacagtgaggattcagacgctgatgcccattaactagacatagtgcctgctgcaaggcgccttgtacccgaattcatgatgtaccctgctggaatagtgagccctttttgaaagtgcttttaagtatgaatgccaccacgactgactagtatttgtgaatgatctttgtgtatctcacgacatacatggactttcatgttcttgcgatctaagaaagtactcataattttctagaagatt

SEQ ID NO: 44383 - DNA, 356 bp, Zea mays
  Clone ID: LIB3066-056-Q1-K1-D3
gccgtggtccctgtctttctccttcggcttcttggtgcaggcgagcaccctgaaggcccaggctctcaaggtggagaacttggagaatgctagagctgccttcctctccaggtgcaaggccaactctgaggctaccatcatcacctacaacggtgatgctgacggcgacaccgacagcctaaacgtcaaggactacacgtactgagctgctcctctctgcatgcccgtcttggaactcctgactaccagctacgttgccgactgtggtttgctcgtcagatcttatattctgacattcaaaaaacatgcttcctatttgggatgatggttatatatatattgcgactgtaattatt

SEQ ID NO: 44384 - DNA, 468 bp, Zea mays
  Clone ID: LIB3066-056-Q1-K1-D4
gaagttctgctactacaacaactacaacatcaagcagccaaggcatttctgcaagagctgtcagaggtactggaccgcaggcggaagcatgagaaacatccccgttggtgctgggaggcgcaagagcaagagctccagcgcgagttgccgcagcgtgttgattcccgttccaggcagcagtagtgtagctaatcctggcggagaggcttccctgtttccgttgtccgtaaaagcaaaccaagcagcagttagcttcgggcctgattcccccctctgcacctccatggcctccgtgctgaagatcggaggaagaggagagcaggttaagagctgcagccctgcctcagcagcagcacagcccaggaacggagaaacccagacccagacgtgcgcaccttcttctgctgctacaacaccatcagatggtccagggaatggattgcagaaaggagcagagagcgcacacca

SEQ ID NO: 44385 - DNA, 414 bp, Zea mays
  Clone ID: LIB3066-056-Q1-K1-D5
gtgaaacatccacaagatgttctacctcctgcgcttggagcgtcaatgtatgccatcacatgcatcctttcattcgatggtttgccttctatggttccacctaatgacctttcagcaaaccgaggttcaggccaggatttagcagaagctagcaagttctctcagggaagaagagcgggttatattccacctagtggttttctgatgtccttgttagctgataggacccataatccaccttctttccagaactcatctaaccatccaggaggtggttcagcgcatactcggccatccagggctcctgttggtaggtttgatcgatctcggcgacctttccgcaattctggacctgggagttcagcaccacgttctttcaaaaggcagcgcgacgctccacggtgagcaaggcat

SEQ ID NO: 44386 - DNA, 480 bp, Zea mays
  Clone ID: LIB3066-056-Q1-K1-C2
cccacgcgtccgcccacgcgtccgggagcacagagctagctagccagccagccagcagccagcttgctcgccgcgcccgtccttcttcctcgcctccgttccgttccgttccgtcccgcccgccgtcgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgtcctcggggccgccgtcgcctccttcttcgcctactacattcagtgagccggccgcggccggtcgcccggaggccgaggaagagacgaagcgggagagagagtgacatggctgcgcgcattccgatgcgtgggcatgtttctgattcgacacaccttttgttctctttttctttgttccctctttctgcttaatttaacgaattgat

SEQ ID NO: 44387 - DNA, 208 bp, Zea mays
  Clone ID: LIB3066-056-Q1-K1-B1
gcaacaggaagtagaactatagaacaagaggcttgaatgaaatgtatgtatcagactcgccccgttttttttttgtccatgtactgcagtgcagcggactgagccgctggcacagcatgcggtaataatcttgtcacaatgacagtgctgtaatcgggagcgtgtttcttgtaatcttgttaggaagtgtttctggttttgtttgagc

SEQ ID NO: 44388 - DNA, 367 bp, Zea mays
  Clone ID: LIB3066-056-Q1-K1-B10
tcgggtgaagccggtggacattatcacccccaccgtggccgcgcacatacaggccaccgtggcgtgcgggcgcaagcacgggctgcgggtccgcgtgcggagcggcgggcacgactactagggcctgtcgtaccggtccgtcaagccggagacgttcgccgtggtggacctgtccatgatgcggcatgtgcgcatcgacggctaggccgccacggcttaagtggacttcatggcgcagctcgcccagctctactactctctggcgaagatgacccccagtctcaggtttcctgaggtcgtgtgcgccacgatcggcgtctgaggccactttagcgggcgcgtgtttcagcattgctgctgcgcaagt

SEQ ID NO: 44389 - DNA, 445 bp, Zea mays
  Clone ID: LIB3066-056-Q1-K1-B11
gcaactgaaaacagccgagcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatgacgcctgggcagtgcaacatggtg

SEQ ID NO: 44390 - DNA, 318 bp, Zea mays
  Clone ID: LIB3066-056-Q1-K1-B12
gttctagatgcgagcgccgcccttttttttttttttttttcttatagacaaattggatgtctgctagactagatcgcgtgtctatatatagatatagatacaatctgcttgaacgatcgccctcaaaactggatcaacaaacttaaaatacaaacaataataatagggaggaagatcctctccgtctgcgtacacagcacggccatcacctagtactacaacgacgacatccacaacatcatgaaggactatccccagccagatcacatcgtgcatacaggcctgtttgtaggacttaccaagtaccatcgtcatcca

SEQ ID NO: 44391 - DNA, 378 bp, Zea mays
  Clone ID: LIB3066-056-Q1-K1-B2
cccacgcgtccggaataattttactaatcaaattcttggtgggatatattcctacaattcccgttctccttcgaacaaggcaacaacaatctgttccggtcgccaaacaaaaccaaataaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgtcgcggagaccgtcgtgccccgcacccatcgtcctgctgcagtccgcgttcgtattcttctacgctaggaagcctgcgggcggtagtctgcggctgcagctgcaagcatgctgcgagcc

SEQ ID NO: 44392 - DNA, 448 bp, Zea mays
  unsure at all n locations
  Clone ID: LIB3066-056-Q1-K1-B3
cccacgcgtccgcccacgcgtccgatttcccagccgccgcggcgccacgcagacctagcagagaaacacccacccgagatggcgatggctctgcgccgccttgcgggcgtgtccggatcgccgtcggcctcctctgccgcggccacggtgctactccggtcggcgctgacccgcccgatctccaccggcttccgcgaggagcgcgacaccttcggtcccatccaagtccccaacgacaagctgtggggcgcgcagacgcagagatcgctgcagaactttgacattggcggggagcgtgagaggatgcccgttcccatcatccgtgcctttggcgtgctaaaaaagtgcgccgctaaggtgaatatggactatggccttgatccaacaatagggaaggccataatacaggcagctgangaggtcgcagagggaaagttggatgatcact

SEQ ID NO: 44393 - DNA, 485 bp, Zea mays
  unsure at all n locations
  Clone ID: LIB3066-056-Q1-K1-B4
cgagaaccccgagaagagcatcgacaccatccacatcgacggctacgccttcttcgccgtcggcatggggcccggcaaatggacggcagcgtcgcggagtacgtacaacctcctggacacggtgagccggcacacgatccaggtgtacccaaggtcgtggacggcggtgatgatgacgttcgacaacgcgggcatgtggagcgtccgctccaacatctgggagaggcagtacctcggcgagcagctgtacgtgagcgtcatctcgccggagcggtcgctcagggacgagtacaacatgccggagaccagcctccgctgcggcaaggtcgtcggcctgccgatgccaccgtcctaccgcgccgtctagagcgtcgaccgatcgcgcacggtgctgtacacaactaaaggagagcgagaggggactntntctcgcgtttccttctctagccagccttgtctgtccccttctcgttaatctctctctc

SEQ ID NO: 44394 - DNA, 474 bp, Zea mays
  Clone ID: LIB3066-056-Q1-K1-B5
cccacgcgtccgcttttttttttttttttttttaacaacaaacaaaaaaactactatctgagctcaaatttgtacatttagaacgacataatctacttggacctttacagtaaagggcagaatgataaattcttggttgtatcattcacaagtaaatgcatctcctcctcaagatatgccgatcgtcttccctagcagccacattaccagcgagaactcgatcataaacagcgcgtgtagccatgtccggtcgacgacgaaaccgaacaccgtgatccccgcccggttgttctccaagtacgtcactagcgcctgcctcttctggaaggagacgttggtggcgtggaaaggcgtgaaccttgaggtgtccacgccgtcctcgctccgccactcgtcgtcgtcggactcttcgccggacgacgcgcccgccatcgggaagggactcgtgggcgtttgctgctgcaggcacgcttt

SEQ ID NO: 44395 - DNA, 481 bp, Zea mays
  Clone ID: LIB3066-056-Q1-K1-B6
cggacgcgtgggtggcggtgtagtctatcagctgagtgggaaagagtggagcaatggtggggggctgtgccagcggcgacggcgccgccgaagggacgctcgcgaggtggcggagggcggcggccaagcggatcggcctctcatgcgcctccttcttctcctacgccgcctctccctccccgcctccttccaagaccatctcccactccgcactgaatgcgcctgatggagagcagcaaaagatggaggaacccaccagcaccagagtggctgacaagaatctatgtgcaatatgtttggaactcctcagcacgagcatcagcagcgatgttgatagtggtgaggcggcagcaatctacacagcgcagtgctcccactcattccacttcctatgcatcgcctccaacatccggcatggcaacgtcagctggcctatctggcgtgccccatgggtctgagctaccacgtgacctgaaggttc

SEQ ID NO: 44396 - DNA, 475 bp, Zea mays
  Clone ID: LIB3066-056-Q1-K1-B7
gttgccgtgaggtggatcttttcgtgaagcaagtagacgggaagaaggtgactgatcctgcgaaacaggacgcgctgcggtcacgcctgaggtccgagacgctccatccgctcagggtcatggtcgtcggccgtggacccgacacggagctcctcgtcgccaacccggtcgaggcctccgggaagggacggccgcgcgtgttctacgacgccactcttgctctcaaggcgcttgggatctgcatcttctctgctgagatcgggaggcaagcggcgtccgagcgccattgggaggtgtacaggttcctcctggatgacagcaaggagttccccttggcaagcagcctcgctaacaggaactgtgtcgtcgatagggcgaggaagacgctgatgggatgctacaactgagacttgggtgggtgtcgatctgtatctgtctgcaagaatccaacgaagcaatgcaagtgcaatgcaag

SEQ ID NO: 44397 - DNA, 452 bp, Zea mays
  unsure at all n locations
  Clone ID: LIB3066-056-Q1-K1-B8
tgaataactcgatcgagatagacctatcgctatcggtgtagcattcaagtagggaggtggccatgaacaacattgaatcgtcggagctgaggaaggtgttccaaatgttcgacaagaatggcgatggccagatcacgaagaaagagctaggggagtcgctcaagaacctgggcatccacatctctgatgacgagctcgatgccacgatggacaagatcgatgccaatggtgacgggtgcgtagacgtcgaggagttcggaaagctctaccgctccatcgtcggcgagggccaagtggacaagcacgacgaggaagaggacatgcgggaggcattcaacgtcttcgaccagaacggtgacggcttcatcaccgtggaggagctgcggtctgtgctgtccagcctcggcctcaagcaagggcgcacggccgangattgccgtaagatgatcagc

SEQ ID NO: 44398 - DNA, 441 bp, Zea mays
  unsure at all n locations
  Clone ID: LIB3066-056-Q1-K1-B9
agtggttntaatggtcatttctggggtttttgcaacaaacgataaacacgattggagtttgactcaatctgaggttgctgctgttgtatatgctggtgtcatggcatctgctcttaattatgtcctattgacatggtccaacaaaatactgggacctgctatggtggcactttatagccctcttcagccagtggtctctgctctattgtctatgatttttctgggaagcccaatttaccttggaagtatttttggaggacttctaatcatctccggtttataccttgtgacctgngcacgccacagagaaaaactgacaagtattggagtaccttatgtaacatgtgtatcggagtcactcgatggtccttctcatgttgcaaagactgtgcccttcatatctctttcaaggctgtgggatgtgccacatgagtcttgaga

SEQ ID NO: 44399 - DNA, 494 bp, Zea mays
  Clone ID: LIB3066-056-Q1-K1-C1
tcggcgtcatgcaacatcggtcaacaaagatcttgaatctaagctaaaaaatgcctctacacttttggtgaagttgcaagatgagttttctagttatttgaaaggggaatgcacacaagaggttagtatagatggagatgcagagagacaaccattggtgtttatcaagatgaagctagcaaatgccaggaaggagcttgaggacatgagagcagacattaaaaaattcaaggatgatgttaggaaactttggaatgtcgcagctacatttcgggctgatatagatagggaggaggcaggtctactagcattagagcacaaagagcaccttgcttcgatttctgtatcatctcaccaggaagagctaagcaacattacatatgagctcaacatcatccatgaaagaacaaaagcaactaagatgcctatagagctacaacaagcaactgaaagtgtggaacaagcaaaagctaaggctttgatggcccattata

SEQ ID NO: 44400 - DNA, 282 bp, Zea mays
  Clone ID: LIB3066-056-Q1-K1-C10
gcatctggttcgggcgctgccacctgtggattagcgagaatgacggcgacaatgagctgtggaactgagacaatggcctagatctcaagaacgatccattagttcgaatttggacggtgccaggccaacacgtatacaagtagatcataagctacgactggatcatataacttgaagatttgaactacctagtctctaggacatacgatgaaactagagcgctggtagaggcaaacaaatgggacgtgtcagtgcacaaagactatctagctatggagagac

SEQ ID NO: 44401 - DNA, 401 bp, Zea mays
  Clone ID: LIB3066-056-Q1-K1-A9
cccacgcgtccggagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaggacaagcctcaacccccacctgagggccgacttcctgacgccactaagggttctgaccacctgaggcaagtttttggcaagcagatgggcttgagcgatcatgacattgttgc

SEQ ID NO: 44402 - DNA, 411 bp, Zea mays
  Clone ID: LIB3066-050-Q1-K1-A6
gccccacacacacaaaagcaaaaagcatcatcacaataatggcccgcgcgtgtgtggtcctcgtggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgcctcatccccggactcgccgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatcaaatgcgtgcggcaaacgcatggaatgtg

SEQ ID NO: 44403 - DNA, 393 bp, Zea mays
  Clone ID: LIB3066-050-Q1-K1-A8
cggacgcgtgggcggacgcgtgggtttccatatattggtaatagtttgattagcggtgctatattaacacttcacattctttaagatgacaacatagatattgtatggattcttagtgttgactcttccgagtcctagaactgtgtcaaccatcatataaagtagttgcttcttcatgtcagatagtctatttgattttgtattgatgtggacatatatatgcttgacattgtgattatttgctaaaaaaaaataaaaaaaaaaaaaactataaaaaaaaaaagaaataaaatgaaaaaaaaataagaaaataataacaaaatggaaccaaaaaaaaaaacaaaaaacgaaaaagaccgggaaaataaaaaaagggggcgccccttttaaagg

SEQ ID NO: 44404 - DNA, 289 bp, Zea mays
  Clone ID: LIB3066-050-Q1-K1-A9
caggccttggcggcctcagcagcgcgggtgcgtggactcgacgacgcgcgggcactgcgcggtagcgcgagcgcgcggcacctcgggcgcgaggatgctaccccgtcgcctgggcaggcagccccggcgcacaagcacgagcgcggtccccagcagcgtgctggctcgtggccacggcgcgagtgcgctgccatggctgggcgaccaggcatcagcgcaagcacatcccaactcgggttacgccatggcaggggctgcgcccaccgtcgctgttcacttggacgcaaac

SEQ ID NO: 44405 - DNA, 421 bp, Zea mays
  Clone ID: LIB3066-050-Q1-K1-B10
cccacgcgtccggacgacgaccacctcgccgccgcccatgtcgtcggtcccggactgggccgacgccatcgtccccaacagcaagcgacggcgccaccggtcgccgcccgccgcttcatcctcctcctcgcacagcagcagcaccacacagaaagaggaactggaagacgaggaggaggacatggccaaatgcctcatcctcctcgcccagggccccgccgccattgaggcagctagagtaatgccggcaccccgtagcaggccaaagagcacggggagccgcaggttcttggccgccgccgaggccagaggtggtgtgtgcgtgtcgtacgagtgcaagacgtgcaacaggtgcttaccctccttccaggccctcggcggccaccgcaccagccacaacaagcatccgcgacggccagca

SEQ ID NO: 44406 - DNA, 418 bp, Zea mays
  unsure at all n locations
  Clone ID: LIB3066-050-Q1-K1-B11
gacccacgcgtccgcccacgcgtccgcccacgcgtccgcccacgcgtccgcccacgcgtgcggccacgcgtccgcccacgcgttcgcccacgcgtccggacagggcgaggaaatggaataagacggctattccaatcctaatcgggacaaagttcgatgactttgcccagcttcctcttgaaatgcaatggaccattgttaaccaggccagagcatacgcaagagcgatgaaggcgaccctcttcttctcgagcgcgacgcacaacatcaacgtgaacaagatcttcaagttcatcacggccaagttcttcgacctgccgtggacggtggagcgcaacctcaccatcggcgagcccatcatagacttctgacgacctnctnctctagctaagtaattaggcagcacacacgacgaccc

SEQ ID NO: 44407 - DNA, 420 bp, Zea mays
  Clone ID: LIB3066-050-Q1-K1-B12
atggcatgccatgcacggattgcaactccaacagctcaattaggtcttccagaacttgagttaggaattattccaggatttggaggaacacagcgactcccacgactggttggtctgacaaaatctttggaaatgatgctgttatctaagccaatcaagggcggtgaggcacaccaactgggtctggttgatgccttagtttctcctaatgatttggtgaatactgctcgtcaatgggctttggatatatatgaatgtaggaggccctggatcaaaagcctttataagactgacaagctagaacctcttggggaggctagggaaattctgaagtttgcaagagctcaagctcaaaagcaggcagctaatcttcatcacccacttgtttgtattgatgtcattgaagaaggtatagttgca

SEQ ID NO: 44408 - DNA, 407 bp, Zea mays
  Clone ID: LIB3066-050-Q1-K1-B2
ctttcgttatcctcctcgatcttaattacaggtcatagctaagcaggtctgacaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgaccccccgccagtgcaacatg

SEQ ID NO: 44409 - DNA, 400 bp, Zea mays
  Clone ID: LIB3066-050-Q1-K1-B3
cccacgcgtccggacaaattcatatgaagtggttgataaagactagcatcagccttgagcccctgctggcacaacttcatcattgtggtcacgacttgactccagatgaatggaggatcatctataaccgccatgaccgtgaccttgttagttcgtctgcacaagatgatattgatgatgaatgggactttgaaaatgctcatgagattgtccttgaagcacctaacaatgttaatgactggtaccctatagattttctcgtatttcatccttacaaggagattgtcttcttttccttatcatggaagacaatatcttataatttgaataccacaaaggttcgacagctgggctgcgcagctcatataccggtgggcataaaaaccttgttttcatacac

SEQ ID NO: 44410 - DNA, 355 bp, Zea mays
  Clone ID: LIB3066-050-Q1-K1-B4
cccacgcgtccgaacacccccaccaagacccgtgggcttggagctggcaaggctgggcgcctcacctactgggagagcgctgcccgcatgattgcggatgtctccaagtctgacaagattgttgttgagaagtccactgtccctgtcaagaccgctgaggctattgagaagatcttgacccacaacagcaagggcatcaactaccagatcctttccaacccagagttccttgcggagggcactgccattgaggacctgttcaagcctgacagagtgcttatcggtggccgggagacccctgagggcaagaaggccgtccaggctctcaaggatgtgtacgctcactgggttcccg

SEQ ID NO: 44411 - DNA, 380 bp, Zea mays
  Clone ID: LIB3066-050-Q1-K1-B5
atccaagctagcagctcagctctccactccctctctgtgctgtgctgtgtaggcggtcattcatgcacttggcgttcttgcaattgcagcccccttctcctcctcatccttgtcggggcagttagctaggtgagaatagtgcagtggagctcaacaggccagcgataagcaattaatggaggtagaggcttgctacaactatggcttcctacctgcagacagaggcaggcaccaaccaccacctgcaccacatgccacccttcctcacgctgcagaggatgcaggtgagctgtgggagtacttcccttgccccttttgctacatcgaggtggaggtgcccttcatctgcaaccaccttcaggaagaacattgctttgaca

SEQ ID NO: 44412 - DNA, 394 bp, Zea mays
  unsure at all n locations
  Clone ID: LIB3066-050-Q1-K1-B6
agcaaagcaaagaggatcggatcagaagaaaagaatagttaggtcccggtgggggatcgaacgaagctgctgctgctaccggccggccgggcatgacgatgacacggacgatgtgcctaggcctgctgcttctactactggcggcggcgtcgacagcgacggcgctttcacggtcggcgatgtggatgagtacgtgtccaagcgcacgcaggagtcccgccacaggaacaacggtggcgcgggcatcgatgacctcatctncagtgcggcgcgcttccacgccaacgtggatgcacgcgcctatggccgtagatccgacctgcaggaggaggcaacagctaccgtaataaccaaagcggaagcacaagaggcttcagctgaaggcaagctggac

SEQ ID NO: 44413 - DNA, 393 bp, Zea mays
  Clone ID: LIB3066-050-Q1-K1-B7
actagttctagatcacttacaaagtcgtcgtgcaagtttgcgctcaaggggctcaggaactggatgaagcccgagaaggtacctgcggccataactacattcccgtcctccgcccaaatcgtgccggagcccctcggcgtcgtgctcatcatctcagcctggaactaccctttcatactctctatcgacccagtcattggagcaatcgctgctggaaatgctgttgttctgaagccatcagaaatagcgccagctacctcgtcactgttagcaaagctgctacccgagtatgttgacaactcctgcattaaagttgtggagggaagcgttccagaaacaaccgcactcttggaacagagatgggataagatcttctacacaggtaatggaact

SEQ ID NO: 44414 - DNA, 353 bp, Zea mays
  Clone ID: LIB3066-050-Q1-K1-B8
atccaatccagtcgcctgattgcattgggatcccatggccaagctcgccgtcgtggtcctcctcgccgtggccgcgtccgccacagtgccggcgcacggccgcgataccccgactgagatcaagctcatcaaaggcacggacgcctccggcgtgggcgacgacagcatggagtgcgtgtacacggtgttcatccggacggggtcgatcttgaaggccgggacggacgcgaacgtcacgctggagctggccgccgcggacggcaacggcgtggggatctcgaacctgcccgcctggggcgggctcatggggcagggctactcctacttcgagcgcagcaacctggacatcttca

SEQ ID NO: 44415 - DNA, 325 bp, Zea mays
  Clone ID: LIB3066-050-Q1-K1-B9
cccacgcgtccgggaacgcacacaccgtccggtccccgatctccgatcccctcgtcgagccaaagatgcagatcttcgtcaagaccctcactggaaagactatcaccctcgaggtggagtcttctgacaccattgacaacgtcaaggccaagatccaggacaaggagggcatccccccggaccagcagcggctcatctttgctggcaagcagctcgaggacgggcgcacacttgccgactacaacatccagaaggagagcaccctccaccttgttctccgcctcaggggaggcatgcagatcttcgtcaagaccctcactggaaa

SEQ ID NO: 44416 - DNA, 360 bp, Zea mays
  Clone ID: LIB3066-050-Q1-K1-C1
ctcgtcgttggcatctacgacgagcttattacgcctgggcagtgcaacatggtgtgcggggatgctaacgactacgtgcttgaacagggcatgtaactactacgtaccagctggaatgcatgtcgacgactatggtttcgagtttcgactttcaataatagtaacaacaaagcaaaggccttcctcccggcgtatttgctttggctcttctcctccacgccataagatatctagcaattggtcactcgccttaattagttcgctttgcttttgacgttgattcgaccattttgctgtaacgtgaattgcatgcatggacatgcaacgctccaatggcctttggaatgtggaaaaaattaa

SEQ ID NO: 44417 - DNA, 303 bp, Zea mays
  Clone ID: LIB3066-050-Q1-K1-C10
gccaaaatacatgtgaatttgtcagcttatcttttctggcccctacacaaactacgggggaggttttttcagcatctagcggactcacagcatatcaccttccatgacctctattccctctactaccttaatcgtcatattatcctgactattctatacctcttctgataccttcgcttactactatcttccctactacatcatacactgacgattttactaccaaacctgatacgcacggctatttaaccatgtcacctcatacattcttatccctaatttgacgcttgattacaaatactt

SEQ ID NO: 44418 - DNA, 372 bp, Zea mays
  Clone ID: LIB3066-050-Q1-K1-A5
ggcttcggcatcatggccggcggcctcgtggccatcgtcgtgtccgcgtggggcagggccagtttccccgccccggcctacgccgtcgaccccgccgcgtccacgccgccgcaggccgacttcgtgtggcggatcatcctgatgctgggcgcgatgcccgcggcgctcacctactactggcgcaccaagatgcccgagacggcgcggtacacggcgctggttgccaagaacgccaagcaggccgcggctgacatgtccaaggtgctgcaggtggagatctcagccggcgccgccgaggagggcgccgcggctgcgactgcgactgcgactgagcctgcgccggcgtccgcgtccgcgtcttttgggctcttc

SEQ ID NO: 44419 - DNA, 399 bp, Zea mays
  Clone ID: LIB3066-049-Q1-K1-G5
cgccatgggattcggaatggggaataataacaacggggcgagctcctcgtcgtcgcggctggaccccgcggcgccgctgctgccgcgccacggcagcagcgggggccgcgagggtggtggcctgtcgtcgcagcccaagacgttcgccaacgtcttcatcgcggcggtcggcgccggcgtgctggggctgccgtacaccttctcgcgcaccgggtgggcggcggggtcgctgctgctcttctccgtcgccgcgctcaccttctactgcatgatgctgctcgttgcgtgccgacgccgcctcgccgacgagcaccctaagatcgcctcgttcggggacctgggggacgccgtgttcggcgcgcacgggcggttcgccgtggacgtgatgctggtgctcag

SEQ ID NO: 44420 - DNA, 407 bp, Zea mays
  Clone ID: LIB3066-049-Q1-K1-G6
cccacgcgtccgcaagacggtgctcgaggtcaacagccacgggcacgccagcgtggcgtttgtgaacaccaaattcgtaggatgtgggcacgggaccaagatgaacaaggcgttcacgctcgagaagcccatggacctgaaaaagggcgtgaaccacgtcgccgtcttggcgtcgacgatgggaatgatggacagtggcgcttacctggagcaccgtctggccggcgtcgacagggtgcagatcaagggcctcaacgcgggcacgctggacctgacgaataacggctggggccacatcgtcggcctcgtcggcgagcagaagcagatctacaccgataagggcatgggcagcgtcacatggaagccagccgtgaacgacaggccgctcacctggtacaagaggcact

SEQ ID NO: 44421 - DNA, 400 bp, Zea mays
  Clone ID: LIB3066-049-Q1-K1-G7
cccacgcgtccgcccacgcgtgcgcggacgcgtgggcgagagtacaagcgtctgcggcgggcggaaacacgtgtcgttcggcgacctgagcctcgcggagtggacgtcgttcctggagaggttcgagcagctgctgccggcggcgctcgaggacaagaagtgcgctgtgctagggacgtcgacgtcgtcgtcgttctgaccgtgctacgtactggtcaatcactaccgccaccatttgcatgcatacatgcgtgagtgcgtgcgtgcgtggatgcaaaataatacacgtgtgcatggcgctgtgctagggacctactagctccgtctggatgccttttgtgtgtctactacgtagggtcgtcgaccttgtacggtggcattggcatgcatgctgttggga

SEQ ID NO: 44422 - DNA, 409 bp, Zea mays
  Clone ID: LIB3066-049-Q1-K1-G8
cccacgcgtccgagtccactcttctggtcctctcgcttttgcgctcccttggtcgtgttcgtcccctgctcgtctcccgtccgttttcggatgcccactccgaccaaaaccctagctacttcgtgaaggtggaggggaggagatggcggcagcggatgggcgcagcggcgacttccgggtcaggggtggcagcgttgggggtcggatcgaccgactggtggtggagaacttcaagtcgtacaagggtgagcagacgattgggcctttcgtcgacttcacagccatcatcggccctaacggcgccggcaagtccaacctgatggacgccatcagcttcgtgctgggcgtgcgctcaacgcaccttcgaggcgcgcagctcaaggacctcatttacgccctcgacgaccgc

SEQ ID NO: 44423 - DNA, 345 bp, Zea mays
  Clone ID: LIB3066-049-Q1-K1-H1
cagacaactcatagagacagggatgctaaatagggtactatgtggtggcttggatggcgtcatgcgggacattggtaagagcctcagagcggacgatggcactataccaatgcacgcgcactagcaacctgactgatgcgtttgacgagtacttcatgaagtctgccttcgggtgagactttgcacattattgtttcaaagaacggtactatgctctattgagccagagttgtaactactagcgagattgcatcacaaataccctgtgaattgggtggctcatgctacaggccatggtggagtgtcacgtacaaagctagactctgcgtgatttgctaccttaac

SEQ ID NO: 44424 - DNA, 393 bp, Zea mays
  unsure at all n locations
  Clone ID: LIB3066-049-Q1-K1-H2
ncaaccgtcggccaagcgtccgatcttcatcgacatgaagtactgccccaacaaggggtgtactgccaacggcgcctccaaggtcaccgtcaaggatgtcaccttcaagaacatcaccggcacctnctgcaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaatggttgcctaaagagcttgcatgcttctagaccctncatcgactgacccatctctctagttataatttttctctcgtcaaaaaaaaaaaagcaactttaaagcttcgccattaaaggaccttatat

SEQ ID NO: 44425 - DNA, 405 bp, Zea mays
  Clone ID: LIB3066-049-Q1-K1-H3
gaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaag

SEQ ID NO: 44426 - DNA, 386 bp, Zea mays
  Clone ID: LIB3066-049-Q1-K1-H5
cccacgcgtccgatcaccggccgtctagcgagcagtctgccaattacacccaatgagtgataacatctcctcgaacgccaggatccttggaccactatatccaggagcgacgaagtgatccacccgccagcacatggagatgaagaaggtcctgtgcgccggcctcgacgacgccgcctgggccaccgccgtgctggcctcggtcgcctccgaggcgccctccgaggcgcccgccggggcggacggtggtgctgctggccctagcgcaagcggcgcctgcgtcgtcgtcgagcccgcctcgctggcgctcgtcgcctgcttactcgcctactacctccactgagcgactacgcgcggtgcggtaacgagcggatgcatcgagtttg

SEQ ID NO: 44427 - DNA, 411 bp, Zea mays
  Clone ID: LIB3066-049-Q1-K1-H6
cgaggattggatggaggaagcatttgtgcgacggatgaaggacatcgtgcattcagagtttgatatattgggttctagtgttaacgtgaaggaatcaattcatgctatcggtgccaatgctgatccaaaggatgctggagatttccttgcatacctgcggaaatcttcaaagggtggtggtttctggttctcagagtctaagatcaagaaaggtggagttttggcacacttgaaaccaattgctgatgaaaatgatttctgtagctgcctaacatcgtattttgggccagaagttagtcggatcaggagtgcaattgacagtaaatgcaagaatatcctggaggatctgctaagctttgtggagtcacataattcaaccacaaggctgaaggaattggtgccataccttca

SEQ ID NO: 44428 - DNA, 396 bp, Zea mays
  Clone ID: LIB3066-049-Q1-K1-H7
cccacgcgtccgcgtattttggggatttatgtagttatagcgaaatctagggatccggaaattaaaatgttattataacttaatacatttttgttggaacaattgtacaatgttctggatatttcctcaaagattttgtaggcatgtttatgtggttacatcacttgtattttattcttatgtactgtaagtgagctagaaatctgtgaagatctcaattagatactcatttcccttcctcatgtagtcatgtttttttgtttagacgatgcagtttctattggctcttgatattacctcatcagagttttttttctgcgctattgcagtaactctatttcttgatcaacatcaacatgtcgcgggaggataatgtttacatggccaagctggctg

SEQ ID NO: 44429 - DNA, 178 bp, Zea mays
  Clone ID: LIB3066-049-Q1-K1-H8
tgcacgtatgcgcgaccatcgacgtgtgactcagatgtaggggactctgcaaccggggcaagctcgttggaactttggtttactcgatcaataaccacgtgaacacgctgagtctcgcagcatacactagccggtccgtgagctggtcaccgtgcaggtagaacttctaacacgccgt

SEQ ID NO: 44430 - DNA, 375 bp, Zea mays
  Clone ID: LIB3066-050-Q1-K1-A1
gcgcgctccccgtccttcggtaggtgcattgcttcggtggtccaccatggcgcagggagcggtggccacgatgacgactaataagccccttctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcct

SEQ ID NO: 44431 - DNA, 412 bp, Zea mays
  Clone ID: LIB3066-050-Q1-K1-A10
cggacgcgtggggccgttgcaaaaagccttgatagtcgatatcgcattgtcagtaatggtgaacgtgagcagacattaaaccaattgctcacggaaatggatggctttgataccaactcggctgtcattgtactgggggcaacaaatcgagctgatgttttggatcctgcccttaggcgccctgggagatttgaccgtgtggttatggttgaagctcctgatcagtttggaagagaatcaattctaaaagttcatgtgaaaagaagagagcttccactgagtacagatgtagatctagccaatattgctgcaatgacaactggttttaccggagcagaccttgcaaacttggtaaacgaagctgctttgttggctgggcgattaactaaagaaatagtggaaaaggttgact

SEQ ID NO: 44432 - DNA, 336 bp, Zea mays
  unsure at all n locations
  Clone ID: LIB3066-050-Q1-K1-A11
cggggccgaccccagcaagaaggcctcctgcttcggcggcgggggcgaccaccacccggggaagcccggcccctccgcagcgaagctcgcgctcgcgtccttcctcggcgtcatcatcctcctcgccgccgacgcctcccttaccggcgccggcgcgcaccgncgnctgcggcagcagtacctgcattacgtcggcgttggcgttggcgttggcgttggaggcggaggcatcaccgactcgctctcgtggctctccgtgccggaccgccccaacttcaccgacgacctactcgcgcggtggctcgcgcccgggggttccccgtgccgggacgcgcg

SEQ ID NO: 44433 - DNA, 337 bp, Zea mays
  Clone ID: LIB3066-050-Q1-K1-A2
cgcggctctcctctgccccgcaccggcaccgctagggttttgccgccgacctctcggtggcttccgggctccgcgaggcaaccgtccggaccggccggtcgaaatggtggatgtggaggaggtcgggaacaagatgcaatcgcagatgcgcctgcacgcggagccggatgacgccgccgccgacctccccctcccggcgctcttcgacagggcgtcgcggcttcacgccctggcctccagctccgccctcgaccaggatgggatccgcaccggggttgagctgctgcggcgctgcgacgagatggtcggcaggctcggtcttttctcccccaacgag

SEQ ID NO: 44434 - DNA, 359 bp, Zea mays
  Clone ID: LIB3066-050-Q1-K1-A3
cccacagtatggctgtaggtaatcctgcaaaggtagttggttatacagagaaagaggaggcttctttaactatgaaacatgatgcaaggagagattattttgagcatgctgccatcagattgagatgattgatacacctaatgacgagtcttctttctattcgtctgtggaatactgtggagtaaaaaaagttccaaatcgccttattggcaagaagttttgtggagttaaaaaaaggtttcgtcgtcttactcgcaggaaaccttgtgaagttaaaaaaaaaatgtttgacgaaacgcatacggatgccattccggacatttcgtcacaggcacaaggctggatagtcgatgagctct

SEQ ID NO: 44435 - DNA, 341 bp, Zea mays
  Clone ID: LIB3066-050-Q1-K1-A4
cccacgcgtccggtccgttgagtcggcggtcgattccaaagacagcagcggaggcggaggcatccaagtcctctccgctcactttcctgctcgacgcggtcttggccaagctcggttgcgtgctggaccggctacgcgaaaacgacagcgaggaatctgccatgtaccggggcaccatcaggcgccatgtggacttggagactctgcggcgtcggctgaacgcgtcggccggctcgcgcgccgacgatgacagccactcctctgcgcacgagctctatcgcgacctgctgctgctctgcaccaacatcgtggtcttcttcccgggtggcacccccgagaac

SEQ ID NO: 44436 - DNA, 403 bp, Zea mays
  Clone ID: LIB3066-049-Q1-K1-G3
gcgaagcgagcaaacccagccatggagaaggcgatcgatcggcagcgggtcctcctggcgcacctcctcccctccccctccgccgcctcctcgcagcctcagcttgcggcgtcggcgtgcgcggccggggacagcgccgcctaccagaggtcctcctccttcggggacgatgtcgtcgtcgtcgctgcctacaggacgccgatatgcaaggccaagcgaggaggcttcaaggacacctacccagaggacctcctcactgttgttctcaaggctgatctggacaacactagaatcaatccagctgacatcggtgacatcgtcgatgggacggtgctcggccctggttcccagcgtgcaaacgagtgcaggatggctgcgttgtttgctggcttccctgaaaccg

SEQ ID NO: 44437 - DNA, 404 bp, Zea mays
  Clone ID: LIB3066-049-Q1-K1-E2
gcaaattaaagagggatcggattggaactcgatcggaaggaaggtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggactagtacttgaacaggcgcacgcaggagtcccgccacaggaaccacggcggcgcgcagatcaatgacctcatctacagtgctgcgcgctttcacgccaacgtggatgcacgcgcgtatggtcgccgctccaacctgcagctgcaggaagaagaagcagcagctaccgcggtgcgtgtaaccaaagcagaagaacag

SEQ ID NO: 44438 - DNA, 401 bp, Zea mays
  Clone ID: LIB3066-049-Q1-K1-E3
cccacgcgtccggctctctctcctctctcggccttcttcgcgtgtttccctctttgggtgaggccgccctctacacttctcgacataaccatcgagagggcggtcgagagaaacgagagcggcagacaccatggggagctcgaggaccatcgttgcgtccgccctgctcctcctcgccctcctcctcctggctttcgcgggcaccgtcgaggcccgcgttgaccccgagctgtttggcgaggaccaattccagcggacatgcaaccaggtgcacttgaggaagatgtgccagagcttgacgaggctcccgagggtgacaacgccgcgcgaactgctgctagcgtcgatgcgcgtcgcggccgacaaggccaatgaggccaagagccgggtggaccagttcg

SEQ ID NO: 44439 - DNA, 336 bp, Zea mays
  Clone ID: LIB3066-049-Q1-K1-E4
cccacgcgtccgtgtatctctcctgtttcggccttgttcgcgtgttcccctcttttgctgaggccgacctctacacgggtcgacataaccattgagagggcggtcgagagaaactagagctgccgacaccatggggagctctaggaccattgttgcgaccaccgtgctcctactcggcctcgtactactggctttcgcagacaccgacaacgctcgtgttgttgcagaactgtttggttaggaccaagttcagtagacatgcatccaggtgcacttcaggaagaaatgcctgagcttgacaaggctcccgagggtgacagctctgcgcgaactgct

SEQ ID NO: 44440 - DNA, 357 bp, Zea mays
  Clone ID: LIB3066-049-Q1-K1-E5
gataggcgtgcgtctagacagtccgggtggtgagtggcctcagccttgcctacggcgacgcatgaagcactgatccgtgtgttgccctacgagttggcaagaagaaacttcagacgagcgtgaagaagagatctgtgaacctcatctggcacgaggagctaactctgatcgtgacatatcccaacctatctctgaagctgtaggtgttagacaaggacacgttcatcagggacgacccgatggctgacgatgataatgacgtggcgcacattgtggaagcagcgatcgcgagcacagacgcgtgcctgaggaacgggaccatcatgctgaacgggcagccgatcgccacgaactgcc

SEQ ID NO: 44441 - DNA, 332 bp, Zea mays
  Clone ID: LIB3066-049-Q1-K1-E6
gtgaatcgcagttcaatacaagttggcatgacagcaatcaagtacatccctcaggcgagtcatgaacttcaggcggaagagcacaattggttggagcgttggcaatatattacttgatctcacaggaggggtgctgaatttttgtcagatgggtgtgcagtctatagatcaacatactttggtgaatttctatggaaacattgtgaaaacccttctttcattggagacggttttctttgatgtcctgatcattatccaacactacgtgttgtaccctgtctagaaggacgagaatggtaaggcaatcatttctgaaagggtatcccccctta

SEQ ID NO: 44442 - DNA, 400 bp, Zea mays
  unsure at all n locations
  Clone ID: LIB3066-049-Q1-K1-F1
ccctccggcgactcatcgccggcgagccggtccgccacgccatagcctcgtcctgaagcgcacttaatcctacgtctcgttcctctctcgcccccggtaccctccataggcatgggaatggggtctgcgagagggggcgcagggggctggctccccggcgagcggtggcggcgggtcatcttcctcgctctggcggccgtctcgttcctcatctcactcatactcctcttcctatccgcgccgcgtctgcgcctcccaagtgtcgtcctgccttacaccaccggttccgcttctgccgtccgccgcgggcccggcgagccgccctgcctggcgtacctgctgaccggcgcgcgcggcgacgggcgccgnctnctcaggctcctnctcgcggtttaccacc

SEQ ID NO: 44443 - DNA, 404 bp, Zea mays
  Clone ID: LIB3066-049-Q1-K1-F2
cagccaactcatggagacaggtaggctgcatacgggacttagtggtggtctggatgagatcatcctggacatgtttaagccccaccgagcagacgatggcgctatattcattgatgggcactagcaactggtctagcaagtttcagttgtctacatcaagtctgccttcgtgtgagattttccgcatttgtggttgaagacgggttttacgctcgattgagccaaagttgtttatcgtagcaagattgcatcacaaatgccctgtgcatttggtttttcagagctagcgaccatgttccaatgtcacgtacaaatataaactatgtggtatttgctaccttaactcgtattgctatgtattcaagacatgcgttaactgtggctatcgtgatatatacagcatg

SEQ ID NO: 44444 - DNA, 402 bp, Zea mays
  Clone ID: LIB3066-049-Q1-K1-F3
cccacgcgtccgcccacgcgtccggcctgaatcctgtgtcattggacgctacatgcctggagagaatggaggattcagttactatagttgatcatggcaaaaaggctgaaaaggatgattctctgttatcgtgggcaaggtcaccagaccgattacttcatcaagatacatgtcttgcattggctagctcctttgtcctcttgaggttgcttcatttccttcttcctaagcttaatgcatgtatgaagcaagcctggaggatgcgactgtatgaattgaataggttgtttcctagcttgtcttgaggaaggcaatatggaactagaaaacttcaactgactctcgaataaggcagcatacttataacaagtgatgcagacaacaaaccggatcactaggaag

SEQ ID NO: 44445 - DNA, 283 bp, Zea mays
  Clone ID: LIB3066-049-Q1-K1-F4
ccgacgcgtgcttcaacgcctccgggtttattcctgactcatatagacgctccatgcggcgggcttaagaattgtttaggggcctctgttcatcatggtaaacatgctaattatgttaacactggctgattgtatgggacctcttcagagcattcctttctccaaggttcttaaaaaaagtgactaaccatatgttttcagtgtaattatgaataggtataggaaactttggcttttgaatggaaaaactttctcatgacacaacgaatggaaataaaaggtg

SEQ ID NO: 44446 - DNA, 386 bp, Zea mays
  Clone ID: LIB3066-049-Q1-K1-F5
tctacgtgtgcgctccaatcagatcgtcagatagatcactggccccgtgctgatgggggcgcttaccatctgagcagccagacttccacgctgcagggagagacgcaaaggatacaggtgctgcctggctgagacgatggccggaggcggggaccactcccacaccaacggaggccacgtcgaccagagggccttggacgagggcatgaaggaggagttcgctgaccagggctgcgtgcacatggtcgtcttcgacccatgctatccagaagatcatcactgacagcttcggcacctacttcctgatgttcgccgagcgccgtgcggtgacgatcaacgcgagcaagaacggccagaacacgtacccagtcgtggagatcatgtgg

SEQ ID NO: 44447 - DNA, 404 bp, Zea mays
  Clone ID: LIB3066-049-Q1-K1-F6
cccacgcgtccgcggacgcgtgggtgcgtcacccgattcgggccgggctcgggacgcgtccttaacaagggcttcaacggcctaaggccttgagtttagccgaaccatggcttcaagcactggttcatttgatgggacctgttgggggcattcctcttccgaaggtcctcaaaaaatgtgactagccatatgttttcagtataattatgaatagttataggaagcttcggctttggaatggagaacttctctcatgacagaacgaatggaaataaagggtgggcgacgaagctagaatccaaaagactttagctggacatgttgacgaagctcaagtatgataacgactgaagaaggataaagaccatacagtcataataattcttgttaaaatcatagatagt

SEQ ID NO: 44448 - DNA, 400 bp, Zea mays
  Clone ID: LIB3066-049-Q1-K1-F7
cccacgcgtccgcccacgcgtccgcatgaatggacgcacaaccgggtatgttgcgccggcaattccgtggtgagaacgaagacagagagaaagaaccgagctgtgccatcgccggtgggctcgtcgttgtcgctgccccagtgccgtgccgtgaagctccacctgtccatggagaagttattatggcctcgccgcgttgaaccggcgcccggggctcgggaattcttcaccggagaccgcgaacccactgtcctccgtggccagcctctccgctgactccttctctgcgtgaggtcacgagtcacctgatgagcaagttggtacctggaatctcaagtcccaggtcaagaacatgtaccagagaatgaggcgcttggaggatgcggtgatgatttcgtga

SEQ ID NO: 44449 - DNA, 230 bp, Zea mays
  Clone ID: LIB3066-049-Q1-K1-F8
ctgacttttttttcttattatacgttttatgcgcatcttaaggtgttattgtagggggttttttttttgcagttggagtatgacaggtactaaactaatgcacaataaaaacaatgaatgcctctatgaaagacgagtaatgacactgctttgaaatgggcctgactgacgaaaaagaaaaaactgacggtactttttaaggacactattgaaagcacatgttctatgca

SEQ ID NO: 44450 - DNA, 432 bp, Zea mays
  Clone ID: LIB3066-049-Q1-K1-G1
ggcggaattggcgggtggaacgcctcctccggccacgcgtacgcccacgcgtgcgtattaatggacgcacaacctggtatgttgggcgggcaattccgcggtgagaacgagtacagagagaaagaaccgagctgtgccatcggcggtgggctcgtcgttgtcgctgccccagtgccgtgccgtgaagcttcacctgtccatggagaagttattatggcctcgccgcgttgaaccggcgcccggggctcgggaattcttcaccggagaccgcgaacccactgtcctccgtggtcagcctctccgctgactccttctctgcgtgaggtcacgagtcacctgatgagcaagttggtacctggaatctcaagtcccaggtcaagaacatgtaccagagaatgaagcgcttggaggatgcggtgatgatttcgagag

SEQ ID NO: 44451 - DNA, 408 bp, Zea mays
  Clone ID: LIB3066-049-Q1-K1-G2
cggacgcgtgggcggacgcgtgggcggacgcgtgggcggacgcgtgggttccattcgcttagtaaagttagacttctgagtagtgtcatatactccaatcctaatccaagaagatgaatgagatttgaagttattgtttctatatttctcagcgtagtagtagaaagtgatgaagatatagtgcaaactttgatatattcttaaacattgtttggcacagctagttcatatttcaccatgctgtattactaaaggtcagatgttcctaagtatattgtattcttatcagcgttctgctctggaagatatccaaaagatgattcgggagttgcagcttgatgagaaccggaaaagggaattggcaactgcccttcacgttcagttcaaggattggttatacggtaacgc

SEQ ID NO: 44452 - DNA, 404 bp, Zea mays
  Clone ID: LIB3066-049-Q1-K1-E1
caaagcacctctctctagctagctactagacgacagctagctagctcctcaacgacgacgcagtagtacatatggagaaggcggcgggcgtgagcgcggcgaggctggccgtggcggcggcggcggtgctgctgtgcctgctgctgctgctggcggcggggccgcagggggtctccggcgccgacgggaggaagaagacggcatcgccctacgataagttgatcagctgcagggtgctgggcaactgcgacaagaacaagggcccggaggccacccgccccgggaagccggtcaacaagtacacccgcggctgcagcaagatcgacaagtgccgcgactgatcaatcgtcatcaatgcaggcagccggagctatatatatcgtgtcgttctcgtaccgtgtgca

SEQ ID NO: 44453 - DNA, 462 bp, Zea mays
  Clone ID: LIB3066-054-Q1-K1-B6
ctcgtttcgttgcggcggcctcttcctcctcgtcctcgtgccccctcgcccgcctaatctgtcgccgcggccttgccggtgccgcagacggccatggacctgcgaaggtgcccttgtggaaagatccgttgagcccgagcaagtggaaggaagagcactttgttctagcaagcctctctatgtggggggctcttttttatggtggtttcaagttttttggtggaaagaaggaagacaagattgaggtggcatcaggacagacataggtggctgggatgggagttcttgcctatttctgtggccaggcaacaatgttaaataaaaggaatgtgttatattgtgctttcaagatgataaattgtggcaaccaggttttgattatgtatgcaatattttgacaagctactcttatccagcatgaatgacttcatgttagtgcgattgagtagatgttttacttct

SEQ ID NO: 44454 - DNA, 77 bp, Zea mays
  Clone ID: LIB3066-054-Q1-K1-B7
cggacgcgtgggcggacgcgtgggttctcgttcatggagaataatatttggtgttggagggtttactaaaacttatt

SEQ ID NO: 44455 - DNA, 385 bp, Zea mays
  Clone ID: LIB3066-054-Q1-K1-B8
ggcaacttcttagctacacacaatctcatagagactatgagagaacggatgtttaaacctgctttgtcaaccattatcacagagaacacagaagtcgcaactgtttccctttcagatccagtttgtgtagcagcacggaaaatgcgtgagttacaagttaattcagtcattattactgctggaaatttgcttgatgggatctttaccccaagggatgtgctgatgcgtgttgtggcccaaaatctttctcctgagttaactctagtagaaaaggtaatgactgcacaccctgactgtgctacattggacacaacaatccttgatgcactacatatgatgcatgatggcaaattctggcatattcctgttcttgatggagatgggc

SEQ ID NO: 44456 - DNA, 401 bp, Zea mays
  Clone ID: LIB3066-054-Q1-K1-B9
caaaggcagcacactcagctatccagcaaatgagatcgagacgcaggagtcatggccaccgtgagcgccgccgtggtgaccaccatcgttgcccgcgccgcgatcgccaggcccaatgctctagggctgcctgcgttgagggcgaggagcgagagggtgcggtgcagctacgccaaggatgccaagaacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacctc

SEQ ID NO: 44457 - DNA, 396 bp, Zea mays
  Clone ID: LIB3066-054-Q1-K1-C10
gcaaacaaagtttggagactatatgccttcttcttgcttacaaaatcaagtaccctgagaacttttgtcttctgaggggcaatcatgaatgcgcctcaataaacagaatatatggattctatgatgaatgcaagcgtcgatttaatgtgcggctatggaaggtcttcacagaatgttttaacactctacctgtggctgctcttatcgatgataaaatattatgtatgcacggtggactctctcctgatctagcacacttggatgagataaagaacttgcagcgtccaactgatgtaccagatcaaggtctactgtgtgacttgctttggtcagatccaggaaaagatgctcaagggtggggcatgaatgatagaggggtctcatatacctttggtg

SEQ ID NO: 44458 - DNA, 397 bp, Zea mays
  Clone ID: LIB3066-054-Q1-K1-C11
ctcggcgccaggtaccacgccgccgacaacgaggacctgccggagtccgtcgactggaggggcaagggcgccgtcgccgaggtcaaggaccagggcagctgcgggagctgttgggctttctcaacaatagcagctgtggaaggcatcaaccagattgttacaggcgacttgatctccttatctgagcaagagcttgtcgactgtgatacttcgtacaatcaggggtgcaatggaggtctgatggactatgcgtttgagttcatcatcaacaatggcggaatcgacaccgagaaggattacccttacaagggcacggacggacggtgtgatgtcaacaggaaaaacgcgaaggttgtcactattgacagctacgaagatataccagcgaacgatgaga

SEQ ID NO: 44459 - DNA, 396 bp, Zea mays
  Clone ID: LIB3066-054-Q1-K1-C12
cctcaagctctgctcctccttttccactgctctgcgtctgcgtctgcgtctgcgtctgcagtgctgcgcgtctccctccccccgcctccgcctccgccccggcaaaaagcaaaacacggccatggaaggctacgaccgcgagttctaccagttcagcgaccagctgcgcctgcagacggccgccttctcgggcctctccctcggcgactccatctggtcccccgccggccggcgcaacaacagcaacgacgtcctcttcgccgcctccgcgtcgcccgccgacgccgccgccaagagcaacgccgtcgtcgggctcaagctcaacgacggagggcccggcctcatcggctccgggaagctggccttcggcggcgccggaggcggcggcaccaacaa

SEQ ID NO: 44460 - DNA, 290 bp, Zea mays
  Clone ID: LIB3066-054-Q1-K1-C2
caccgtaccattccgtccgcagaggagagccctcccctccaccggcttacccgcccctgggccagcgatcgcgcctgcttccgggcgtcccagccttggtccggtcgccgggtgcggcgctggtcctggtttgggctctcccatggcatctctggagcacgaggtggtggtcgccatggcatctctggagcaggaggcggtggtcgccgcggtcgtcgtggagaacgtgacgccgtagcagcaaggcggaagttgtggcggcgcacgaggaggaggggataccggtagcg

SEQ ID NO: 44461 - DNA, 419 bp, Zea mays
  Clone ID: LIB3066-054-Q1-K1-C3
atcgaggccccgtacagatggttcttccagtgaaggatctcctagccccggtaccagtgagggatgtgctagccccggtaccagcgctccgaacgaagagagcaaccctgcgactgcgagcaagaggccgtatctcgagaggaactactccgtgctggaaccttcagaagggagccagctcgtcgacgacgtggaaggggaaagctctatcgagaacgtgggaaacagcttgagatcaacaagaaggcgatggccgctctttacaaggagcttgaggaagaacggagcgcttcggcggtcgcggctagccagacgatggccatgatcaataggctgcaggatgagaatgctgcaatgcagatggaggctctgcattacctgaggatgatggaacatcatgctgaccacgaccacctggc

SEQ ID NO: 44462 - DNA, 472 bp, Zea mays
  Clone ID: LIB3066-054-Q1-K1-C5
ccgcactctcagcagcttcagcatgaactccgcatacagcgagaagaagcccagcagcaagggcgcaagcgcaactgatcccgcacacgggtgatgttccacatccatgcctataggccactcacctcaccacgcagcgttaccggccgtactactatatctacatacgaccgtgggacaacgtcgaccggagctcgatcggcgcagttgccgcatgggcgtggctgtcaaagttcctttgtttctttcttgatttgtgcttgcgttgggttcggtgttccactttctttttatgtgattattaatcttgttttcagatgcatgtacgcatgtatgtgccggcaccatttggtcttgtgttaagtttattcttggattccaatctctagtgtagggtcgtttggtttgtgtgtgcaatgtgtactcataccaacttctgtctttacatcagtatttattaagaaatagcaat

SEQ ID NO: 44463 - DNA, 470 bp, Zea mays
  Clone ID: LIB3066-054-Q1-K1-C6
cccacgcgtccgataccatccagtacatcgattctccccccaagatcaaaggccggagaaggaggaagaaaggttagggagtcggctatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaaggaaattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcaggtttcagctgtctcaaggttgaaacatgagaatgttgt

SEQ ID NO: 44464 - DNA, 447 bp, Zea mays
  unsure at all n locations
  Clone ID: LIB3066-054-Q1-K1-C7
cttgtttgcgcctcgccgttgattgatgcgctcactcatctcacatgggtgggactctttgctcttggagcaccacctgtctagtgggagctactccagcctctagacaccaactccagcgcccccgtatggaacaacaactccaccctcactgtctggacagcaagattcattcacctgtcatatagtttcatcgatgaatctgaaacttttattgctcctgtgttgcccctatccaaaggtcatgttccttggatcaactgtaaggtgaaccttttatcctgatattatgatgtggttatgtattctatgttctcaacagtaggagtacattctaaagatcataggttagaaatcttgcgccataagatagctgctaaagaaaatgaactaaaaggtcaaaagagacctttggtcgctgntgctaccaagaatgcagatttttct

SEQ ID NO: 44465 - DNA, 460 bp, Zea mays
  Clone ID: LIB3066-054-Q1-K1-C8
cccacgcgtgcgcggacgcgtgcgcagactcgtgggtggaaatccaggacaagttgacgggtgagtggaagcccatgaagctctcttggggcgccatctggaggatggacactgccaaaggcgctcaagggccccttctgcatccgccttaccagcgagtccggcaagaaggtcatcgccaaagacgtcatcccggcgaactggagacccgatgccgtctacacttgcaacgtccaataatactagactttgaattaccttcgattcatccggcacagcgggctatggaccttcagcagcaagctaattaagttggcagcatgcaccgctaacctaatatactactgagacttccaaattctagaatatgcaatccttttgttcagattcatgatcgaattccaaagagtggaaaacaagcacaaggttaaatatacatgccatttttggaggctttttt

SEQ ID NO: 44466 - DNA, 344 bp, Zea mays
  Clone ID: LIB3066-054-Q1-K1-C9
gctttcgaggctagggttgcctcctcctcgtcgtcgtccacatggcgcgaatcctcatgcggctcctcctcctcgccgcggcggcggcggtggcggcgggggacggctgcctcaactccggctgcgtcgcgctgggctcctacctcgtcgcccgggaccagaacctcacctacatcgccagcctcttcggcaaaaacgactaccacacgctggcgccctacaaccccggcaccaccaacctggactacatccaggccggccagagcgtcaacatctccttcacctgcgactgccacacgttccccaactcggacgccacctacctcggcggctccttccagcac

SEQ ID NO: 44467 - DNA, 421 bp, Zea mays
  Clone ID: LIB3066-054-Q1-K1-D1
atcgcgagcggtcgctcgcgatctagaactagcggacgcgtgggcagtggtccacgtggcgatcactggatgtgggattctcgcctatttaactatgggaactgggaagttttaagatttcttctctccaatgctagatggtggctcgaggaatataagtttgatggtttccgttttgatggtgtgacctccatgatgtacactcaccacggattacaagtaacatttacggtgaacttcaatgagtattttggctttgccaccgatgtagatgcagtggtttacttgatgctggtaaatgatctaattcatggactttatcctgaggctgtaaccattggtgaagatgttagtggaatgcctacatttgccctttctgttcacgatggtgggggtagggtttgactatccggatgcatat

SEQ ID NO: 44468 - DNA, 349 bp, Zea mays
  Clone ID: LIB3066-054-Q1-K1-D10
acgcgtacgcctgtgctgacgcttgtgaaaaattataattatacatcaacaaaataaatataaagtaatggaaaaaaaataaaaaaaaaaaaaaaaaccaaaccttttaaaaaatccaaacattcatactactttctttcaacctcatatttttactttactattacctactttcatttaactactcccgctttttcaacctaattcactggtaaaacccttcttttccccaatttaatctccttctattacatccccttttctcaatttggcctcttttctatcaacccctctcctttcgactttcccaccctttccccactctaattcctcaattgtactccccctt

SEQ ID NO: 44469 - DNA, 181 bp, Zea mays
  Clone ID: LIB3066-054-Q1-K1-B4
ctgacgcgtgcgcggacgcgtgggctgcgcccgttcaggatccacatcttcccgagcgagtgctgggttgacctcttgctcttcggaccacctccaaggctcttggtgtagcttgccactctcaccaatcaagttttcatgtctgatctcgacattcagatcccaactggcttcgatccct

SEQ ID NO: 44470 - DNA, 407 bp, Zea mays
  Clone ID: LIB3066-054-Q1-K1-A1
cctgcatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaagaggagtgcgacaaggcgtacgtggtgaaggcggccgaggtcacc

SEQ ID NO: 44471 - DNA, 400 bp, Zea mays
  Clone ID: LIB3066-054-Q1-K1-A11
atccggagcagccgcagtcccaccgacccctccgccggtcgccctccatctcctcgccggggcctgtcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcatgttgctgcttgggttaccagccaaaccaataactaccacaaggctgatggtcagaacactggcaacttccttacggaccgtccttcaaccaaggtccacgctgctcctggcggtggctcttccctgggctacctgttcggtggcaactgatgcccgtgct

SEQ ID NO: 44472 - DNA, 391 bp, Zea mays
  Clone ID: LIB3066-054-Q1-K1-A12
acgcccacgcgtccggggttgttctaggtggactgaaggaatatctcaagacaattaggcgctgtataagggtggtatttattggttgtggaacaagttacaatgctgccttagctgcaagaccttttgtggaagaactgactggtattcctgtgactatggaggttgcaagtgacttgctggacagacaaggtcccatctacagagaagacactgcagtttttgttagtcaatctggggagacagcagataccctacttgctctagattatgcactagaaaatggagctctctgtgttggcataacaaatactgttggaagcacgctgtctagaaaaacacactgtggtgttcatatcaatgctggttgtgagattggtgttgccagtac

SEQ ID NO: 44473 - DNA, 406 bp, Zea mays
  unsure at all n locations
  Clone ID: LIB3066-054-Q1-K1-A2
ttcctcacaacctcacccggctccatccacgcggctccaacgccagccacagcacgagccatggactcgcgcgtcgtggacggcgcaggtgggggtgccgacgcctccttgccggccgatccgccgagccccgtgcccgatccggccgcgggcgggatggatgcgcgcctgccatcggacctgcttcgtgcagtgctgcaaaggctgccgccgatcgacctcgcgcggtccgcctgcgtctgccgagcgtggcgcgcggttgcctccgaccgcgccgtggtcgaggccgccttctgtgcgccctggggagtgcggcgcgtcgtcggagagccggcgacggtggccttctggcgggccgcctaccttgggagatttgcgctgtcgcatgcgatccgncgcggggata

SEQ ID NO: 44474 - DNA, 442 bp, Zea mays
  unsure at all n locations
  Clone ID: LIB3066-054-Q1-K1-A3
gtggaactcacttcagactttgtgtatccctacagaaaccagggcggattcgatatgatcgtgcagtggaagggacaagattgaaacaccggagcagttcaagcaagctgaagacacagccaacaagcttgatttggatggacttgttgtcattggtggtgatgattcaaacaccaatgcctgccttcttggtgaatactttaggtcaaggaacctgaagactcgtgttattggttgcccaaagactatcgatggagatctgaaatgtaaggaggtaccaacaagctttggatttgatactgcttgcaagatatactccgaaatgattggcaatgttatgactgatgcaagatccacagganaatactaccactttgtgaggcttatgggtcgtgctgcttctcacattacattggaatgcgctttgganacacaccccaat

SEQ ID NO: 44475 - DNA, 373 bp, Zea mays
  Clone ID: LIB3066-054-Q1-K1-A4
cgtggatggcggtgccacaacctctcctgctgtcgctgctggtcgccgtgctagcggtgggcggcgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcgggctgcggagggtgctacgaggtgcggtgcgtggacagccctagcgggtgcaagcccgacgcgggaacgctggtggt

SEQ ID NO: 44476 - DNA, 448 bp, Zea mays
  Clone ID: LIB3066-054-Q1-K1-A5
ctcgcccaaattgcaaccttccccgagtgctccaggtcccgtggccggcccccagatcctgtccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggaggacgaggagccgcggcagcaggcggaggccgtgacggtcacggccgtggggcccagcctcacggaccggttccggagcaggttccggccgtcgcgctacgggcggcgccggggcggggactgccgcgtgtgcctggtgcggttcgagacggagtcggtggtgcagcgggttccct

SEQ ID NO: 44477 - DNA, 473 bp, Zea mays
  Clone ID: LIB3066-054-Q1-K1-A6
gcgatattcagcagaatgaacattgggacgctagatgtcggggattttctcgctattggagctatcttttctgcaacggattctgtgtgcacgctgcaggtcctccatcaggatgagacgccctttctgtacagtctcgtgttcggtgagggagtcgtgaacgatgccacgtctgttgtgctcttcaacgcactccagaacttcgatcttaaccacatcgatgtagccgttgtgctgaatttcttgggaaacttctgttacttattcgtgtcaagcaccttacttggagtgtttactggattgctcagtgcctacataattaagaagctatatataggaaggcattccactgaccgtgatggtgcgcttatgatgctcatggcttacctctcctacatgctggccgagctgctagatctgagtggcattcttaccgtattcttctgcggcatcgtgatgtcacattacacctg

SEQ ID NO: 44478 - DNA, 427 bp, Zea mays
  Clone ID: LIB3066-054-Q1-K1-A7
ggcgggcctcgaggcctccgtccgagcctatggcagcagcgccggcgcaggcgggcggtggcccagcccgttcaccatcgcctgcggcgccctgctcgccttgtccctgctcgcgccgctgctccccccgctgcggtggctggcggtggcggcggcctgcgtgggctcccagcccatgctgctccgggcgttcgccgcggcgggcaagctgacgctggacatcaacatcctgatgctcatcgcggtcgccgggtccgtggcgctcgggagcttcacggaggccggcgccatcgtgttcctcttcaccgtcgccgagtggctggagacgctggcgtgcagcaaggccagcgccgggatgctgtccctcatgtccacggtgcccaagactgtcgtgctggccgagacggggcaggtcgtcggcatgggc

SEQ ID NO: 44479 - DNA, 470 bp, Zea mays
  unsure at all n locations
  Clone ID: LIB3066-054-Q1-K1-A8
gtgcctcggcgccatctgcggcgtcggcctcgtcaaggcgttccagagcgcctacttcgagaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgtcgtcatctacaacaaggacaagccctgggacgaccactggatcttctgggtgggccctctcgtgggcgctgncatcgcggncttctaccaccagtacatnctncgggctggcgccatcaaggccctcggctccttcaggagcaacgcgtgatgagcgg

SEQ ID NO: 44480 - DNA, 336 bp, Zea mays
  Clone ID: LIB3066-054-Q1-K1-B1
aataaccaatttattggatcaaaaagaaagtagatgttatcacaggatggctacataaaccttctgtgtgaagtaaactgtgagtacgaagtcaatccctggaaccagaaaatgcaaaagagatctacgtgcacgaagtagctctgccactactggacttcactaccacctttctctcacatcatccgatttgttctgttttccgtaaagtggtggttcgctatcagttcaagtcactggcaggccgtggctgtggatcatcaccttcacgaagagaatatcgaaagaatgttcttcttaacgatgaattcatcagctttggaaggactgattgac

SEQ ID NO: 44481 - DNA, 67 bp, Zea mays
  Clone ID: LIB3066-054-Q1-K1-B11
aaaaaaaaaaaaaaaaaaaaaaaaaaaaaaaaaaaaaaaaaaaaaaaaaaaactagttctagggcgg

SEQ ID NO: 44482 - DNA, 397 bp, Zea mays
  Clone ID: LIB3066-054-Q1-K1-B12
cggacgcgtgggcatgcatgtgtaatgcattgcttgggatccaacccaatctagtatagcgtggcatgggtcggcttaaagtattgtcagcactaaagttaattatttggcggtgtaggcggtgttggccttccagttggcagggatgacatcgtcgtagacggacttggtgcctccctcggtagtgaggcggacggtgaggggtcccttaagcggtttgtcgctgtccttcctccagatggcgccccaggagtgcttcagaggctcgtacgtgtcggagcccttctccttgacgtccactgccacaatgtcaccgtcgccgtccacgtacttgaccagcagtgccaggtagttggggccgcaccccttttcaaggtggaaggtgaccttggagtcg

SEQ ID NO: 44483 - DNA, 382 bp, Zea mays
  Clone ID: LIB3066-054-Q1-K1-B2
ggatgggcctcttaccattctttcttcaagtgcctgatgtaatgatgtagtgtattgtatgaatagataatgacatttactgcctagcttaatttttaccactgactatggtagcagcaagccactgatgcagcaaattattgttgcagtgactagctgcattgtagctgaagctagcagaagcgagcacataaaaatttataggcaatttataccttgtgagttattcatatcatcagctcatttttccttatggatttgtgaatatgaatgttgtggatgcagataattatgttatgtacccctagaaataccacaatgttgtaacaggtgaactagagcagagagagaatacattattccagattaacaaccttttctt

SEQ ID NO: 44484 - DNA, 433 bp, Zea mays
  Clone ID: LIB3066-054-Q1-K1-B3
ggaccagggacagggagcaacaaagctgagtcctcctcctccatggcggtacggtggcgggcgacgtttacaaaggcgagctgacgccgctgcagcggcacgtcgccttcttcgaccggaacaaggacggcgtcatctaccccgccgagacataccaagggttccgcgcgatcggggccggcgtcacgttgtctgccttcagctccgtcttcatcaacggcctccttggacccaagaccataccggagaacgagaaggctccagctttcaagctccccatctacgtgaagaacatccaaaaaggaaagcacggaagtgattcgggcgtgtacgatgccaatggaaggttcgttgctgaaaaatttgaggagatcttcaagaagcatgcccacactaggccagacgccctgacaggcaaagagctggaagagct

SEQ ID NO: 44485 - DNA, 382 bp, Zea mays
  Clone ID: LIB3066-053-Q1-K1-H9
aaaccgcacccgagcggcccaaatcgggatctgacggcaattccccaattcgattccatcggatgggttggcgttggcacgacgacgacggtgacagcggccggggcctcggcggtgtccctgacctcgctggtggcgggggcgatggggcgcagtgcgccacgcgacgggtggtgcagtcccgctgccacacggaggaagtcgagcccggccgatttgtccgcaagtgcgagaagacggagcagctcctccgcgactgcgtcggcaggccctctgaactggtggaatccaaaactgaaaacactgaagaagatgtcacagaagaaatgaagagcggttcactttctcttgggtttccaagaaacgagcccttcgcattccc

SEQ ID NO: 44486 - DNA, 466 bp, Zea mays
  Clone ID: LIB3066-053-Q1-K1-G3
ctccgcttctcacccaaccctccaagcaacattgaccgcaaagggccatccgctgcggtcagtgtgggtttctgaatcatagcttggcgatgcctgaggctagacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaacacgtggcacacatcggttgggatggt

SEQ ID NO: 44487 - DNA, 465 bp, Zea mays
  unsure at all n locations
  Clone ID: LIB3066-053-Q1-K1-G4
gccaaaagctgttggatagagcagcaactgcagagaaaagattccaaaaaggatggaatacgctcggtgaagaagggcgttccattcaacacgagttgcgtgagattagtgatattgaaaaccaagcagtaggtctgaagggaattcttgatcagcttcccagagcacatgcatctgaatttcggtcgaagatgtctggcctagcttctcaggttaagaaggagaagcgagtgctcaacgccgccctcacgaagattgtgaactacggtgtccccatctgactgccactccagccagttgttctgagggtccattgtatcagatttttgtgaaggaagacatgttcgatgtgtagggtggacgctatactgcccacttggtttcgagaaaaggaaaagagaataagttgtgacccgtgcagatttctaatgtcgcanaagcaacatctttgaaacctgagtaaca

SEQ ID NO: 44488 - DNA, 462 bp, Zea mays
  unsure at all n locations
  Clone ID: LIB3066-053-Q1-K1-G6
gtacgagagagagagcgtgatgcaaagcttagaaatagagaacaacaggaacgagagaatggaataaggtcgtatgcccaggatcgtgaggacaaagagagaaaggaaagactagaacaagaaagagagatgaggcaaaaagaggaaaaggaaagagagcaacaaagacttgaagaggagagagaacttgagcgacatagagaaagagaaagagctaggcaagcagtggagagggctacaaaggaggcacgagaaagggcagcttctgaagctcgcgcaaaagcagagagggaggcacggaaacgttcagaacgtgctgctgtgcaaagagcccaacaggaagcacgtgagagggcagcagcggatgctaaagatcgagcagagagggctactgcagaagcanacgaaagggctgctactgaagctaangagaaagctgctagtcaagcgagggatagggct

SEQ ID NO: 44489 - DNA, 463 bp, Zea mays
  Clone ID: LIB3066-053-Q1-K1-G8
cggacgcgtgggcaaaccgagaggtgaaccagcagcctccaataaaagccagcacatgcagtaaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgcctccgagtcgtcggcgtccgccgaagcccccgctggcgccgccggcgccggcgccggcaccggcaccgccgcggggccctccgtcagcggcgccgagcccgccctcgccgccgcgcccgccgcgctcctcttctccctactcgcctactacctgcactaagcggacggacggacggacgcgcgcattgcattggcatgcatggactgttgaacatctatgcatgc

SEQ ID NO: 44490 - DNA, 393 bp, Zea mays
  Clone ID: LIB3066-053-Q1-K1-G9
gccaaatatggtagtgattggctagatgccaaggcgacatggtatggcaagccggcgaggtgctggccccgacgacaatggtggcggctgcgggtacaaggacgtgaataaggcccctttcaacagcatgggcgcgtgtggcaacgtccccatcttcaaggacggtctaggttgtggatcctgcttcgagatcaagtgcgacaagccagcagagtgctctggcaagcccgtggtggtgtacattacggacatgaactacgagcccattgcggcgtaccacttcgacctagcgggcaccgcgttcggtgccatggccaagaagggtgaggaggagaagttgctcaaggcgggcatcattgacatgcagtttcggagggtcaagtgcaagtatgg

SEQ ID NO: 44491 - DNA, 286 bp, Zea mays
  Clone ID: LIB3066-053-Q1-K1-H10
cacccgatctgaccaaatttacatttaactgaaattccccaattctattgcatctgcataattggaaatgacactaccactacctatacatattcccttccctcatcatcatccttaacctaaactaaccaaccaaccaattacaccaaaacatcacactacatgatctccacatactctatcacactaataaactacatccctcccaatacatctacaatacacacaatacctaccagattctccaatacaccattcacataaactctcaactcaaataacccaa

SEQ ID NO: 44492 - DNA, 394 bp, Zea mays
  Clone ID: LIB3066-053-Q1-K1-H11
cccacgcgtccgcccacgcgtccgcccacgcgtccgcccacgcgtccgcgcttataatctggggagagcaagatcgggtgttcccaatggagctggctcacagattgaaccggcttctagaggggaattctcgattagttgtcataaaaaatgctgggcacgcggtcaatatcgagaagcccaaggaagtgtgccggagcatcattgagttcttcaaggagcctgtcgctggagctgcaaatgcggacgacaaggtgtagtagcttccactaatggcggacgtggacaggtcttcgctgggcatcggcagacggcgcacccgcttgtggcacgcaaacacaaggcagatacgtggcattgtacatctacatccctctgccattggtctgatgta

SEQ ID NO: 44493 - DNA, 395 bp, Zea mays
  unsure at all n locations
  Clone ID: LIB3066-053-Q1-K1-H12
cgcgtccgggagagactagacccgctagctgaggccgggcggcgcgctggacacgaacatgatggggagaaaggcgctcggctgtgctcctcttctcctcctcttggccgccgccgtcgctccggccgagctcagcgtcggggcggcggctgcctcgggcgcggtcacccgggccgacttccccgcggggttcgtcttcggcgtcggctcctccgcgtaccaggtcgaaggtgcagttgcagaggacggaaggaagcctagcatctgggacacattcacacatgaaggctattcccttgacaacgccacaggcgatgtaactgcngatcagtatcataagtacaaggacgacgtnaagcttctgcatgagaatggtgtcgatgcctaccggatgt

SEQ ID NO: 44494 - DNA, 357 bp, Zea mays
  Clone ID: LIB3066-053-Q1-K1-H2
gagaaagctgatgggagtgaaatggatctttctactatcactagcgcttctacaagctggcgtcggccgccgcatgaggtggtcagtcttgaagtcccgaaagctggtcctggatgtcgtcaactaaggactatcattaccctttttttattgaaatatgttgagccgctaatgagcattcaaaataatgagttggtggtgtacaattttgccactggggctaggttccatgcctagaaattattttgttgtctttactctgctgagctgcaaaagcatttcaccaagggagtacatttcacggttctttttggtttgcaatgcctcaatatcaccagcaatcttctaacttaaaaa

SEQ ID NO: 44495 - DNA, 465 bp, Zea mays
  Clone ID: LIB3066-053-Q1-K1-H4
aattcccgagccacgcgtccgctcagctctcatgctcgctctaaaactgatggagctagaacaaaggctgctcaggaggctttcagggaactacagagtgcccggcaggaggccctgcaaaggaaaaaggctgaaaagaagaaactcatcgaggaggcagatgccaaactaagcgctgagtcactccggaagaaagaagaaaaggaaagggctcggcaaatgaagaagtctggacccaaagtgaagatgctccgctcttaacaacgtcatgattcaagaatctatcatatcttggcttttgctattcacctgttgattagcatatagttcagtgtctgctagactcatttatattctaatcctgtgagaatgagcaaaaaggatccaggagaaaagaatcctcactggcgtttcggcttttattggatgtgtgccagaattatccgtggccccacgcaacttcta

SEQ ID NO: 44496 - DNA, 458 bp, Zea mays
  Clone ID: LIB3066-053-Q1-K1-H5
cccacgcgtccgcccacgcgtccgtggcgctgtccggcgcccacacgctgggcttcggccggtgcaaggagttcgccgaccgcctctacaacttccgcaaccagggcgggaagccggagcagttcgaccccagcatgaacccgtcctacgccagggggctgcaggacgtgtgcagggactacctcaaggaccccaccatcgccgcgttcaacgacatcatgacgcccggcaagttcgacaacatgtacttcgtcaacctcgagcgcggcctcggcctgctcagcaccgacgaggagctgtggacggacccacgcaccaagcccctggtgcagctctatgcatccaacgccacagccttcttcgacgacttcggccgcgccatggagaagctcagcttgttcggcgtcaagaccggcgccgactgcgaggtcaggctgcgctgcgacgcctacaacagc

SEQ ID NO: 44497 - DNA, 455 bp, Zea mays
  unsure at all n locations
  Clone ID: LIB3066-053-Q1-K1-H6
gagaaacaaggctcgacttgtggcaaaaggttatgcccaagtcgcaggtttggatttcgaggagacttttgctcctgtggctaggctagagtcaattcgaatcttgctagcatatgccgctcaccattctttcaggttgtaccaaatggatgtgaagagcgctttcctcaacgggccgatcaaggaggaggtgtacgtggagcaaccccctggcttcgaggatgatcggtaccccgaccatgtgtgtaagctctctaaggcgctctatggacttaagcaagccccaagagcatggtatgaatgccttagagatttcttaattgctaatgcttttaaggttgggaaagccgatccaactctttntactaagacttgtaatggtgatttgtttgtgtgccaaatttatgtcgatgacataatatttggttctactaaccaaaagtcttgtgaagagt

SEQ ID NO: 44498 - DNA, 464 bp, Zea mays
  Clone ID: LIB3066-053-Q1-K1-H7
cccacgcgtccgggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacg

SEQ ID NO: 44499 - DNA, 313 bp, Zea mays
  Clone ID: LIB3066-053-Q1-K1-H8
cagacgcgtgggcggacgcgtgggcggacgcttgggggaatggtggtggtggtgctggagagaagaatctctttgtagcatcctttttctttgatagggctgctgaggctggatttgttaacgccaatgcgcctgtcgctaaggttaaaccatcggacttcagacaagctgcggagcgcgcttgctcgttgagcgtgaagaacgccgaggccaccttccctggtgtacagaaggatagcatttcatatatctgcattgacctcgtttattaattcacattactcctggaaagattccgcgttgatccggacca

SEQ ID NO: 44500 - DNA, 462 bp, Zea mays
  Clone ID: LIB3066-053-Q1-K1-G2
cggacgcgtggggtgatttgaaataatcggtaataaatagttcgtgaatccctgaagcgtgcatgtatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgttcatgtatgctc

SEQ ID NO: 44501 - DNA, 352 bp, Zea mays
  Clone ID: LIB3066-042-Q1-K1-F7
tgcagatccagccctctgatcctcgtcttctttcacctctccaacatgaaggtcaacaccgggatcaagctggagccggtcatggcgccgacgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccggcgatcacgcccaccaagaagcaggacgacaagccgaagccgacgccggatgccgtcaccgcggcgaactacgcgtcggtgtggtcgcccaaacgcctaatgc

SEQ ID NO: 44502 - DNA, 487 bp, Zea mays
  Clone ID: LIB3066-042-Q1-K1-F8
gggctctgagtcttgcacactccgagttgtccactgtattctacgataaagtactactgatggcatgggggtttaacaatgtcatcatccttattattggcatcatcgtcttcatatttgccacggttggtgtcctgcttgttatggagaccctgagtgcattccttcacgcactgaggcttcactgggtggagttccagaacaagttctatgaaggtgatggttacaagttcgccccattctcctttgcgctgattcgtgaggaagaagattgagatcgtcccatgtagccgatgtacaatctttgatggcctttgttcccggaacaaatcattttttcatctgttgtctcggatggatcataaacctcagtcccctttgtttagacatgggacgaacagcaccatttatccttggttagctatgcagatgatttttgggtcggttggcggcaaacatgggggtgatatcaccattgtatgatgct

SEQ ID NO: 44503 - DNA, 390 bp, Zea mays
  unsure at all n locations
  Clone ID: LIB3066-042-Q1-K1-F9
actggcatccccctctctccctcttcccaccacaccacctccctgctcacaagccatagccggcgcctctttctgtgcttgccctctcgccatcttcgagtacgacgagaaggcggtgatggagctggacgagcaggccttcctggaggagatcctctccctgcggagggacgcctgggactgcaatgccatgggggacttcttcgccccggccgacatggactgcaccttccaggaccgtcaccaccaggcgcccaccgtcagcgtcctccccaccttcaccgnctgctacgcccagccgcagccgcaaccggcggcggcgcccggcttcgactgcctcagcgaggtctactgcgccgacgcattcggcgggcccaatgctggtgacta

SEQ ID NO: 44504 - DNA, 133 bp, Zea mays
  Clone ID: LIB3066-042-Q1-K1-G1
aagacgcgtagactgtctcgtgcgctagttttcactttaacgcccattaagtctgtagtcggactgggcgagcttgccgatagtctcggcttcctgacctgctcttttcgagcggttggccatccactacatc

SEQ ID NO: 44505 - DNA, 435 bp, Zea mays
  Clone ID: LIB3066-042-Q1-K1-G10
cagaagttggtatgagtacaacatgcacacacaaaccaaacgaccctacactagagattggaatccaagaataaacttaacacaagaccaaatggtgccggcacatacatgcgtacatgcatctgaaaacaagattaataatcacataaaaagaaagtggaacaccgaacccaacgcaagcacaaatcaagaaagaaacaaaggaactttgacagccacgcccatgcggcaactgcgccgatcgagctccggtcgacgttgtcccacggtcgtatgtagatatagtagtacggccggtaacgctgcgtggtgaggtgagtggcctataggcatggatgtggaacatcacccgtgtgcgggatcagttgcgcttgcgcccttgctgctgggcttcttctcgctgtatgcggagttcatgctgaagctgctgagagt

SEQ ID NO: 44506 - DNA, 389 bp, Zea mays
  Clone ID: LIB3066-042-Q1-K1-G11
gcccatgcacggcaactgcagcacttccgcttccgcgacatcacgctccagcgggggctggggttgataccacttgcgccaccaccaccagcagcgcctgcacagccctcgcatggccggctcaggctccatgacgctccgggccagctcgttcaagcgcggctccggcggcaagatcgagctacatatcggctctacgcgctcgccaaggtgcgaccgcttgtggagcactttctcggactccgcggagtcgtacgttagcggactgctactgcaacatatccagcagaaccagctcctacggctacgactcttcaagccgccagtctccagcatcagcaccataggacttggtctggagatcctgcacaggagcaaactcggcaaca

SEQ ID NO: 44507 - DNA, 468 bp, Zea mays
  Clone ID: LIB3066-042-Q1-K1-G12
ttaaagcattgtcagaactaaggcaccttcatatagagagtttggatagggctacttcaaggtaccaacaccctttggtacatagcttagatgcctttgtctctatggaacttccctaagctatgtaccaaagggtgttggtaaattgaagcatctcaatcatctagatggtctaatcattggtcatgacaacaatgcgcctgagggttgtgacttagatgaccttaaagcattgtcagaactaaggcaccttcatatagagagtttggatagggctacttccggtgcgtctgcactcgcaaacaagccattcctagaggatctgtacctctctgagcaagcaccagcaatagaaaatcaggaagatctggaagacaaagatgaaacagaaaaagaagagaaggaaggacaggaaagaagcaatggccaatgcagaggagatgagtcaaccaaagctagtgaaaagat

SEQ ID NO: 44508 - DNA, 408 bp, Zea mays
  Clone ID: LIB3066-042-Q1-K1-G2
cccacgcgtccgaacgggctctggccttggttccctcctcctagagcgcctgtctgttgactacggcaagaaatccaagcttgggttcactgtgtacccttccccccaagtttctacttccgtagttgagccatacaacagtgtactgtccacccactccctcctcgagcacactgatgtggctatactgctggacaatgaggccatctacgacatctgccgccgatcccttgacattgagcgcccaacctacaccaacctcaacaggcttgtgttccaggtcatctcatcccttactgactccctgaggttcgatggtgctctgaacgtggatgttaacgagttccagaccaacctggtaccctacccgaggatccacttcatgctttcttcgtacgcctcagtcat

SEQ ID NO: 44509 - DNA, 314 bp, Zea mays
  Clone ID: LIB3066-042-Q1-K1-G3
aagaagcacaattttgatggtcctatatactattatgtgttcaattcccttctattttcaggacttgttctccacatatattggtgggtcttaatatatcggatgcttctgagacaaatcaagacaagaaatgttggagatgatgttcgatctgattctgaaggagaagacgaccatgaagactgattggcgtcaccatcttagtttgcatattatgtcggtgctagaagcatcacccccaataccgtccctgagcttatacattctttggctggattccaagaatacgtgcagattatgagaggacgagcatt

SEQ ID NO: 44510 - DNA, 374 bp, Zea mays
  Clone ID: LIB3066-042-Q1-K1-G4
tgatacacacgagttacaaacaatcactctcgactacagaagggagtgtcaacaggatgagatagtggattctcttacttgcatagaggaaggagaggagaaaagcatgaacggctctgcttctgcagcagcgcctcacaaagaagagcggcagcagttcctgcattgcttgagatttgcagccaacggacacgagatcaaccgtggccgtaccgtgtggaggaagctagctagataaaagtgttctttcgtcataaatgatctcctccatttctctgctcacggctggcggcccttgtaccacaattttgtgatgtattgttgccctttggaatgtactcagccatgtatcggtgccgatttgtgacatttct

SEQ ID NO: 44511 - DNA, 397 bp, Zea mays
  Clone ID: LIB3066-042-Q1-K1-G5
cccgatctcgccgtgccctacccccagacccgctccgccgccaccggagagatcgcgcccgccattcccacaatctaatccttccgtccctcgaggagccgagccctccgcgcggccgtgggatggggcggtgacaacaccggtgagtggcgtggggcagggagccggtggcgagggcatatcatggtgcagtgcctggacggggtgaggcagctgctcgcggtcctgctcaagtgctgcgacgtcgagctcaagcagccgcccgggctcgaggaccctcaggttctcgcgagggagaccgtcttcagcgtgagcgaagtcgatgctctctacgagctgttcaagaagataagcagtgctgtcatcgatgatgggctgattaacagggaggagtttc

SEQ ID NO: 44512 - DNA, 144 bp, Zea mays
  Clone ID: LIB3066-042-Q1-K1-G6
gcggcaagacgttgctgccataatccttttacctttataaggataaccctggcactttgggcacgtataaaatacaatatgtacttggcgacatatacgatagatacccacatgtggaattgtatcttacattccaccaaatga

SEQ ID NO: 44513 - DNA, 426 bp, Zea mays
  Clone ID: LIB3066-042-Q1-K1-G7
agatatacgagctcctcgtggacgacaccggcgtcgtcgaggtggatgccggcgccgccagtgcggtggcgctgcccgtgaagcccgccttgcagctggaggaaaagggggagctggagaaggaggtgtgggcgaggttctacggcaccggcttttggaggagcccgtcgcagctggacgacaacgacgacaggtgatcgggacaggcccgcgagcgagctatccacaagctcctccggcgatgcgtgggcttccttcgttttccgcgggaagaagagaggatcgaggaaagggaaacatgattgtgtgttcgatactacgattacgaacttcgatttcccctctttttttgttggtttggaaaggggaaatacttggtcttctattctacaacaatggtacgtacatgcaatggtataattaaaa

SEQ ID NO: 44514 - DNA, 458 bp, Zea mays
  unsure at all n locations
  Clone ID: LIB3066-042-Q1-K1-G8
cccacgcgtccgcccacgcgtccgctaaagcgacatggtatggcaagccgacaggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgttcggcgccatggccaagaagggcgaggaggagaagctgcgcaaggcgggcatcatcgacatgcagttccgaagggttaagtgcaagtacgactccaaggtcaccttncacctttaaaaggggtgcggncccaactaccttgcgctgctggtcaagtacgtc

SEQ ID NO: 44515 - DNA, 313 bp, Zea mays
  Clone ID: LIB3066-042-Q1-K1-H1
gtcaggcggcaacgcttacgtgatcggggactctgctaagcccggtcagaagtggcacgggtactgggccactgagcaccctgaggagcctgtcgttactctggagatgtgcatgactgggctggacaagaagaaagcttctgtcttgttcaagaccactgctgatggttactcgctgtgcgccaaggagatgaccaagctctctggtatctcggacatcattccagagatggagatctgtgacttcgacttcgagccctgtggctactccatgaatgctgttcatggccctgctttgtcgaccattcatgtg

SEQ ID NO: 44516 - DNA, 342 bp, Zea mays
  Clone ID: LIB3066-042-Q1-K1-H10
attcatcacaccttccgtttttaatttagcttcaaggccgccctacacggggcatggtccaatctaactgagccaatggcactgaaccctatgtctcgcgaacatcactaacatagctcttcgccacatcatatcatatcacctttgctatcttggattctgacttatacgcgtccagacataatccgtcacactgaatcttcactccactttatcaccaaccaatctctattaccaaatttgtcaatcaacatctccactaatactatgaacaattactatcgctgtccttttatcactaactaaaaactaacctttctcaccacattctaaccccaactc

SEQ ID NO: 44517 - DNA, 386 bp, Zea mays
  Clone ID: LIB3066-042-Q1-K1-H11
gatgactgttgtgagtatcatgtggtcgttagtgcaggtgcaggtgctggtggtggtggcagtagcatttctggtaggcggtgcctggtgtggtcctcccaaggttcccccgggtaagaacatcacggccaaatatggtagtgattggctagatgccaaggcgacatggtatggcaagccgacaggtgctggccccgacgacaatggtggcggctgcgggtacaaggacgtgaataaggcccctttcaacagcatgggcgcgtgtggcaacgtccccatcttcaaggacggtctaggttgtggatcctgcttcgagatcaagtgcgacaagccagcagagtgctctggcaagcccgtggtggtgtacattacggacatgaactacg

SEQ ID NO: 44518 - DNA, 468 bp, Zea mays
  unsure at all n locations
  Clone ID: LIB3066-042-Q1-K1-F6
gcgcccacgcgtccgctaatatatagataatcgaaatcgaaaagaactgtcttttctggatacgttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgtgaagtttcgggaagaaattggaataatatcgattcatacagaggaaaaagttctctattgatgcatacgctgtacctagaggatagggatagaggaagaaggataaatcgaaatgaaatanataaagaataaagcccaaaaaataagtcgaagatagaagagcccagaatcaaaatgaagaaatggaaact

SEQ ID NO: 44519 - DNA, 468 bp, Zea mays
  Clone ID: LIB3066-042-Q1-K1-E11
cggacgcgtgggcggacgcgtgggcggacgcgtgggtgaacgcgctgtcaaactggctggtgaacccgcgccgcaacccgctcgcgcgcctccacatgaacgccgtctcctcgcgcctcaggaaatacgggctgaggtacgatgacctgtacgacccctatttcgacctggacatcaaggaggcgctcgggaggctgcctagggaggtggtcgacgcccgcatccagcgcctcaagcgcgccatggacctctccatgaagcatcagtacctccccgaggacctccaggcacagcaggtcccattcagaggatatttgagtgacatgttggctctggtgaaaaaggaaagcgctgagcgtgaagcactgggagcccttccactttaccagagaacgcttccctaaattgctggctaaacatggctgcaagtcttctctttacgccaaatcagaatgcatgcaataaaat

SEQ ID NO: 44520 - DNA, 460 bp, Zea mays
  unsure at all n locations
  Clone ID: LIB3066-042-Q1-K1-E12
actacctggcgttgctagtcaagtacgtcgacggcgacggtgacattgtggcggtggacgtgaaggaaaagggctccgacacgtacgagcccctcaagcactcctggggcgccatctggaggaaggacagcgacaaaccgcttaagggacccctcaccgtccgcctcactaccgagggaggcaccaagaccgtctacgacgatgtcatccctgccaactggaaggccaacaccgcctacaccgccaaataattaactttagtgctgacaatactttaagtcggcctatgctagctatactagattgggttggatcccaagcaatgcattacacatgcatgcattggaccgtgatatctatttgctaccactaccctattacgacagtgatgctggcgccaacaataatggcgtcatcctncttctncatcttctccatctccatatatagctagagtgag

SEQ ID NO: 44521 - DNA, 229 bp, Zea mays
  Clone ID: LIB3066-042-Q1-K1-E2
cccacgcgtccgcccacgcgtccgataattggctgatgatgcctgatgttcagtgtgtgatactgtgatcaagcaaggagacgacacttgaattctctacagtttggcataggtcgggagagacactctcgaccggccacaccatgtaacaaactaaccttcttcgttgtctcccattattttcctccacggagttcttctgatgaaacaacatgttctaattgggctt

SEQ ID NO: 44522 - DNA, 336 bp, Zea mays
  Clone ID: LIB3066-042-Q1-K1-E3
cggacgcgtgggcggacgcgtgggcggactcgtgggggcgcgtgctacaagatcgtcctgagtgtgaccatctcggtgatcacgtcgtgctgcaccttcggcttgccgtggctgacggcgtgcaccccctgcccgccggagctcgccagtaagtgcccgaccatcgggcgctccggcaatttcaagaacttccagtgcccgccggggcagtacaacgcgctggcgtccctcttcttcaacaccaacgacgacgccatccgcaacctcttcagcgccgggtacgacagggagttcggcgtgttcacgctcctcaccttcttcaccacggtgtacacc

SEQ ID NO: 44523 - DNA, 339 bp, Zea mays
  Clone ID: LIB3066-042-Q1-K1-E5
cttcgagaaccccgagaagagcatagactccctccacctcgacggctacgccttgttcggcgtcgggatggggcctgggacgtggtcgccggagatgaggaagacgtacaacctactggacacggtgagccggcacacgatccaggtgtacccgcggtcatggacggcgatcatgctgacattcgacaacgcgggcatgtggagcgtccggtccaacgtctgggagcggtactacctcggggagcagttctacatcagcgtcatctcgccggcgcggtcgctgcgcgacgagtacaacatgcccgacaacgccctccgctgcggcaaggtcgtggggct

SEQ ID NO: 44524 - DNA, 368 bp, Zea mays
  unsure at all n locations
  Clone ID: LIB3066-042-Q1-K1-E7
ggacgcatctcggcgggttcctgtttttcctggcgctcgcggtcgccggagggtggacggaggccgtcgacgaagccgctcccgggatcatgaggttcgtggtgacaccaccagctaacgcttcgtggggtagcggccagcattcgggtctgccaagccacgacggcagggcgtcgcagtccggcgtgccgcggtggccgcggacggtgttcctggtgggcgccatgtcgtgcctggccatcagcgcgacggcccacctgctggcgtgccactcgcggcgcgccagcgtggtgttctggcagctcgactacgcgggcatctncgtgatgatcgtcggcttctttcgtgccgccggtgtactacgcttt

SEQ ID NO: 44525 - DNA, 475 bp, Zea mays
  unsure at all n locations
  Clone ID: LIB3066-042-Q1-K1-E8
caccgaacagcacgaccagaccagttgcccggctcaccaaatccaggcgtggccgtgcgacgcatccctcccctcatggcgtcatcggcggcgcgatccctcgcgctcgtcgcgtctgcctcggcatcgctcggcgtcgggcagcggtcgtgggctcgcttggctgtctcttcctcttcggctgggtcggccctccccaagctccgcgggctccgctcgttcgccgcctccgcagggggcgccgtgatggggaagccaggccccggggtcgttgacgccgacgccgggatggacgccgtccagcggcggctcatgtttgaggacgagtgcattttagtggatgaacaagacaatgtcatcggccacgagtccaagtataactgccatctcatggagaagatagaagctggaaatgccctgcacagagctntcagtggtttccttttcaactccaaatatgagttgctactgcagc

SEQ ID NO: 44526 - DNA, 391 bp, Zea mays
  Clone ID: LIB3066-042-Q1-K1-E9
cagctcgcgcgagctccatcggggacaaggccatacctcaacggagtgcaaggtcggccgggccgttcgggagcgatggatgcgcatagctggtggtgcgggcatgggtaccggcacacggcgcaactctcttttttcttgtgataacagatcaataacatatcataccttccaattgcatagctgaatcgaaacatgtcgcgtaggatagttcggctaggccggagacctgctgttggggacttgttctcaaatgctatgagttaagaacaaggcaacacaaaaatgttaatggttaaagtccttcgtccttcgaagcattatctcccttaggatataatgatcttcagacgaaggtcatgaaggatgtaccttcatcatcacagtatat

SEQ ID NO: 44527 - DNA, 300 bp, Zea mays
  Clone ID: LIB3066-042-Q1-K1-F1
cccacgcgtccgaaggccaggtgacccactgggtgagcaagctgagcagaagggcgcagggcttcagagagcatgtgaccttggggccgaagctgtcggagacggtgaaggggaagctgagcctgggcgcgcggatcctgcaggccggcggtgtggagcgcgtgttccgccaggccttctccgtcgccgacaagggcgagcggctgctcaaggcgctgcagtgctacatctacaccacgggcgggcccatcgccggcatgctcttcggcttcactcagaaggtcgccttccgcagcgacc

SEQ ID NO: 44528 - DNA, 449 bp, Zea mays
  Clone ID: LIB3066-042-Q1-K1-F10
gcgacgccaccaccacacgttcacggtagctagagcttatcgtcgtcggcggcgaagatggggtcgctgaagctgcagaagcggctcgccgcgagcgtcctcaagtgtgggaaaggcaaagtctggcttgaccccaatgaagtcagcgagatctccatggctaactcccgccagaacatccggaaattggttaaggatgggtttatcatcaggaagcctcagaaggttcactctaggtcccgtgcaagaagggcacatgaggccaagcagaagggaaggcactctggatacggcaagcgcaggggtaccagggaagctaggctccccaccaagattctgtggatgaggaagatgcgtgttctgaagcgcctgctccgcaagtaccgtgaggccaagaagattgacaagcacatgtatcatgacatgtacatgaaggtcaagggtaatat

SEQ ID NO: 44529 - DNA, 376 bp, Zea mays
  Clone ID: LIB3066-042-Q1-K1-F11
gcgatgagagccttgttcctcctgttcctcttctgcatcgtgcatggtgagaaggaagagtggaaggtcatcgatgcgaaagcgttcgggcctggcgggtccttcgacatcaccaagttgggcgccttcggcaatggcaagacagacagcacgaacgctgttcaggaggcatgggcatcggcgtgcggcggcactgggaagcagacaatcctcatacccaagggtgactaccttgtcggacaactcaacttcacacgcccttgcaagggcgacgtgaccatccatgtggatggcaatctgctggcgaccacggacctaaagcagtacaaggaccatgggaattggatcgagattctacgtgtggataacctggtca

SEQ ID NO: 44530 - DNA, 326 bp, Zea mays
  Clone ID: LIB3066-042-Q1-K1-F2
attgcatgaacgacttcaagaatcccaaggtgatgaggtattgaaagcagaagcaagtgcgaaggtgcacaggtttacagaatgggctctaaagtgtatcgggctgcattcacgtgttcgagagaacaggggcaaaggaaaccacgacactgtaattgaggttcagcttcagttgtctgctttcaagatatttcttgatcttgctgataatgagcttaccgggaaggattttacggaggcttttgatgctgcatgcttccctcttacactcttttcaaccaccttcgaccaaggatgggcatcaagaatatcagcagctgcagtac

SEQ ID NO: 44531 - DNA, 268 bp, Zea mays
  Clone ID: LIB3066-042-Q1-K1-F3
cccacgcgtacgggacgcgtggtcggacgcgtgggcaggtgacgaggctcaagtgtgtgggcttcgggctcggtctgaccatgaaccactgcatgttcgacggcatcagcgccatggagttcagcaactcgtgggcggagactgctcgcggtgtctccgagctcaccgtaccgtcgttcctggaccgaagcgttctaaatgctctcgacccgtccgtgcccaccttaccccaccacgagttcgcctagatccccgacgtcttcgacac

SEQ ID NO: 44532 - DNA, 449 bp, Zea mays
  Clone ID: LIB3066-042-Q1-K1-F5
cacgaggatggtggcgctggccctggtggtcctcctggtggcggcgacggcgtcggtgccggcggccaccgcgtacggctgctacgacgactgctacgagcggtgcgccaacggcaagaaggacgaccccgcctgcaccaagatgtgcaaccaggcgtgcggcagcaccgacaagggcgccgtcgccggcgcgccggcttgatcgacccgggcttcatcggcgcgcgggctcagctcgatatcagcatcatatacaatcgctgctccgtcgctcacgtcagcccatgcatgatctctcgacccggcccattgaatcttctacttctactatagtatatctttgttgcaggtctttcgtctcatacatcgatccactcatctttttttaaatcctaccattaagtgagatgacctatataaatatatatatatgcatgattcagtttttt

SEQ ID NO: 44533 - DNA, 461 bp, Zea mays
  Clone ID: LIB3066-042-Q1-K1-E10
caccgaacagcacgaccagaccagttgcccggctcaccaaatccaggcgtggccgtgcgacgatccctcccctcatggcgtcatcggcggcgcgatccctcgcgctcgtcgcgtctgcctcggcatcgctcggcgtcgggcagcggtcgtgggctcgcttggctgtctcttcctcttcggctgggtcggccctccccaagctccgcgggctccgctcgttcgccgcctccgcagggggcgccgtgatggggaagccaggccccggggtcgttgacgccgacgccgggatggacgccgtccagcggcggctcatgtttgaagacgagtgcattttagtggatgaacaagacaatgtcatcggccacgagtccaagtataactgccatctcatggagaagatagaagctggaaatgccctgcacagagctttcagtggtttccttttcaactccaaatatgag

SEQ ID NO: 44534 - DNA, 222 bp, Zea mays
  Clone ID: LIB3066-042-Q1-K1-C4
gagagagagacaccccagccgtccgagagcggtcggtcggctgtgctggtggaccaaaaagggcgagcgaccgtgccatgcatgcagcgcgctgacgaggcgttcggcacggctccgatccgcctccgctccaccaaccgaggattaggcgtcgtcgtcctgtgccacaggcgccacgcccagatcgtgtaccggctattggtgcgcgcgcgcgctcatggc

SEQ ID NO: 44535 - DNA, 418 bp, Zea mays
  Clone ID: LIB3066-042-Q1-K1-C5
ggacaactggcggcgcttcgccgtcttcgtgcgccgcatgaactgcgccgggtcgtgccgggaggccgcggagcgggaggcgcacggcgtcgcgcaggccaccgggtcgctggtgcacgaggccgtcgtcgcgctgcggatctgaccggccgggacggtacgggacggaacggaagcctacgatcgactgtacatacaggggttgggacttgttgggttttcctttgggtggagagcgagggagcgcagtcgagagccagcgagcagtctctcgtgcagtgcagtgcagctccggcgtagatgagattgtattgtgaccaagccgtgagggaaagcatggaggtgaggacaaagaagttttgtcacgtttcatgctccaggcattgccggagtttgtcccgggaatatatcgatttcc

SEQ ID NO: 44536 - DNA, 394 bp, Zea mays
  Clone ID: LIB3066-042-Q1-K1-C6
gccacgcgtccgaggaggagcctgcccgcgcctgcgcctggttgtaattgtagctgacgctcacccttcagttgaccaccgctgcggcagcaatggcggcgagtcgccggcagcaccgccgcggcttcccgctggtcccgctgctgctgtcgctcctggcggccgccgcgtacggccgcctcatctccgacggcggcccgcccgcgccgctcctcccggtcatccgcctcgcggcgccgccggccgaggccgagtgcgagcagacctacggcttcctcccctgcaccaccaccgtgctcggcaacctcttcctggtgctggcctacggctttctcatgttcaaggcggccacgttcctgtcggcgggcaacgagctgctgctagagatcatggg

SEQ ID NO: 44537 - DNA, 398 bp, Zea mays
  unsure at all n locations
  Clone ID: LIB3066-042-Q1-K1-C7
ccaagacaaaacatggctgtgaatgtgagaaccatttggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgngttgtgggtcctgcttcgagatcaagtgcgataagcctgtggagtgctccggcaagcccgtggtggtgcacatcacggacatgaacta

SEQ ID NO: 44538 - DNA, 453 bp, Zea mays
  Clone ID: LIB3066-042-Q1-K1-C8
cgtagaaaagcaagacgatgatgaaattcatccaaggcgggtacctgccgttctgcttctggcttgtcctcatggccttgatgatcacatggcactacgtccacgtgatgaagtactggtacgagctggaccacgtcgtgccagccaacgaagtgacaacgctgcttgagaagcatgaggtgcggcggatccccggggtgggcctcctttactcggacctggtccaaggcatcacccccgtgtttccacgtctggtgcagaggataccctccgtgcacgcggtcttcctgttcatgtccatcaagcacctgccgatcccacacgtggcccctgtggagcggttcctcttccggcaggtcggcccgagggagcaccggatgttccggtgtgtggcgaggtatgggtactgtgacaagctagaggagtcggggctggtaaaaggttcctcatgga

SEQ ID NO: 44539 - DNA, 70 bp, Zea mays
  Clone ID: LIB3066-042-Q1-K1-C9
aatccgtatatgggatcttaatttgtacattaataagaaacaaagaatgtactacccacttattgcttct

SEQ ID NO: 44540 - DNA, 344 bp, Zea mays
  Clone ID: LIB3066-042-Q1-K1-D1
ggaggtgccgacgcgggagctgttcgacgcgtgcagcatgcgcaacatcaccagccggtagcagagcgggcccaccatcatcgagctcaccgaccccggcgagcgcttctacttctgtggcgtcggcgagcactgcgaggccggccagaagctcgccatcaacgtgctcctcgtcccgccgccgccgccggacacggacgacgactgctccagcgccgcccgtctcccgggccacgcgggcgcggggctcgccgtcgtctgcatgtgcctcgtgtccgcgctgctgacaatggcggtgtgaatcggcacgctgccgccgtagattattggcgattgctggctga

SEQ ID NO: 44541 - DNA, 438 bp, Zea mays
  unsure at all n locations
  Clone ID: LIB3066-042-Q1-K1-D10
gcagcattacgaggccaaaagtaagctgctgctgttcttcgacccgtcccgttcggtcgatgcgttctttccgccatggaggctcggaggaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgccagtgcctgttggcggactgccaataggcgcgaacagctgcgtcgcatggcgtcctggctgcctcgccggccgatgaaggatgaacggttgcngccgatgatcgatgtgtccgtcggcatgtcgatcactcattganaccccctcta

SEQ ID NO: 44542 - DNA, 468 bp, Zea mays
  unsure at all n locations
  Clone ID: LIB3066-042-Q1-K1-D11
acggccactgcttgcgtctctgtctctctgtctgctcgtgtttctgcttctgcgactcgtaggagggtgaggtcttgcttgcctcgcggaatggcggcggccggggcatggctggcccgtgcgacggcgactgcggtgctgggtttcgtcctggcggtggcgtcagctgaggcggcatcgggggacgtggagatggttttcctcaaggccgcggtggccaaaggcgcagtgtgcttggacggcagcccaccggtgtaccatttctctcccggctccggttctggcgccaataactgggtcgtccacatggagggaggaaggtggtgcaggaatcctgatgagtgtgcggtccgcaagggcaacttcaggggctcctccaaattcatgaagccactctcgatttcacggatattaggcggcaaccaanaatccaatcctgatttctacaactggaatagagtaaagatc

SEQ ID NO: 44543 - DNA, 462 bp, Zea mays
  Clone ID: LIB3066-042-Q1-K1-D12
cggacgcgtgggcggacgcgtgggcggacgcgtgggcggcgccgggacaggcgttgacaccgttcggcggcactggcgcgtacggcccgtcaggggcaggcagcacggactacaacgacgccgtcgccccgcgcgccgccgggctgcacgtggtggctgccctcgctctcgccgtcgccgtcgccgcacctctccaccgctaggggcggtgccatggcaactgggagctggcgggcacgacactcgcagacgggatcccgcctcggcggcccgccagcgcgggctctggtcgatgtccggcgttagtgcgtgcgcgtacctgatgaagtgatgatgggttttgatcgaccagccgtcagcgtagtgcggtcacggggtttacagtgttattcgaactgacctctctgcttcctcgtgctagtagtggtggctggcatgtgtgtgtgctgctggtagagaact

SEQ ID NO: 44544 - DNA, 373 bp, Zea mays
  unsure at all n locations
  Clone ID: LIB3066-042-Q1-K1-D2
caacgagtgggtaaagcccaagccaggaacctacgttacaaggctcacccgcttctccggcgacactgtcctgctgcacgggcaagccgtgctgaaggccggtgggcatcaggctgcttcttctagctcatggcctggccatgccaggtcgcgctggctgcgtttcatttcatggaagaaagcaaggatggatcacaggttgtcgttctgctaattaatctacatacgtttgccttcaagtactgtgttgtggcattgttacacatcacagtacagtttggtcaaattttttttccacagaggaagtanggattgatntaatcattgatttaatcccacacgcgtgtatctacgtatacagtntgtataacat

SEQ ID NO: 44545 - DNA, 315 bp, Zea mays
  Clone ID: LIB3066-042-Q1-K1-D3
gttcagttgtagccgttgagacttgggaggcaggcgacatgggtggcgggaaggacgacggccacgatccctcgaaggcggacaagggattccacggaggagggtacccggccgccgccggtggatactacggcggccagtaccccggcggcggctaccctgctccaccgggcggcggtgcgtaccctcccggccctgggtacccggtaccacctggtgggtacccgcctccgggtggctaccctcagcctggcggatacccgccgtcgcacggtgcgtacccggcgcctggtgcaagcgcgtattcttccagcg

SEQ ID NO: 44546 - DNA, 266 bp, Zea mays
  Clone ID: LIB3066-042-Q1-K1-D4
actagttctagttccgtcgtgctggaccttgtcagagggtgtattttgagtcagaagaagcgaaagcttgcattgtaacctgtggaggcctttgccctgggctcaatactgtcatcagagagttggtttgtggcttgtcccacatgtacaacgttagcaatgtcttcggaatacataatgggtacaaggggttctattcgagcaattatcttcccatgacaccaaagagtgtgaatgatatccacaaacgaggtggtacagttctt

SEQ ID NO: 44547 - DNA, 214 bp, Zea mays
  Clone ID: LIB3066-042-Q1-K1-D6
aaatgagtgaagggtagatgctgatctgaaaaatatgtgtgttcccccctctttgcttccatgtcgtgttgtttcaggtaaccgtcacaatatatataggtggtcccctttggaatccggggattattccgtttgctgtatttttttctgtgaaaatgaactgattcctgtcaaaaaataaaataaattaattttaataaaaaataataaataa

SEQ ID NO: 44548 - DNA, 269 bp, Zea mays
  Clone ID: LIB3066-042-Q1-K1-D7
ccacatccaagtgaggaaagttcaggtctgatgtgccggtgggaattggtcgtctgagaaattttgatagcgccgcctgatgtgttatcatcattatatgtgtaattttactgttttaccaggagattgctacgtcgagttatatgttgtgtcgaattcacgtgtaggctctgaatcttgactgtgttcgttcattttcgcttgtttcacactgaagtgttataagctcaactttactgctttaaaaaaaaaaataaaaataatataat

SEQ ID NO: 44549 - DNA, 394 bp, Zea mays
  Clone ID: LIB3066-042-Q1-K1-D8
caccacctctgctgaacgcgaaattgtaagagacatcaaggaaaagcttgcatatgtggcgcttgaatacgaccaggagctcgagaatgccaagagcagctcatctgtggagaagagctacgagctgcctgatggtcaggtgatcaccattggggcagagaggttcagatgccctgaggtcctcttccagccttccttcattggtatggaagctcctggcatccatgagaccacctacaactccatcatgaagtgcgatgtcgacatcaggaaggacttgtatggtaacattgtgctcagtggtggcacgaccatgttccctggtattgcggaccgtatgagcaaggagatcactgcccttgcgccgaacagcatgaaaatcaaagtggtggca

SEQ ID NO: 44550 - DNA, 469 bp, Zea mays
  Clone ID: LIB3066-042-Q1-K1-D9
cggacgcgtgggcggacgcgtgggcggacgcgtgggagcgagcacccggcgtcgggcgacggtggcgccatgggtggctgccactccgccatcgcggccaccaagctgaagattctgcgccgcggaggccggggtgccgctgccgtcctccccgtcaccaaccacgacggcccgtgctgctcctccgaccacggcagcaaggagaagaagaagaaaaagaagggcgccaggaagggcaggaaacgcgcctccatcctgggcgacgccggcaccttcgacccggacttctcgcggcggtaccggctcggcgcggagctcgggcgcggcgagttcggcgtcacgaggcggtgcgaggacgccgtcacgggggaggccctggcgtgcaagacgatccggcggaagcggctgctcctgcgcctcgccgggcccgacgcgaccgacgtgcagcgcgaggtggagatcacgcggc

SEQ ID NO: 44551 - DNA, 250 bp, Zea mays
  Clone ID: LIB3066-042-Q1-K1-E1
ctgtggttcaaggaacacagatttatgcctgcatgtatcgcttccaaatcgatatgtcgaggtacggaatcttgtagaggctccatgatgcatacatgcaaattcccgcattccaagccgcgctttctaaaaatcaaccagactcaccttcatgataaacatcaatattatctcaatcattctcatgtcattttgcaataatttgtatagggagccactgctttctttataccgttgtttatcaaaaggg

SEQ ID NO: 44552 - DNA, 356 bp, Zea mays
  Clone ID: LIB3066-042-Q1-K1-C3
cacgtacgttgaacaaacacccaaggcctgacgagacgagatccggacctccgtcctcccgactagggcgcgcgcgcgacctcggcaccggcggcctcgatccatcgttctctcggatccccgccagtgcatgccctggaacggacggacggaatggcagcgtcgccggaccacctcttcggcctgcgcaacagcttctacgtcggcgcataccacgccgtcatcaccagcagccagtccctccccgcgcacgcgctctcccccgacgacctcgtcgagcgcgacgccctcatgtaccgctcctacatcgccatcggctcctaccagctggtgatcggcgagatcgggcccagcgc

SEQ ID NO: 44553 - DNA, 257 bp, Zea mays
  unsure at all n locations
  Clone ID: LIB3066-045-Q1-K1-B7
cctgatttctctggttccttgagactattactaccgcttgtgcgagcacgcaaatgtatgtgatgcattattgctgatagcatctgttcgttggccagatgagtagagagctgacaaaatgttaagaacaccatagagagaagtacatccgctctctctcaactcaaggagcanacagcaacacttaattatgagtctgctatactgattatcagtcgcgtaacatttgtgaacaagttattgaaatatctcttttt

SEQ ID NO: 44554 - DNA, 442 bp, Zea mays
  Clone ID: LIB3066-045-Q1-K1-B8
cacaacacaaggagaaggggaagggcggcgagggaagggctccgcgtcgtgtccctgctcgtcctcctcctctctccaacaccccatccatcagcgctgccctccgcattgctcttgataccatccagtacatcgattctccccccaagatcaaaggccggagaaggaggaagaaaggttagggagtcggctatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaaggaaattacaaaaaacttcagcagtgatgccctcattggcgagggctcgtatg

SEQ ID NO: 44555 - DNA, 452 bp, Zea mays
  Clone ID: LIB3066-045-Q1-K1-B9
cggacgcgtgggatcgcataaaaggagatcagcaggaggtggagccaaccgacgacggatcggtccctgcgacggaagagaccgagacctagcattggccgcgcgccggagtgggctgcactgcagtgcaggtgggtctcgcatcgcacgcgaggaggatgtaggctgtcgacgcccgggagaaaaggtgaaggtggagcgggtgggcaatgagccggcacctgcaccgctgcttcgcgtccacggggaccatgttcctgtgggcgctcttcctggtggccatgacggccacgtacctgagcgtgcactgcttcgtcgacagcacctccccgcgctacttcgcggcgtcctgtggcgggctgcactgggagcgccagatccgggcgtcggcgtcgacgcggcggcggtcggcgcctgggccgcccgcggggctgtccgtgctcgtcacgggc

SEQ ID NO: 44556 - DNA, 490 bp, Zea mays
  Clone ID: LIB3066-045-Q1-K1-C10
gaattctccgggttcgactccacgtcgtgccggggaatttgagggggaaaattggaggggatttgaggtgtggaggtggggaatgaactgaatttccacttcaagtccccgggcattatctctcaatgtctctagtcattcaaatcagcccctgagggccctgttcgtttcaagctcaatccatatggataggggattgaatggttttaaatctctagcaagtcaaaatcattcctaattcctcatgttgggagagtgcatcagccgaaggtcctcaaactacaaattccaagttttatgatctgtttccagatcattcttcgtcacggcatgcctcagccgaaagctataaaatgaaaacgaaggtctggagcaagtaactgggaaacgaagaaggaatcaagtgacgtgcacgtaacgtcttcaagaggaacagaaagacgatatctctggtagattatgtagctcacgtgtataagatcaaaggtca

SEQ ID NO: 44557 - DNA, 457 bp, Zea mays
  unsure at all n locations
  Clone ID: LIB3066-045-Q1-K1-C11
gcgcggacgcgtgggcgccggaggaggggagggatgatgtggctcccattcctgtacccggcggcggcgtgggcgtacatggcggcgatgtcggcggtgtcgttcgtgtccatggcgaacgcgggcctcgccgagctccgcggcgaccacatgccctactccaagttctggcacgccgtggcgggtgccgccggcggggacaccaggcagcggggcgggatgccgctcctgcgaagccgggacggcatgctgctggcctacgccccggcgctgctcgccgccgccgcgtccttcgcggtgccgggcgccgtcgagggcgcgcgcgccgagctgctcagcgccgcgctcgccgcgcacttcctcaagcggatcctcgaggtgctgtgcgtgcaccggtacagcgggagcatgccgctgggcacggcggccaccatctnctgcagctacctggtcagca

SEQ ID NO: 44558 - DNA, 458 bp, Zea mays
  unsure at all n locations
  Clone ID: LIB3066-045-Q1-K1-C3
gatcgatcgatcaaaaatccatcggcggcggccctaacccggccggtcccgtgtcaatcgtccgaattgaatgacaacgacaacaagctaggacggcagcagcaatgccggcccccggcgctgttctattttgatcccaggcccagcgatgcattggtacggtcaccaccgactgctattggtacggtcaccaccaccacagcagcaacagcatcgccctgtcgtcgtcgtccctgtccctccccgcctgcagcagcactagcagcatcacctactcctgccacctgcagcagcagcggcatcgtcgcaccatgggcggtcaccagctgcacctgtcgtccncgaccgcggtgctgggccacgtcaccccggcgctgcgcgacctctacgccgtggggcgcaagctcgggcaggggcagttcggcaccacgtacctgtgcacggagcttgtccacggc

SEQ ID NO: 44559 - DNA, 454 bp, Zea mays
  Clone ID: LIB3066-045-Q1-K1-C4
gatcgaccgctcgtacgggcacacgatgcatttgtacccacggacgcgcacggctcgattgggcgggttcaatgactcgggcatctagcgcgtacgctccaacatctgcgagaggcacgacctctgcgagcagcaccacatgagcctcagactcgtctgagcgtgcactagcgactagtacaacatgcgacacaccagcctgcgttgcggcaaggtcgtcgggctgccaatgccacaggccctacagcgaccgctagagcgttgaccgatagcacacggtgctgtacacaactaaaggaaagcgagaggggactctttctcgcgactacttgtataaccaggcttgtatgtcccctcctcgtttattctctctctctcttttttagttcgctttcgagggataataacccaactaaaaacacaaaagggctcaagactttatcatgcatgcatg

SEQ ID NO: 44560 - DNA, 438 bp, Zea mays
  Clone ID: LIB3066-045-Q1-K1-C5
cactgatccaagacaaaacatggctgtgaatgtaagcaccatgtggtcgtcgatgcaggcacaggtggcgatggctatggcgttggcgttcttggtgagcggcgcctggtgcggtcctcccaaggtcccccctggcaagaacatcacagccacctatggcaaggactggctggacgctaaagcgacatggtatggcaagccgacgggtgccggtcccgatgacaacggctgcggctgcgggtacaaggacgtgaacaagccccccttcaatagcatgggcgcgtgcggcaacatccccatcttcaaggatggtctgggttgtgggtcctgctttgagatcaagtgcgataagcctgtggagtgctccggcaagcccgtggtggtgcacatcacggacatgaactatgagcctatcgcggcgtaccacttcgatttggc

SEQ ID NO: 44561 - DNA, 351 bp, Zea mays
  Clone ID: LIB3066-045-Q1-K1-C6
ctgactcgtgggaaaaaaaaaaaataaaaataaaaaaaaaaaaaaaaaaaaaaaaaaaaaagaaaaaagaaaaataataataaataaaaaaattaactaactcatacattctacttcataaattcttatataataaaacctatataaaattaattaaataatctatatacaacattaatacatattaaaacattatcatttcccaactccttttaatttctatcacatttccctttatacatcttgctcaatttgtcaacatgttcttacccatctatacttcctatcagttcctcaattctgaatggctattttttattaaccctctaattttacattaattgcagcggt

SEQ ID NO: 44562 - DNA, 429 bp, Zea mays
  unsure at all n locations
  Clone ID: LIB3066-045-Q1-K1-C7
atccaagtgaaggaaggggtgtacgaggagtacgtgaccatcaccaagactatgaagaacgtgaccctcttaggtgacggctccaagaagtccatcgtcaccggcaagaagagcttcgccgacgggatcacgactttcaagacagcaaccttcactgcgcaaggcgacgggttcatggcgatcgggatggggttccagaacacggccggcgcggagaagcaccaggcggttgcgctgctggtgcagtcggacaagtccatcttcctcaactgcaagatggacgggttccaggacacgctgtacgcgcactccaaggcgcagttctaccgcaactgcatcatctccggcacggtggacttcatcttcggcgacgcggcggcggtgttccagaactgcatcctggtgctgccgcngcccatggacaaccag

SEQ ID NO: 44563 - DNA, 454 bp, Zea mays
  Clone ID: LIB3066-045-Q1-K1-C8
cccacgcgtccgggcacacgatccaggtgtacccaaggtcgtggacggcggtgatgatgacgttcgacaacgcgggcatgtggagcgtccgctccaacatctgggagaggcagtacctcggcgagcagctgtacgtgagcgtcatctcgccggagcggtcgctcagggacgagtacaacatgccggagaccagcctccgctgcggcaaggtcgtcggcctgccgatgccaccgtcctaccgcgccgtctagagcgtcgaccgatcgcgcacggtgctgtacacaactaaaggagagcgagaggggactttttctcgcgtttccttctctagccagccttgtctgtcccctcctcgtttattctctctctctcttttttcgttcgcttccgaagaataatacccaaacaaaaaaaacaaaggggctcaagacttcatcatgcatgcatgcataac

SEQ ID NO: 44564 - DNA, 367 bp, Zea mays
  Clone ID: LIB3066-045-Q1-K1-C9
cacaactttcagatagatctacatctaactttaccagcctgcaccatgcgatttctacttcaggctcgtatctacgcttccaagacatctccataactaaatccactacatcaccttcacaacctctctcactacaaattcttcttgctagacacatactactgctatctctgacaccacctctattaccataaagagacctatcccattaatcactaatgctccatcatatgatatcaatgactgacagactttaatgtccttgacaaactccaccttgatcgctatttctacaaccacgactactccacatactggcttcacttcctaccaggtcttcaagactatgctcacatacctttattat

SEQ ID NO: 44565 - DNA, 462 bp, Zea mays
  Clone ID: LIB3066-045-Q1-K1-D1
cggacgcgtgggtcttttctcatctatttccgcttcactctgattactcttaccttttcactctaaagacaaaagtggatttcacactttgaaatcctgtgcttaaagtgacctgtaggaataggagacctactcataggaacaaaaacaaaactatttttgtaggtatatataggtacttgaatgattgttcttatgacacttgtctgatttgattctttgattgagtgtgatgggttgtggagtaatgtccacaatcacatctgcatatacatatagaaaaaaaacggttataaaaatatctaaatgaactaggttatccctcatcaaagaatctagcctagcaaaatccatcttatcttgaaaaggtctatcctacattcatagatccatcttatcctaaaaaaaatagattctcatcttatcttgaaaagaattatcttatcctaatagatctatctg

SEQ ID NO: 44566 - DNA, 326 bp, Zea mays
  Clone ID: LIB3066-045-Q1-K1-B5
aaaaaaaaaaaaaaacaaaataaatataaatattaaaaaaaaaaataaaaaataaacaaaagggataaatataaacataaaaaaaacaaaatacaaataaaaaaaaaaataaaaatctaaatacaggcaaaacgggcttgccgttttatgggccccaaccttcccttcccttcttttggatctcatatctcttctctggggtcccctacatttacttcgtttgcccctgttttacaccgcgttgcctggtaaatccctgcttttactcagtttatcccctttccagattttcctcttttggccatttggcaatttctctatatggc

SEQ ID NO: 44567 - DNA, 336 bp, Zea mays
  Clone ID: LIB3066-045-Q1-K1-A10
cacacgcgtacgcccacgcgtccgcccacgcgtccggggtccttcggggctttggcccctgttgacaagggtaatctgaaacttactagaacattcgagttcattatggtcagattggtatgtctcttgtaagtcaggctggtgactggaataaatcttgcatacctgaactcaataggcaccgatgcgtatgtaaccctactacttggcatgtagaaaattaagacgatcgtgaagaagagatctgtgaacacgatctggcacgatgagctaactctgaccgtcatagatccaagactagctctgaagctggaggtgttctacaatgacacgttc

SEQ ID NO: 44568 - DNA, 473 bp, Zea mays
  Clone ID: LIB3066-045-Q1-K1-A11
ccggtccgggattcgagggacgcgtcacgcgagattttgttccagccatttacgatccaacggtaatagttcctaaggattcccttaaggcaacagtgctgcggatttggaaagggcaatcatcagtgatacatgtccgcatgaaacgtcatgcaatgagtgagatgccaaaatcagatgatgacgtttcaaaatggtgtaaagacatttttgtggcaaaggatgccttactggacaaacatttggcaacaggcactttcgatgaggagattagacctatcggccgcccagtgaaatcattgctggtgaccctgttttggtcgtgcctgctgttgtttggtgccatcgagttcttcaagtggacgcagctcctatcgacatggagaggagtggcattcactgccgcagggatggcgctcgtgacaggggtcatgcacgtcttcatcatgttctcccaggctgagcggtcgagc

SEQ ID NO: 44569 - DNA, 286 bp, Zea mays
  Clone ID: LIB3066-045-Q1-K1-A12
cccacgcgtccgcccacgcgtccgattaagaattcattgaaaaatgaatgcaagcattcaggggatggtactgctcctaatgctagggtagcattcaaggttaatattatgtatgcaacatccatcaatgagtgagacacctgaatgagatcatgaccttacatactgatgtacatgcatactcgaggcatatgataccttactgctcaaacatttgacaactggcactatctataagtagatatgacctatctctctatcacagaaatcattgattgtgaccctg

SEQ ID NO: 44570 - DNA, 383 bp, Zea mays
  unsure at all n locations
  Clone ID: LIB3066-045-Q1-K1-A2
ccgaaccgcaggttcgacccacacgtacgctttcggctacgtcattctagtagtttaggatttcttttctgacacatcgattctgaccaatctctctggcctgctgcttcctgataatcgaccagttccccagtcttgctccttgcactcctccctccatctccagcattgtgttctgattcacctgctccaatggctgatctttctgctgctgatgcttccccggtctcagctatcgggtttgagggctatgagaagcgccttgagatcacattctctgaggcacctgtctttgtggaccctcatgggcgtggttggcgtgccctctccagggcccagattgactctgntctggatcttgcacggtgcacaattgtgtccga

SEQ ID NO: 44571 - DNA, 413 bp, Zea mays
  Clone ID: LIB3066-045-Q1-K1-A3
ctatgcggatcgagcggaggagaagcttctggtggtggtggctctcgtcgtcaagcacgaggtgagaggagccggcggcggaggtgaatggcggtggagtaccactgctgctcggcggcctttttcgagcacatcgtcatcatcatcgtgctcgtgctcttcgcgggcctcatgtcgggcctcaccctgggcctcatgtccctcagcctcgtcgatctcgaggtcctcgccaagtccggcaccgagcaggatcgcaagcacgcagctaagattttacctgttgtgaagaaccagcaccttctgctatgcactcttctaatctgcaatgcggctgcaatggaggctttgcccatattccttgatagcttggtgacagcttggggtgctattttaatatcagtgacactgattct

SEQ ID NO: 44572 - DNA, 283 bp, Zea mays
  unsure at all n locations
  Clone ID: LIB3066-045-Q1-K1-A4
agagcgtccggtcaaggctgcctgcctattggttggacctggacgaaggaggacgagaggctcgctcgtggctggcggttggtacgtgcgcgcgcgatggacaggggaacggtggaggacctcatacggcggttgctggacgggaagaagcacatggcgacggggaagaaggtgcagctgaccgagaccgagatccggcacctgtgcgtcaccgccaaggagatcttcctctcccagcccaacctcctcgagctggtggcccncatcaacgtctgcggtgaca

SEQ ID NO: 44573 - DNA, 140 bp, Zea mays
  Clone ID: LIB3066-045-Q1-K1-A5
gcgctattcaaaggatggttagtacaagagatatttctctcccctcttccacagatacaagtccttcaaccaaccaacttcaaatcaggaaaaggatgctgtcaccctcatgctcagtgttcgtcaagcaaatcttcttc

SEQ ID NO: 44574 - DNA, 297 bp, Zea mays
  Clone ID: LIB3066-045-Q1-K1-A6
acgccaaggctggctgcctattgattggacctgtaccatggatgactagaggctcgatattgggtcggggaagctacgtgcacgcgctatggacatgggaacggtagaggacctaatactgcagctgatgaacctaaagacacacattgcgacagaaagaaaggtacagatgaccgataccgagatccagcacatctgcatcaccgccaaggagatcttactctgccagtacagccttctagagctggtggcccccatcaacgtctgcggtgacatccactggcagttctcggacct

SEQ ID NO: 44575 - DNA, 229 bp, Zea mays
  Clone ID: LIB3066-045-Q1-K1-A7
atgcagctcacctaaaataaaaatctaaaattaaaaaacaactcaaataacaaaaggaaaggtaaaaatcaactcactaacaaatgcaaataacaatgcaaatcctactacttcctccaggccatcacactagctcctctacttgattatcttgctcgtgcttacaccgatcctgctgttcatctctaccctctacttcatgtctttcttcctccactataccatcttc

SEQ ID NO: 44576 - DNA, 383 bp, Zea mays
  Clone ID: LIB3066-045-Q1-K1-A8
acccacgcgtccgcattcaagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaa

SEQ ID NO: 44577 - DNA, 451 bp, Zea mays
  unsure at all n locations
  Clone ID: LIB3066-045-Q1-K1-A9
gacgaaagaagtcgcctaattctttcgatcaatttaggcccttttttcgtccaaggctcgggcttaattggtaatctgaacctaacaggaccatttaagtggatcatggccggatgggtaggacttctggaaagtccgggtggtgaggggcaatcaaccttgcctaccgcgacgcaggaagcagcgatccgtatgtacgcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggatgcgagcctgaggaacggcgccatcattctgtcngtgcg

SEQ ID NO: 44578 - DNA, 466 bp, Zea mays
  unsure at all n locations
  Clone ID: LIB3066-045-Q1-K1-B1
cgacctctcctcctcgctgtctctctgtatctgcaactgcaagcaaggaaattaattaagagaagatcggcgccatggcggcaacgacgacgacggggatgcagatgatgcaggtgcagcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacaagcagcacangagcgaggcgccgncgncggcgtgtccgcgctcagagggttcaagctatcatcaccgacgacccgtggccgtggatgannataataaggccccatgcatncatgcatcatgcatgcatgcct

SEQ ID NO: 44579 - DNA, 245 bp, Zea mays
  Clone ID: LIB3066-045-Q1-K1-B10
cccacgcgtccgaaacattgccatggccctggactggaagccccaactttcccaagcctgtggaaagcgccatgtgcctctacagaagccaccgcgtgatgaccagcttcatccggcagggtgggtacagtagctagctatagccctagtctgatgtaagaacaaatttatattatccatcccatattgtctttaaaaaaaaaaaaaaaaaaaaaaaaaaaaataaaaagataaaaagggtagac

SEQ ID NO: 44580 - DNA, 442 bp, Zea mays
  Clone ID: LIB3066-045-Q1-K1-B11
ctcagcgcgctcagggagtgccagaagcaggacggcctgctgcacaccacctgcggaacccgggcgtacgtcgggccgaagatcatcaacaggaagggctacgacggggccaaggccgacatctggtcctgcggcgtcatcctcttcgtgctcctcgccggctacctcccgttccacgacgccaacctggtggagatgtaccgcaagatcagcagagccgacgtcaagtacccgcagtggttctcccctgagctccggcggttgatgcccaagctcctcgaaccgaacccaaacaacaggatcacgatcgagaagctggtcgagcacccctggttcaagaaggggtacaggccggccgtcatgctggcacagccgcacggctccagcagcctcaaggatgtccaggtcgccttcagcaacgccgaccacaaggacagcagca

SEQ ID NO: 44581 - DNA, 312 bp, Zea mays
  Clone ID: LIB3066-045-Q1-K1-B12
tggttgccttgtctgctattttgacttatgcattatgagtgggatcaagatgtttagcaagcgttaagttgatgtcgcatttacatgaagtgcactgcagctgaatatttatatattcaattccatatccatacactacatatgatgctaagctaataaaaagtagatgtgtatgtatgagtgtcatattgaagtttatggtccaaaatatctttatagcctactatatataatctctacaatactttgctgaactacggcagttgatactcaatctcctcgaactcaacctaaacaacatgatcacgatct

SEQ ID NO: 44582 - DNA, 373 bp, Zea mays
  Clone ID: LIB3066-045-Q1-K1-B2
cccacgcgtccgcccacgcgtccgcccacgcgtccgcccacgcgtccgcggacgcgtgggcgggcaacggcgtcgtcaccgccggtgagaagctaggcgtggagcggatcgagctgccgctgatctacatctcgctgtcgcggaaggagaaggaagacgatttccttgcgatgaagggcaccaagctgccccagcggctccatgaaaagggctaagaacgtggaccagaccctgcaatctgtcttgccggagatgtggctgtccgatttgacgaggggacggtacgaggtgcgggagaagatatgcgtgacgaagacgcgaagagggctgaaagggatggagagcattgacagcgactcggagcctatagatg

SEQ ID NO: 44583 - DNA, 182 bp, Zea mays
  Clone ID: LIB3066-045-Q1-K1-A1
cccacgcgtccgctccggccggcgacgcgggggaaaatggggaagacgccggtgcggatgaaggcggtggtgtacgcgctgtcgcccttccagcagaaagtgatgccggggctggggaaagacattaacaacaagaaccaacacaagggcaccgagaactggatcttcggcacgcttcttct

SEQ ID NO: 44584 - DNA, 408 bp, Zea mays
  Clone ID: LIB3066-045-Q1-K1-B3
attgttcaacgctggtaggtccatctcatcacggaccatgggctcttccatccagggcaccaaggcccagccattcccatctgcagcctcaaaacctacactggcaaaggagaaatccgacaaggtcagcaccaccttgcagcggcctccagtgcttgctgtgccggcagctaaggcatcgccatccaccttgccgaggagtaagccatctccaaggcctagttctgacagttgcaaagcggcagcatcactgaaacctagcagtcagagggtcatgttgccaggtgctgctcaaggagacaaagttcagccactgtctaccgcacagtcacctggtgcagctgcaaggaagagattggatactgttaatggtgctactaccaactcaaaagctaaaagtgtttctca

SEQ ID NO: 44585 - DNA, 273 bp, Zea mays
  Clone ID: LIB3066-045-Q1-K1-B4
cccacgcgtccgagaaagttgacgatgctaatccttttaaagtcaaaagttactttttgttgtatacttcacctttccgtacaagctgtcgatgatgcaagaagttacacaggcgaatggaattgcctgggcttgcttttacacttgtgaaaatcgtgtattttattttcctgctctcgtctgaggttagtgtaataattcaacgtttggagtttcttgttttaactgtattttacatgaaataccacctcaaaatcctgttgtggaatcagc

SEQ ID NO: 44586 - DNA, 335 bp, Zea mays
  Clone ID: LIB3066-044-Q1-K1-G12
cccacgcgtccgcccacgcgtccgcggacgcgtgggcgtctccttctccctcctggctccagcacgagcggcagctgtcggagcacgacagttgcagcgtccttcaggggaggaagaaaggggacgacggcacgagtttaaaccaacaatctctcgtcatatatatcataatagagagtaggacgacaaaagccatgggcagtaatggcagagatcataggcgcggagtcccacgcccgccacctttaccactttacagggattgggaggaggaagaggtcgtcaaggctggtagacgtcggcagtcgccgttggcgcagtcgtcaacgtcgccc

SEQ ID NO: 44587 - DNA, 66 bp, Zea mays
  Clone ID: LIB3066-044-Q1-K1-G2
cccacgcgtccgcggacgcgtgggcaaaaggttaaatatacatgccatttttggaggcatgttttt

SEQ ID NO: 44588 - DNA, 383 bp, Zea mays
  Clone ID: LIB3066-044-Q1-K1-G3
attcttcttctattctattctttcaccccagaccaccgctttcctctacgagtacgtcgctaaaggaagcatcctcgacatcctgtgtagccaggaggatttcccgctggatctacgcatgaggatcgcgatcaagaccgcggaagcgttgcagtacctgcattcgtcggaaactgggcgtcaccggacacggcagcgtctcggcgtccaccatactcctcgacaacaacctcgtaccgaagctcaccgagttctcgaggtcatgtacgctgttcaagaagagcgagactacttctgttgttggtgctggagtgatgatcactggcagccttctagagaaagctctgaacgacgacccgtcccgctacggctcggtgttgatg

SEQ ID NO: 44589 - DNA, 277 bp, Zea mays
  Clone ID: LIB3066-044-Q1-K1-G4
cccacgcgtccggtgcatgacatcttggtgagtcgatggacaaaaagcaacacgcccttgcactgcttggcacacttactaaattcaaagtattacactgatgcatggatcaatgaggtcctcaaccgacaggctcctcataatgatgaggaaatttcagagatgagaaatacttgtttcaagagggtattttctggtgcagaattaaaaaagattaagttgcagtatgctaatttctctttgtttggacctggattcaattcatttgacttacttg

SEQ ID NO: 44590 - DNA, 104 bp, Zea mays
  Clone ID: LIB3066-044-Q1-K1-G5
cggactcgtgggcggacgcgtggtcggactcatgggtgaatgacatgctcgcatgtgatgcaggtttactattaatatactatgcattcatatattcccacttt

SEQ ID NO: 44591 - DNA, 232 bp, Zea mays
  Clone ID: LIB3066-044-Q1-K1-G6
gatggggccaatccattgggccgctggagccactgcccgcgttgttctacaagagttaggtatcctcgcggttgacacagaaaggataaaattgcaagttgtgtctcagtttggcactcgaagggagcttgtgtgggtgttgttgttttttttttgtcatggcagcgtcgtctctaactctaaaggataccgcagtttctccaggtatttctgttaatagcgttatgtacct

SEQ ID NO: 44592 - DNA, 208 bp, Zea mays
  Clone ID: LIB3066-044-Q1-K1-G7
gttgaacatctatgcatgcatggacgacgtcacttgcaacgctgttcccatatagtactactggtctgctatgaatatctatgcatgcatggtaacgggttgtgttatttaattattattattacgtagacattactatttaaaattcatgtgttcgcgtcaagtcgttctgtaatcttgtgatggaatatatatgatatttcctttt

SEQ ID NO: 44593 - DNA, 402 bp, Zea mays
  unsure at all n locations
  Clone ID: LIB3066-044-Q1-K1-G8
ttccacgacgccaacctggtggagatgtaccgcaagatcagcagagccgacgtcaagtagccgcagtggttctcccctgagctccggcggttgatgcccaagctcctcgaaccgaacccaaacaacaggatcacgatcgagaagctggtcgagcacccctggttcaagaaggggtacaggccggccgtcatgctggcacagccgcacggctccagcagcctcaaagatgtccaggtncgcttcagcaacgccgaccacaaggacagcaccaccaaggtggaacagccggcggacagctccttgaagccggcgagcctgaacgcgttcgacatcatctcccactccagagggttcgacctgtcaagcctgttcgaggtggaccaagagcagaaggccagcaac

SEQ ID NO: 44594 - DNA, 438 bp, Zea mays
  Clone ID: LIB3066-044-Q1-K1-G9
gtagatttcagtctactgctgtactatatactaagaggaccaacacttgagaaaagacctgggaactgggaagcagtcactagccatcaattttgacagagtagatccagcaccatctgttcattgaacttgtgagctcgatggatgggtttttctgcagttagcggggtttagttaagttcgaaggataatgcagtagacaacgttggtcacgtgtggtggtgaggttccaagtaagagagagcatcacactcacgtaacaggaatgatcattgatggattgaggcgccttaattgaaattggtgccttccacctcatggatgcaggttaattcttttcttcgttgattttttgaccccttttgcttggtccttctgccaataaggacatccacaggttaaaattcaaattctttgctctaagttgttgcacattga

SEQ ID NO: 44595 - DNA, 459 bp, Zea mays
  Clone ID: LIB3066-044-Q1-K1-H10
cccacgcgtccgctgaagctgaacagccaaaggacactaagaccagtgtctcattccttgggtcggctgatgatggtaacacattcttgcattcctcagtctacatgccaagtgctccaccagtacttgatgaagaagccttaaattacaacatttatagggctgtactggaagcagagccaccagaatggcttcctgacagttatgctagtgcgtgtatgcagtgcgctgctctttttactgcccttacacgtggaaggcatcattgtcgattctgtggagggatattttgcagggcatgctcaaagggacgatcgctgttgcctgccaagttccgtgagcggaatccgcaaagagtctgtgatgcttgttatgataggcttgatccattgcagaacttattgattaattctgtcagcaatgcctcacaaactgcaaagcatgatgtcatggattgga

SEQ ID NO: 44596 - DNA, 206 bp, Zea mays
  Clone ID: LIB3066-044-Q1-K1-H11
cgaatccccagaccaaatcgccgtttccgtcgccgtcgcatcgcagcagctggagtcccagggtcccgtaccgaatccatttgcagacactcatggccaagatccatcgctcgttccaaccagccttattcttcttgtgcttggtcgtctgatctcgttttccattcgtgtccaatccgatccatccaaccgctgtgaatgatgac

SEQ ID NO: 44597 - DNA, 370 bp, Zea mays
  Clone ID: LIB3066-044-Q1-K1-H12
gtcacgcgtgagctgctacggcgacagagagccgcttcggagcaagcagcaatggacgcgaagcagaggcaaagttcgggtggcatgtggggttggctcgctggaagcccgacaccagcagtttagttccgtgattcatatattttacttgtaacattatatatcatttgactgacaccctctacaatttttttatttggttacttacggcattcgtgttcattttggacccacaaagaataaggtgttctagcgatcgttatactcacaattactcaaaatgtattctttaggtttagcaagggggtgctcatgttagtcgatgtgctggttatccttttgacgctgtgctggtttggctgtccaaaaa

SEQ ID NO: 44598 - DNA, 141 bp, Zea mays
  Clone ID: LIB3066-044-Q1-K1-H2
gcgcccacgcgtccgcccacgcgtccgggaaagagttacatagttgcaaccaaaggcgcacacgaagctggttaaggaaatatccaaatctcggaagactaaccaaaccgtggaaacttacactgtacatgtcgttacgct

SEQ ID NO: 44599 - DNA, 368 bp, Zea mays
  Clone ID: LIB3066-044-Q1-K1-H3
cccacgcgtccgattggttcttcatttaattgggattcaaacaaggacttaggggctaacaatttaattccaattgaaattgctctcaaaattgcaaataagattaaggcaaatgaaaggttttctgcatacatagtggtacctatgtggcctgagggtaatccaactggggctgcaacacaacgaattctttactggcagaataaaaccatgcaaatgatgtacgagacaatatacaggaccttgaaagaagaaggcctggatgatatgtatgagcctcaggattatttaaacttcttctgtcttggcaaccgtgaagttgctgacagcactagcacttcaaacgcttcgaatacagcaaataatcc

SEQ ID NO: 44600 - DNA, 303 bp, Zea mays
  Clone ID: LIB3066-044-Q1-K1-H4
cccacgcgtccgcccacgcgtccgctctctctctctctttcatttctatagccagcaggtggcaggcaggcaaccggccggtatattagtagatcttcgatcgttcatccaagctaataagtcagtaagcagcagtaggtcgaaaatggcgatgaggtcgctagcgctactggtcctcctcagcctgctggttgttggtgtggcgcaggcggtggagttggagatggagttggtgcctgctgatgcaattgcgatgactatggatcatgagccgccgcaggagtgcgcgaccccggtgagcgt

SEQ ID NO: 44601 - DNA, 466 bp, Zea mays
  unsure at all n locations
  Clone ID: LIB3066-044-Q1-K1-H5
ccacctcccagatctcatctgcgacgacctcctccctcccgatcccgctccgtgtccccgcaccgccaccgctgccgctgccgcctcccccaccgaggtcttgtcttcggcgatccagccggagcccgcggcggcgacgatgtacgggtgggagatgctgtcgttcaacatacacgatgggttcctggaggccatcgtgcggggcaaccgctcgggcctcctcaccgccgccgactacaacaacctctgccagtgcgagacccttgacgacatcaagatgcacctcaccgtcaccgagtacgggccctacctncagaacgaaccttcacccttgcacacaacgacaattgtggagaagtgcactcttaaactagtcgatgagtacaagcacatgctgtgccaggccactgaaccactatctacgtttttgcaggatataacttatggccacatgattgacaatgtt

SEQ ID NO: 44602 - DNA, 356 bp, Zea mays
  Clone ID: LIB3066-044-Q1-K1-G11
gtcacgcgtcccgtacggaggatcttgagtctgtgaatccgatcataacaacgcggttacgtcgctattgcgccggctcaccatcgagatccttctactagctaattcactaccaataactgctttcaatgcaagttcctaccacacatgaagaatctcatgctctgatatcacactcacacaactagatggagctactaggttatacatatatgtcgaaccacgggcactaggattcagacctattgtatcttattgagccctttatggcacatgcagcatcctgcatgactaatcatctgtaccactttgctacacaatcttgtggactttacaggcgtactccacattgcatt

SEQ ID NO: 44603 - DNA, 321 bp, Zea mays
  Clone ID: LIB3066-044-Q1-K1-H6
cccacgcgtccgcggacgcgtgggcttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgttttttttccaaatataccgtcgatggaactccaaatgtaatgtcacgcaaatgtgtgtttttcatcgattgaatggataataataaaaaaggcatgctggcaggtactact

SEQ ID NO: 44604 - DNA, 355 bp, Zea mays
  Clone ID: LIB3066-044-Q1-K1-H7
cggacgcgtgggcaaacaactagaaattccccagcccggttctttgcgtgcggttgatctcgtcggaggcccggccgcggttccccaatccgccatcgaattcgatggcggccaacgccgggaataagatccgcaacgccaagctggttcttcttggagatgtgggcgctggcaaatctagcttggttcttcggtttggtaagggacagtttgttgaattccaggaatcaacaattggagcagccttcttttcccagaccttagcggtcaatgatgagactgttaagttcgaaatctgggatactgccgggcaggagaggtatcatagcttggctcccatgtactataggggtgc

SEQ ID NO: 44605 - DNA, 299 bp, Zea mays
  unsure at all n locations
  Clone ID: LIB3066-044-Q1-K1-H8
cgcacgaaccgacgcactagaccgacccgcgaatcccccgcgcgcgcgccgtgcggtcacgcgtccgaggccacggcaccgccggcccccgcccccgccccggccgccaagagcaaaggcaaggccgacgcttcctcctcgtcgtcctcctcctccactccaccgaggttgcgccgcgcgcttgccgtcgtgatggccgcgtcgctgctcgtgctcgccgtggcgttcttggttggctctggctccggngggatcgatggaggcgcagcggctcccgtcgaggtggagggcaccgaggt

SEQ ID NO: 44606 - DNA, 416 bp, Zea mays
  Clone ID: LIB3066-044-Q1-K1-H9
gtcgcgcgtctaggttcactctctcactatagcgcccgctctgtcgcccttcgtgtacctgttcttcctcttctcactgcctgccactgagagcgtaagtcaaaggcacgaagtggctcagagcatacgccctgagagaccattgtaactaggcctgtcggcaggatagtagccgtcgactaatccctacaaggaacagatggagaagaaggcgcacatcctgatgaacaggtacaagcttgggcgcacgctcatgcaaggcacctatatcaaggggtaccacagacggaacctggctttcagagagagcgcgtgcatgaaggccatcgacaaggagaaggtgatgcgcgatggcatgatcgaccagatcaagcgcgagatctacgtgatgcgccgtgtacggcaccccaacgtga

SEQ ID NO: 44607 - DNA, 423 bp, Zea mays
  Clone ID: LIB3066-055-Q1-K1-H4
gagcacgcgtacggcgcgcacgacggcttggctcccgcctccccgcgcgcggcaagccggcaccgcaatggcgcgtccggaccttccctccccgcgtcctcctcctctccgtcgtcctcctcgctgaccccgccgccggcgccggcactggttcggagttcgacgacggcacctcgcccaagttccccggatgcgacaacacgctgcagaaggtgaaagtgacgtactgggtggacggcgacgagcggagcagccttacggggatcagcgcgaggttcggcgcggtcctgccggacgcggcgcccgacgacgagaagcagcgggccgccgtgcccagccccgagagcggctgcgccaagtcgtcgacgccgctcgcgggctccgacgccgtggctgtgcgcggcgagtgcacgttcatcgaga

SEQ ID NO: 44608 - DNA, 451 bp, Zea mays
  Clone ID: LIB3066-055-Q1-K1-H5
gtctgcgtgcccaccacacctaggttgtccttatcgtgctcgtcgttcggccacatggtgggcccgcccaccgacacaccgccgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcagcaaggtctatgatgaggcggcagcggcggctaccgcggtgccgcctgcaggtgccaagacctccagcagcaacgatgcccgcgacggcgccatgggcagcgtgcaggacgagccgcggcagcagcgccacgatgactatcaccccgagatcgtccccgaaaagatca

SEQ ID NO: 44609 - DNA, 260 bp, Zea mays
  Clone ID: LIB3066-055-Q1-K1-H7
aaaaaaaaaaaaaactaaaaaaaaaaaaaattaaacaaaaaaataaataaaaacaaggaaagggaaaaactcaaaaaaaaataaacataaactactctataaacaaaactaacccaaacttgcttttctgtctctagctttagcttatcttgctcacttttctctcctcttcttttaatacccgtacacacactcgtacttctaaaattgaaactctttctctcttgtggtgcctgtgcaccattcttgcttgctttctt

SEQ ID NO: 44610 - DNA, 456 bp, Zea mays
  Clone ID: LIB3066-055-Q1-K1-H8
cccacgcgtccgattatttccggtttaggcttggattgtttgtggtagcctcggcctttggagttcattcagatcggtgattcctgcgtcggccaacagttttgaggtggtaatggcggaccaggctaaccaacccactgtccttcataagctaggtggccagttccacctgagctccagcttctctgaaggtgtacgggcccgtaacatctgcctttctttctcatcttatgaaaggagatttgccacgaggaactacatgacccagagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctgtttcgaagactgcagctgctcccattgaacgagtgaagctgcttat

SEQ ID NO: 44611 - DNA, 322 bp, Zea mays
  Clone ID: LIB3066-055-Q1-K1-H9
cggactcgtgggttctttctttcttatttttctctttattttcctcatcacctttttcttggtctttctctattattatctctacatttttttttttttcttcttctttttttttttctctctttaaaaagcatcccctccaatcttttcaccaagcactccttccacttccactacacaccccaccacaaaaacaaactctccctcacctcctcccagatactgtccaccgtcaccaatctcaaagccatcactatgctctactgccttcaactactgcactcccacatcggctcccacatccccaccaccagcctactct

SEQ ID NO: 44612 - DNA, 408 bp, Zea mays
  Clone ID: LIB3066-056-Q1-K1-A1
gaaacaacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcccgctcacccgcaacgacggcatcaagcagagc

SEQ ID NO: 44613 - DNA, 436 bp, Zea mays
  Clone ID: LIB3066-056-Q1-K1-A10
ccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtggttgagaggctcggtgactacctcgtagagcaaggcctgtgattgaatgcatccaaacaacgacaccaacgccaacattaattaattagtagtctccatgccctgggattgtgcgtggccgctccgttaaacaccacccatccttcgttcggcattttttcccccttgtttatataattttattgtatcgttttggcaaataattttgtgattcgaccccaaagcaagtttggttgtcttacgatttgtaaacctggaacaatatataatgtgattgaactgctttgtct

SEQ ID NO: 44614 - DNA, 401 bp, Zea mays; identical to SEQ ID NO: 44401
  Clone ID: LIB3066-056-Q1-K1-A11

SEQ ID NO: 44615 - DNA, 408 bp, Zea mays
  Clone ID: LIB3066-056-Q1-K1-A12
cgcaaggagagcaccctccacctggtgctccgtctcaggggtggcatgcagatctttgtgaagacactcactggcaagacaatcacccttgaggtggagtcttcggataccattgacaatgtcaaggccaagatccaggacaaggagggcatcccaccggaccagcagcgcctcatcttcgccggcaagcagctggaggatggccgcaccctggcggactacaacatccagaaggagagcaccctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatcttt

SEQ ID NO: 44616 - DNA, 424 bp, Zea mays
  Clone ID: LIB3066-056-Q1-K1-A3
cccacgcgtccggcggccgcctttattttttttttttttttttttttttttttttttttttggtttttttttttttttttttttttttttttttttggggaacttatttttcttttgaacaatataacctctggcttaaaaattttgatattttaagttggaaattgtttaaccccataaagtggaacatttgaatgggccaatgttgaaatacctgttactagacccggtttcagtgaaaataaaatttcaagtcctgccaacaaaaaatatccccggggtggaaatttatggcccccataaactgcaactcattaaacggcttccaatggcaatcctaatttaaaaattggccttctaactaaggggactcttgttgcgccaagttgaccgcttaatacccttcagtgggttctttttcaag

SEQ ID NO: 44617 - DNA, 396 bp, Zea mays
  Clone ID: LIB3066-056-Q1-K1-A4
cttcgagccgctcctcgtcgacttcgggttctccagcctcatcagccacatgcagtccccgaactccctgttcgcgtaccgcgccccggagtgcgccgccggccaccccgtgagcgcaatggccgacgtctactgcctcggcgtcgtcctactcgagctcctcaccggcaagttcccggcgcagtacctccagaacgccaagggcggcacggacctcgtcgtgtgggccacgtcggcgatggccgacggctacgagcgggacctgttcgacccggccatcatggcggcgtggaagttcgccctgccggacatgacgcggctcatgcaggtggcggtggactgcgtcgagacggacctggagaagcggccggagatgaaagaggcgttggtgagggt

SEQ ID NO: 44618 - DNA, 427 bp, Zea mays
  Clone ID: LIB3066-056-Q1-K1-A5
cccacgcgtccgcggacgcgtgggcgacgactgcgggtcttaggcgacaccgtcacaaccgctgcgtctgcaccgtccagaagtgacgcctccaccttcctctacgcgcagacaccaattcgaccaccttcctcgccaacaccctcagcctcgaggagaacgaggtgtgtgtatcgcgttcatgaaagccatcgtgcctggtgggattgaattcgagatgtacttctctgtcaggagaaatggcgtgggatttggtttgtatctcgattcttctgtgtgcgtctaagtagatcgcggtcatctgtacaggctatagattggtgccttcttccaatctccccctctcttagttccccaccctctccgtcttccatttgtatattggagacctatatctgagatatcaccaggtctatcttttcattgt

SEQ ID NO: 44619 - DNA, 478 bp, Zea mays
  Clone ID: LIB3066-056-Q1-K1-A6
ttggtgttcgcggcagcgccagtttgcttcccggtgatcatggcggcggcggcggcggcaaaggccgtgcggggccgtccaagcgcgcgaccacgtaggtcggctccgccagaccgccactccggcctctgtgtcaccggaaattcgtcgcggaaaattagtgtgcactgggcagtgggcagatatgcagttggttctcctgtccatgaacaattaccatctcaagggaattaagaagctttcaggccttgccaaggaagactgggggattccaagatgaagaaaaatgttatgatgcacaaggttatagaaaattctagtgaagagaaataatatcataccttcctcttaagaaatacatcagcacataaccaagagattccagatcatctcttctgctttgctctgtaaggaaatgaagaaaggttaacccaaattcatctattaaggcatccagatttgtggatgaatatagtct

SEQ ID NO: 44620 - DNA, 358 bp, Zea mays
  Clone ID: LIB3066-056-Q1-K1-A7
gccacttaggcttgcgatcgcgtggcacgatctttgcgaaaaagcaccctggtctgctgccgaccgagtcgctaacaatcgatttccatgacacgtccccgcgtgggtgtcccatggcactggcgctgctgctctgtcggaggtccgcgcctgtgcgagcgtccgactcagcggtcactacgtgcaacccggcacgcaagcggcaagcccagcggggggggctgcgcggggatcactcacgggacggacagacagctgcgagttcagccactagatctggctggcatgagaggtaaggtgtggtggcgtctagcgactactgacacacatgcgcacattggtcgaattctttgtaatg

SEQ ID NO: 44621 - DNA, 480 bp, Zea mays
  unsure at all n locations
  Clone ID: LIB3066-056-Q1-K1-A8
cgagaatatcaagatggaggactcagccaaccccatcttcatcgacatgaagtactgccccaacaagttgtgtaccgccaacggcgcctccaaggtcaccgtcaaggacgtcaccttcaagaacatcactggcacctcctccaccccggaggccattagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcatattagttgctatccattggtaacgcacaacagtaaaacgacanacatncaacagctatattatgttcgacggtgtaacaccctgaattttagggtataaaatttcttctc

SEQ ID NO: 44622 - DNA, 488 bp, Zea mays
  unsure at all n locations
  Clone ID: LIB3066-055-Q1-K1-H3
ccgtctcgggagaatctgtccgctcgtcctnnctcctcccgcctctctgcggctcctctcgcagaagagggcagtgctcgcncgcggcggtcgagcgcgacctcaactctccctttcgtgctcttcgcnctctcaaacggcccctcaagccgccaagaaatggannggagggcngccacgagccgcgaggaaccctgcaggtgcannngcggtgccgggccgccgtctggaaaccggctggcgaactgctncagcaccggcgaacgatnngccgagtgggagggacccatgtcggttgaagaagggatcccctggtnncgattacatnnngcttcggatgggtcctaactacannattccgcncacccannagctcnngctgagactnnntctggtattcaaggacccctcgttgatanttgatgggtctttctcgatgccgaaaaagagtnaattggattcttcttcagaaaataatgaaaagtttc

SEQ ID NO: 44623 - DNA, 432 bp, Zea mays
  unsure at all n locations
  Clone ID: LIB3066-055-Q1-K1-G1
aattccggtcgaccacgctccgcacgcgtcgcaggagatcaggaagtttcacaaaagccctggcaccacggcgtgaggacgatgtaaactcacaagcacatctggaacagcgggatcaggagcgtgccgcggagggttcgtgtgaggatcgcccgcaagaggaacgatgaggaggatgccaaggaggaactctactcccttgtcaccgtcgcggagatccctgccgagggcttgaaagggctggggaccaaggtcgttgacgaaaccgattaagctgtcgcgttctccacatctttagagagttcctagtttgtatttgcaacagcaaaaccttttgtatccaaagaagtttttgtattcacaaagttgtctatttctgncacagaattgcatggctagttttcttttcatctctgccacatccttttcttc

SEQ ID NO: 44624 - DNA, 459 bp, Zea mays
  unsure at all n locations
  Clone ID: LIB3066-055-Q1-K1-G10
cccacgcgtccggtttgtctggtggtacaaatggacattcagacatgtgctacttctgtcccagatttaaaaaaacacagaaatctgctggtgtccttgaacagggaaatgttgctctggatgttgctcgcattcttctacgctgtanagctgagttggctactacagacattactgattatgcattggatgctctacgtggcagcacgataaggaacgtatatttggttgagcgaccgngtccagtacagggcaacttgcacagcaaacgagctgcgtgaaattttaagtttgaaaaatgtccgtatttgcatcaaggcagctgatctcgtgaccacacctgcggacgaggaggagatgaggaatagtagaatacatagaagagtttatgaattgttgtcaaaaactgcgcatggcggcaacaattacaatggccaaaaggagcttcattttgtgttt

SEQ ID NO: 44625 - DNA, 400 bp, Zea mays
  Clone ID: LIB3066-055-Q1-K1-G12
cacgcggctgcagcgagcagcacgccccgacggaagacgagaccaaggataaagagcgatggctggccaaagagaaggctttcgcggcggagaacgtcgtacagcatgagatgctcaagttcgccaaggagtatggtctggagtcctcgtccaacggcacggagtggtacaggggcatcgcccgggagttcgtggacgcccacaacgagctccgcgcgcgctacggcgtgccgaccatgaagtgggactaccagctggtgcggcaagcgcggcgctggtccaacgccatgcgcaaggactgccagatcctacacagcggacactagtacggcgagagcgtgttcaggagctactacgactggaacgccaccgccagggaggccgtcttatggtggggcaa

SEQ ID NO: 44626 - DNA, 399 bp, Zea mays
  Clone ID: LIB3066-055-Q1-K1-G2
cccacgcgtccgcccacacatccggccacgcgtacgtccacgcatgcgcccacgcgtccggccacgggttctcagactcatgggcgccatgcgcactgccatcagcttgatcgtgatgggattcgtccgcttctttatcaagctcatgatgatccacatcaacagacatcatcgacgaattctgctgattcatgaccgtcactgactaacgagtggacaacgtcatctgcctcttgaccgcgcacctctagcataccgaatgcactgtgttgatgtgaacgactagtcccagggtctacctggtactctctcgtgcctgatgtcgaatattcatatgtgaagaagattcacttagatgttaccatgtgcaaacagaattgcatggctagttttcttttc

SEQ ID NO: 44627 - DNA, 383 bp, Zea mays
  Clone ID: LIB3066-055-Q1-K1-G3
cggacgcgtgggcggacgcgtgggcggacgcgtgggcggacgcgtgggcggacgcgtggggtgaatcatcccctcgatcggcggggacggggccagggcatgaggcggcggcgacccgactcctgcccagctgattatacatccgtttacctggtattggcataaggagacccttggatgcgtgtaatgtttgtttgcagttctgataaggtgtgcaagaaggctcatgctactgggagcaatgcttgtatctcagttttgcttctgcgggttttttatccacaaattacattgttctcgttgatcacatttccataaaaccatttatcagtaggtcaccatgtagagcaaaagaagataagaaaaagttgcttcaacaaaaa

SEQ ID NO: 44628 - DNA, 160 bp, Zea mays
  Clone ID: LIB3066-055-Q1-K1-G4
caatctcatgaggtcctgacctacagggaccgtaggtaccggtcgatgtctacgacttgcggcacgtcctccgtttcacggtaaggccgcttccagtccatcagccagcgcccgaagtcttcggagtccggacttcttccgttccttaacttcttctgcc

SEQ ID NO: 44629 - DNA, 442 bp, Zea mays
  Clone ID: LIB3066-055-Q1-K1-G5
cgtcgcccggtcggaagcaccaccagctaccagggatgtctggcgaggaggaggagaacgccgcggagctcaagatcggcgaagagttcctcaaggccaagtgcctgatgaactgcgaggtggcgatcatcctggagcacaagtacgagcagatccagcagcacgcgtcgtcggagtcggacccgtcgtcgcaggtgtcgcaggtgttcgagaagtcgctgcagtacgtgaagcgcttcagccgctacaagaaccccgacgccgtgcgccaggtccgcgagacgctgagccgctacggcctcgccgagttcgagctctgcacgctcggcaacctctgccccgacaccagcggcgaggccaccgcgctcgtcccctccctcaagtccggcggcaggttcgtcggcgaccccggggacgagaagatcgagaagatgctcaacga

SEQ ID NO: 44630 - DNA, 167 bp, Zea mays
  Clone ID: LIB3066-055-Q1-K1-G6
caaactcctgcgggaaacaaccacactgaccatagatacacggctatgcataagggatcgggtactatcttaggttctcggaatagtcactgacagcacaatgcctattatactagccagtttcaatcattccagactccacatactagcctactcagcagataacg

SEQ ID NO: 44631 - DNA, 335 bp, Zea mays
  Clone ID: LIB3066-055-Q1-K1-G7
acgtgatcatgttctacgcgccggtgctgttcctgaccatcggcttcggcgacggcgcgtggctgatggcggccgtcatcacggagctggtcaacatgttcgccaccgtgctgtccatcgtgtgcgtggaccgcctgggccgtcgcgcgctgttcctgcagggcggcacgcagatgttcgtctcccagatcgtggtgggcacagctcgatcgcgctccagatcggcacctgcatcgttggcgagatgtcccgctccaacgcctgtctgctggtgctcttcatctgcctgtacgttgccaggttcgcctggtactggaggccgttgatctggctcg

SEQ ID NO: 44632 - DNA, 105 bp, Zea mays
  Clone ID: LIB3066-055-Q1-K1-G8
accaaggttaccaaaaaagttgctgttcctacccttccggccaataaccatggttctataaaaaccatttccttgaaacctaacgggcaattgaaaatgaccccc

SEQ ID NO: 44633 - DNA, 278 bp, Zea mays
  Clone ID: LIB3066-055-Q1-K1-G9
cgctcctgccgccgccgccccagccgggggcgaccattctccggccttctcgttcagcatcgtggccgccgacgcagcgcacgcgggacgcggtggtgcggcgcctcgtggagacgctcgcgggggacaccatcctctgcaagcgctacggcgccgtgccggccgccgacgccgagcccgcggcgcgcgccatcgaggccgaggccttcgacgccgtggccgccgcgggaggcgccgccgccttcgtggaggaggggatcgaggcgctgcagtcctac

SEQ ID NO: 44634 - DNA, 419 bp, Zea mays
  unsure at all n locations
  Clone ID: LIB3066-055-Q1-K1-H1
gtccggcttctcctcgtcggaggagaactgtccgctgtcgtgactgacgttggggaggtcggcctcgttcttgatggggcgcagacctgggcgtcgcgcagccgcctctcccacgtggcgacgttgcgggagcagtgcgggagacgacatcaggagtgcggaaggtggaggggaatcaaccactgcattggtgtagattggcgggcaacctgtccgggctgccatcgtcggacggcgaccaaatctaggcagcgcgggtgttggtggcctccaacgaggcctctcctcgactgacgtggtggacgcgacagccatcgagcgcanggtggagataatggtgttctcgaagatcctcgcgtcgcgcagcacacatagttaatctaatctcgggacacgcggaccgttcgagcccaagggcc

SEQ ID NO: 44635 - DNA, 452 bp, Zea mays
  unsure at all n locations
  Clone ID: LIB3066-055-Q1-K1-H10
cccatgccatcgcggcgcctaccccacccgtcctgctcccgnccggtagtagtagcagagcgtccccggccgtgccgagaatagatggggttcgggtccttcgtcgggcggggtgctcttcgtcgccgctttccttctctccgnctaccaggagtttaatgaatttggcgctgatggtgggccagcagctaaggcccttcagcccaagttcaatgtgtttgtaaaaaatatctctgcgcatctgggagtagttgtgccgcacattgagttgaagcatgtgattgctgctacaattgctcttaagggacttggaagtctcctttttattttgagcagctccctcggtgcttatctcctgctgctgtacctcgctctgatcacntctatcgttcacgacttctacaactacgacacggagaaggaagaaatcgcgcggctgtttgcgaagttca

SEQ ID NO: 44636 - DNA, 313 bp, Zea mays
  unsure at all n locations
  Clone ID: LIB3066-055-Q1-K1-H11
cccacgcgtccgctcgctcgcgctcatggcgcgctccatgggcctcaacaccgtcatcgtgcgcgagcaggaggaggagctcgacattgtcgtcgaggccagccgccgtctcggcgtgcgccccgtcgttggcatgcgcgccaagctgcgcaccaagcacgccggccacttcggctccacgtccggggagaagggcaagttcggcctcagcgccgcgcagatactgtccgtggtcaccaagctcaaggccatcggtatgctcgactgcctccagctgctgcacttncacatcggctcccagatcccgaccacc

SEQ ID NO: 44637 - DNA, 421 bp, Zea mays
  Clone ID: LIB3066-055-Q1-K1-H12
cccacgcgtccgtttcttaacacaaatgatgtcacttgtcatgaaaatcgttgggagaacgaggacagcggatttttggcatttacgatacatgatcacagttctggtggagacatctatttggcattcaatgctcatgagtattttgtggatgctgtaattccgccaccaccactccatatatcttggaatcgtgtggtggataccaacctggaatcaccaaaggatattgtcccagaaggggtgcgcattcacaggttcagggtacatgattgctccgtactcttacatcttgcttaaggcaaagccttagaatggcggatgcaagtgattctgaagtgagcacgaataatggtgttgtgatccctaactttgcaagctcttagccaactgtactgcaagtatagcaaactttggtatg

SEQ ID NO: 44638 - DNA, 463 bp, Zea mays
  Clone ID: LIB3066-055-Q1-K1-H2
gcgttcactcgtcctgttcaacaacatctccaccctccttccaaagaccaccatgagggctccggtcctctactcgctgctcaacctcgccaacgtcatcaccgtgcctctactactctacgtccatgaacatcatccggcacacacaatttcgacagcaaggctgacaaagaaactgctgctactaccgcgtctgacgatgagcataactgtatcaacaccatatccttcgacacatactgaccactcgacatgatcgccaacaagcccaacgaacaagtcttgaacgcacaagctacgccggcgactaacactgacacatattaccacaaaccaaacggtcaataacaatctgaaactgacacaggcaacgctgctgactatgaacaagccgacagataccatgcagctctaattcctgaccacacaccctatgaatttcccataaatatgtggaagctct

SEQ ID NO: 44639 - DNA, 295 bp, Zea mays
  Clone ID: LIB3066-055-Q1-K1-F9
cgactgcttcatacacatatatagcagtcgacgaaactatacatcgtcggtcatcaaattgggaggtatacccatgcatgcatgcatcaaatcgtcatcgcatcccatgcatgcatgtatgatgtatcagtgattcaggatcaccggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtc

SEQ ID NO: 44640 - DNA, 459 bp, Zea mays
  Clone ID: LIB3066-055-Q1-K1-E6
gtagcgagcttcttggagccttgaaatgagtagtagtggtagcctagccaccacgagtaggaagtaggcactataggcactaggaagtagctaaagcagtcataaccatgggttcgctgccgccggtggacgggcagagacgccccccacacgttgtgatgatcccgtacccggcgcagggccacatcacgccgatgctgcagtttgccaagctcctccatactcgcggcttccacgtcaccttcgtcaacaacgagttcaatcatcgacgccacctgcgtgcgcgagggcccaacgcgctcgacggcacggatgggtttcgcttcgccgccatcgacgacggtctcccgctctttgaagcggacgccacccaggacatccccgcgctctgccactccaccttgaccacctgcctgccccggtttaaggatctcatcgccaggattaacgccgaggctg

SEQ ID NO: 44641 - DNA, 446 bp, Zea mays
  Clone ID: LIB3066-055-Q1-K1-E7
acgtgatcatgttctacgcgccggtgctgttcctgaccatcggcttcggcgacgacgcgtggctgatggcggccgtcatcacggggctggtcaacatgttcgccaccgtggtgtccatcgtgtgcgtggaccgcctgggccggcgcgcgctgttcctgcagggcggcacgcagatgttcgtctcccagatcgtggtgggcacgctgatcgcgctccagttcggcaccgccggcgtgggcgagatgtcccgctccaacgcctggctgctggtgctcttcatctgcctctacgtcgccgggttcgcctggtcgtgggggccgctgggctggctcgtcccctcggaggtgttcgcgctggaggtccggtcggcggggcagagcatcgccgtgtgcgtcaacatgctgctcaccttcatcatcggccaggccttcctcagcatgctgtgc

SEQ ID NO: 44642 - DNA, 445 bp, Zea mays
  Clone ID: LIB3066-055-Q1-K1-E8
ctctggtgtgcgaagatactatgatatgagcataaatcatcaccatcagtctgtgcataggccacccccgaatttaggtgttgattctggttatgtcttcgcatcaaatatgtacaatccctgcatgtcatcaacatcaatgaacagacatgtttctcatgctcagagctctggatcacggaatcaagagttgcctcaaaaccaagtcccaggaactatggatgagagtagcagaaatgacagtattggtgaaagtgctcgagagcatattacaaggaaaaatgctgcacttgctggaagctatcattttgttaatggatttgcaagctcaagctcatcttctcatgcacctcacaatcctatgcttgggccttgtgacccttcttttgaatcaactgcatcttctaatgttgcaccattcaacccatcagaatatcatggacac

SEQ ID NO: 44643 - DNA, 377 bp, Zea mays
  Clone ID: LIB3066-055-Q1-K1-E9
ctccgatccatcaacaatcgccgagagcgatcgagagataaataaagatgaagaaagtggcgtcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcaaatgaaggtgtgccaagaggcgtgcgacaaggactacgtggtc

SEQ ID NO: 44644 - DNA, 444 bp, Zea mays
  unsure at all n locations
  Clone ID: LIB3066-055-Q1-K1-F1
acgnccacgcgtccgtccaggcgtccgcccacgcgtncggcaaacaccagttttctaccctaagcgcaaggacccagatgcataataaaaggtgaaagctagcagaagaggtacctaactctaccctactatagagaaaaagtcagcacattgcaagcaataataatggagacgacgacgaagctccggtggagccggcccggctccttcctcctcgtcgccgcggcgttcctggcgtccgacgtcgcgtcaggcgtcaacgtcggccagttcgacgaccacttgcagaagcggaaggagctcgccgaggcgtcagcgagggaggcgtacaggcccgacccgtacaacgtcaccaacagcttcaacgccgacgtccacagagctgtcagcagcaatcggcgtgagatgcgggagaggccgaagaagcacaagaagaagggcccg

SEQ ID NO: 44645 - DNA, 410 bp, Zea mays
  Clone ID: LIB3066-055-Q1-K1-F10
agcgagcgctacgacgccactggccatggacgagggctattccaacctgcccaccagccaggtactcggctccgtgcccgctgtgacacaagatgacaggagattgggccccgccgccgtccaagatgcagctgccacctctaggttgcaggagttcccgcctggaggtggtaatggcggagggtatcggccaccaggtggccctgcagatggagatgccgatatccacgcagactggaaaggatacttcaatgctgcatcttatgctccatacttcaatgttgatactgatgttgtagttgacaggctcattagctcagtgtatccaatggatggctattacaggataattgatgctaatgctgacatgtatggtcctgtgtggatcaccactactctgatcttcatgc

SEQ ID NO: 44646 - DNA, 447 bp, Zea mays
  unsure at all n locations
  Clone ID: LIB3066-055-Q1-K1-F11
aaagaattccctcccctagccgccgccgccgctcgtctccctgagaggtgccgggaccgaggatttgggcgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggcttcagcattgatgacgttcgacctgccggaagcctgaagaaattccagtcttgtgcttactccaactgcgcgaagaaaccatcctgatatcccttttggcttcctcattctagtagtttaggatntcttttctgacactttgattctg

SEQ ID NO: 44647 - DNA, 321 bp, Zea mays
  Clone ID: LIB3066-055-Q1-K1-F12
atacagctccatacacttacataccacgcctctaatctatacaacatgtgtcatcacctaggttctgggtccacatgcatgcatacattcaatattactcgcatcagatgcatgcatgcttcatatatcaatgattaaggttaaacattcatcaaaccatcactctatcaattgtacccaactactaattacatcttctcacacataactttccttataccaatatcttctactactacaaactaatcctccctacaaccatagatattaacaatgtattatgtactaatctcgtcttagctacaatcattcacgacctta

SEQ ID NO: 44648 - DNA, 394 bp, Zea mays
  unsure at all n locations
  Clone ID: LIB3066-055-Q1-K1-F2
catgcagcccggctgcagccccctgtcggcggccatccaggaggatgaccaccagccttggggtgggggaagcaagtcgggctgcggcctctctcccaccctcagcttcaaggatgttcatcatcctcgctggggcggaaggtgcgtcgagccggggttctgcctcccgcgtgggccagcggcccgcttcttcctccagcattcgcgggaggagaggggttcaccagccatgcaaaggaggcgaacttcagctacgcggggccggccaggtgcaggcgctgacagctgccgcgtgcctggctcttggcctaggtggccttgccgacgnctccgacactgcctactgccgctaggtctgngcgtggttgtctgtccaccatacgagcgacagtcg

SEQ ID NO: 44649 - DNA, 451 bp, Zea mays
  unsure at all n locations
  Clone ID: LIB3066-055-Q1-K1-F3
cccacgcgtccggtgcgatggaaggcagagggtgacggccaggaggaagcggtcaataagagacaggggaaaatttgcccaaaaaaggactagaataacagctccgatccgaccatgtcgtcgtcggcgttcggcgacttcggtccgctcaccgagcgccgccgcgccgaaaaggcgcggcagcagcgcaggcgcatcatgatcgccgccgggactatctccatcatcatcatactcatcgccatgggcagcgccgcggtcatgtacagcgggaagaagtcgtccagcgacggtggccacaagtctgcttccaaaggcaagtcgagcggcgggtcagactcggactcgggagcggaagcggaagcggaatcggaagcggaatcggaatcggggtcggaatcgaagacgaatctgaaggccgtgtncaagagcantcaagcgatgtgctcgc

SEQ ID NO: 44650 - DNA, 397 bp, Zea mays
  unsure at all n locations
  Clone ID: LIB3066-055-Q1-K1-F4
ctggagccggtcatggcgccgtcgtcgtccctgccgcggagcgccagcgagctacccgacgcgncgtcaccgttcagctccaacacggcgcaccaccccgtctccgtgcccaccacacctaggttgtccttatcgtgctcgtcgttcggccacatggtgaccccgcccaccgacacaccgtcgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcgcgcccgcgtcaggacggtcaaggacctcgccgaggaacgggcctcagtgctcgccgccagcagcaaggtctctgatg

SEQ ID NO: 44651 - DNA, 449 bp, Zea mays
  unsure at all n locations
  Clone ID: LIB3066-055-Q1-K1-F5
cggccctcctgtccccggaggtcaccgccgccgtcttcgtgggcggccataccggccacgaggaatagcatcaagtcggctatcttctccggccatcggtcgcacccccacgtgggggcggcggcggtcccgcagcagcagcagctggggagcaccgcttcgttccactcgacacccattctgcagcggaagcacaagacccagtggcacaacagattcaactattatacgagacgtaggaggaaccgagaaactaaaaggtcaatgctacggaacatgtcagaatatgcagagtctctctttcagagttggcgtgatgaagatgagaaaaatgctgcatctgctgggccttcatggtttagaggacatcgttgggtcagaaattcaagcaacaatggtttccgtacacacgatttttattaccggaatttcanaagcaaaggaggatt

SEQ ID NO: 44652 - DNA, 399 bp, Zea mays
  unsure at all n locations
  Clone ID: LIB3066-055-Q1-K1-F6
ctcactggaaggccgccgacctacgacccgcccaaggcggcggcgccctcaggcgagctgtggtcgtcccagcagaagccggggccggcggcgggcaacaccgacctggtgaccgtcgtggggtcgacgccggagggcgagtggctgaacaccgtggtggaccgggacctgcggggcgaggaggaggaggacacggaggagatggtgaagctgatcagggtcggcatggcgtgctgcgagagcaacgtggacaaccggtgggagctcaagaccgccatcgagaggatcgaggagctcaaggcgaaggagcgcnccgacgaggagcaagcgacggtgatcgacgatgactacagcgatgttgccttcaactgatcatcgacacgaaccggccgggaatcg

SEQ ID NO: 44653 - DNA, 443 bp, Zea mays
  Clone ID: LIB3066-055-Q1-K1-F7
cggacgcgtgggcggacgcgtgggcggacgcgtgggtgaccttcgtggacactccaggaggtgtatcaggggagaagcagcggacgcagcgcagctacgatttcaccggagtcacgtcgtggtttgcggccaagtgcgacctcatccttctcctgtttgatccgcataagctggacatcagcgatgagttcaagcgtgtgatcgggtctctccgcgggcatgatgacaagatacgcatagttctcaacaaggccgaccaagttgatgcacagcagctgatgagagtgtacggagcactgctgtggtcgctcgggaaagtcctgaacacaccagaagtcatgcgtgtctacataggttcattcaacgacaagccgatcagggagacagcggctgggccgctgggcatggagctgttccagaaggaacaagatgacttgctctcg

SEQ ID NO: 44654 - DNA, 463 bp, Zea mays
  Clone ID: LIB3066-055-Q1-K1-F8
accaaaccagcggcaccacccatggcttcggcggcggcgagatccggtctacgggcgctggcggagcgcgccgccccgttgaggcgccgcatgtcctcctccgtccacgacgacgcctatgagacggccaagtgggagaagatcacctacgccgggatcgtgacctgcaccctgctggcggcgtacaacctgtccaagggccacccccacttcgatgagccgacggcgtacccctatcttcacatccgcaacaaggagttcccatggggccctgatggcttgtttgagacgaaggaccaccactgagccctgattagcacaccttcaagagctggtgcacgcttaaaagagttatatggatgtttcagtgattctacttttccctcgagacctatttgctgcaacatgaaataagaatgaccagactctggtatcgacagtgaggttctaactgtgttagctg

SEQ ID NO: 44655 - DNA, 415 bp, Zea mays
  Clone ID: LIB3066-055-Q1-K1-E5
cccacgcgtccgcggacgcgtgggctgacgcgtgggcctgaacaaccggcaggtgtgcgcgctcactctgctcaactccaagttcttccacatgaacatgtaccggtgcaaggacatgctgatcaaggacatgaccgtgacggcgcccggcgacagccccaacacggatggcatccacatgggcgactcatccggtatcacgatcaccaacaccgtcattggcgtctgtgacgactgcatctccatcggccctgggacctacaaggtgaacatcaccggcgtgacctgcagtcctggccacggcatcagcatcggcagcctacggcggtacaaggacgagaaggacgtcacggacatcaacgtcaacgattgcactcttaagaagacgatgttcggcgtccgcatcaaggcgtac

SEQ ID NO: 44656 - DNA, 408 bp, Zea mays
  Clone ID: LIB3066-051-Q1-K1-H1
cggacgcgtgggccgtgcgtgccccgggggccttgatcgcgcgcaccggtcagctgagcgcgtctgattcgcgtgctgccagccctccgccgatcgtgaaacacaaccgtcggtggtttgcttgcttgatcgctgatcctcgcggacgctcacggtcatggcgcctcagcctgtgcgcgctccgaggctgagcgcccccgctggccacgcggcgtgcaggtgctcggccgcgccgctattcgggaagcgggcgccccccgtcgtcgcgttcccccgcgcccgtagcggcggcgccgtcgcctcgtgctcggccgtgcaggagtcgtccaccttcaccactgttagcaagaagaaggatgccgcggacggtgccaaggaggccacagcggatgcggcgaagccggccgc

SEQ ID NO: 44657 - DNA, 425 bp, Zea mays
  Clone ID: LIB3066-051-Q1-K1-H10
cagtacaccacacactcgcctttccgatcccatccctctccagccaccttcctccgctggccgtgcttctgcttcctccgccaccaccgccggcatggctgcgcgctgcccctacttcgccgtcgaggagtcctcccgcggcatccgctcgggggagtccccggccgcggcgctccgccggatcctcgcgacgcctggtgcgcaccaggcgccctgctgctacgacgcgctcggcgcgcgcctcgtcgagcgcgcggggtttccgatcgggttcatgggcggtttctgtgtttctgccgcgcgacttggcttgcctgatgttggcctcatttcctatggagaaatggtagatcaagggcgtctcatcaatgaagctggttcaatcccagtgattggtgatggagacaatggttacggaaattcta

SEQ ID NO: 44658 - DNA, 417 bp, Zea mays
  Clone ID: LIB3066-051-Q1-K1-H11
caatgccaagcctaagccactagccgcctaccttttcaccaagaataggaagctgcaagaggagtttgtggcgagcgtccctgcaggagggatgcttgtaaacgacactgcgctacatctcaccaacccgtacatgcccttcggcggcgtcggcgacagcgggatgggctgttaccacggcaagttcggcttcgactgcttcagccacaagaagggagtcctgatccgcggctttggcggcgaggcgaacgccaggtacccgccctacacgacggagaagcaaaagatcctgaggggcctcatcaacggcagcttcatcgccctcatccttgccctcctgggcttccccagggagaagcgttagatgctccggcctctttttggtttcggtacagcctttgtagtccctgttcgtcg

SEQ ID NO: 44659 - DNA, 422 bp, Zea mays
  Clone ID: LIB3066-051-Q1-K1-H12
cccactgctataggcagcccacatgcgcgcgcactcccaagtcccaagtcctaagctagccagctgagctcgctcccagtccaagcgccggcgccaccaccgcagctgctcgctggtcaccatgagcaaggagaagcaccaccgcgactggatcctccggcgctgctgtggctccctcgccgcctgcatcctgacgctggccgccgtcgtcggcttcatcgtgctcgtcatcttcctggcgctgcgcccctccaagccgtccttctacctgcaggacgtgcagctgcgctccatcgacctcagcgacccggcgctctccctcgacctccaggtgacgatcgtgtcgcggaacccgaacgagcgggtgggcgtgtactacaagacgctggacgcgttcaccacgtaccgcgacgaggcggtga

SEQ ID NO: 44660 - DNA, 367 bp, Zea mays
  Clone ID: LIB3066-051-Q1-K1-H2
cgcacgcgtccgaccacgcgtccgcaaataatctaccactgcgtgagctcatgcgtgcgcgcctgcaatggagtcctccgaccatgcgctcatcggcctaatagacgccgcagactccctcgccgtcgagctctcagatggcggcgggatggcagtgcctgagtactgatacgctgaagagagccacaacgagccgtagaactgggagaagctgaaccccgactacaagctgtgcactgaagggaagcaacagtccatgatcgacatcgttaccaaacaagccgttcacgccgtcagcctccacaccctcaatcgtacctacagcgccaccatacgacacgctcatcaacgatggccacgacatcac

SEQ ID NO: 44661 - DNA, 355 bp, Zea mays
  Clone ID: LIB3066-051-Q1-K1-H3
cgaacgcgtgcgatctgaatccatgtgatcaacgagacaggacttatatctcgagcgggactattaccaggacgtgggaggagatcctgagggttaactgatagaggctttaagcatgctggttgaaaagcaccacaattgtggtttgaataaactgcttgaaacgcatcgagatgaacatatgcacgaatctggatgcatggaagatgaaggcgatgcaaacgagcagcctgacacgctatcattagaacaggctattctaatgataactagcataacacgagggaatgttttgagcaacccaaatgtgctttctgacgatatagatcgctgcatgagacacattttcgtacac

SEQ ID NO: 44662 - DNA, 439 bp, Zea mays
  Clone ID: LIB3066-051-Q1-K1-H4
acccacgcgtccggacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacat

SEQ ID NO: 44663 - DNA, 406 bp, Zea mays
  unsure at all n locations
  Clone ID: LIB3066-051-Q1-K1-H5
gggaacatcgtccatccgagctaagtaattaggtcgaaaatgacccgtgccagcaggagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgnctcagcagtgcgcgaccccggtgagcgttgaggaggcgtgccgcggcgcgttcgagacgcacgccggcgtgggctacgaccactgcatggcgtcgttggccgccgacccgcgcagcaaggaggccggcaacaggaccatgcacggcctggcggtgctggccaccagaatggccatcgaccacgccgccagcaccgagt

SEQ ID NO: 44664 - DNA, 421 bp, Zea mays
  unsure at all n locations
  Clone ID: LIB3066-051-Q1-K1-H6
ctcatcgttctcccaaatctgagagcgttcccaggacctagggttcttgagatccagccccaggatggatccgaaccctagagctcccctcctcctcgccatcgtcgttctcgcgcttggcgtatccgtggtggccagcgccgaggacgacgcgtcgggggtctctctgggccgccgcgccggggggttcttgcacggcctgaagaaggatgcactggcggagggcgatcatggggtggcactagacgaggttggaccggggctgttcgacgcactctttgccagcctctccatgatactagtcagtgagattggagatgagaccttcatcattgctgcgctgatggcgatgcggcaccccaagtcaattgtgttgtctggtgcactatctgcgctntatgtgatgacagtattgtcaact

SEQ ID NO: 44665 - DNA, 335 bp, Zea mays
  Clone ID: LIB3066-051-Q1-K1-H8
gcataagctctctataaatactgatgagctatctgctgtttcatgagcgtctgacatagccatatgtttactggactggccatgatattacctgggctaggctttgaccgtcccattcttgttggaccgcctggatgggcaagaatgggcacccaggtttgcagctctgatgcttaccgatcgctggacttcgtgcttgacatggcaggccgtgacgaagcaaatctgtggtcaggggacgactctagctaagtggacgaatacccctcgcatgatcagcaggcccagttcctcgtgtacgagagctcatgtttactacataggcccgtcgacag

SEQ ID NO: 44666 - DNA, 418 bp, Zea mays
  Clone ID: LIB3066-051-Q1-K1-H9
aaaaaaaaaaaataaaaaaaaaaaaaaattaaaataaaaaaaaaaaaaaaaaaaaaggaggaaaaatttataaaaaaaaatacattcatataatcatacttttcacctacttctttactacttcttaccaactctttccttttctttggcgtcatctaaatccatttttttgtctgttacttttcaacttctcccattttactacccctgcctttatcccactttactgattttctgcttttgcctttttgccaacctctcgtactctttattcactcctgacaagcctaccttcctaacagtcctcctcctttaatgcttaatttgcctcatccttttccttctcttttatccctgcatttattttatttactcccacctttactttttctcttttcatttcctttactcccttttt

SEQ ID NO: 44667 - DNA, 419 bp, Zea mays
  Clone ID: LIB3066-052-Q1-K1-A1
gtctctcgttgcccacatagatatgtttccatggttcttagattcttctctatgtttgcagataagatcaatgcataaatgggagaaggtcagtttggatggccatgtcttctgaaataattgattaaactcgcgtttggcatgctgtgcaacacatgcagcaggttatgtttgtaacgaatgtgtctggaatacattaggtacctttggtcaggtgttggagtgttgggacaaggaaaggaaagaaatggtggctatcaaaatcattaggggcattaaaaagtacagggatgctgcaatgatcgaaattggcatgctcgagcagcttggtaaatatgatgaaagtagatctaggtgagtttgctgggtcggttaacacccttctgtatgctttacattcataagattgcttgcatata

SEQ ID NO: 44668 - DNA, 439 bp, Zea mays
  Clone ID: LIB3066-052-Q1-K1-A10
gatggttctaatgttctgactaatgaacagctggatgcttatgtagtgaaccctgtgacttggtcaagaccaactattcagcattctcgatgtttcaccaagttgtgcatatattggtacaaatacaaaggtttcagttactggtacattcttggtgaataaagaacatgtggaaagtcacaggtggtcatgtatgtttggggatgttgaagtaccagctgaggttttgaccgatggcaccctacgctgctatgcaccagctcaccaatcaggaagagttccattttatgtaacctgttcaaacagggtggcttgtagtgaagtgcgagaatttgagtatcgcgattctgaagctcattacatggagacttctcgttcccaagccaatggtgtaaatgaaatgcatctacacattcagcttgagaagctactcactttg

SEQ ID NO: 44669 - DNA, 405 bp, Zea mays
  Clone ID: LIB3066-052-Q1-K1-A11
cccactcgttcgcccacgcgtccgcccactcgttcgcccactcgttcgcccacgcgtccggccacgcgtccgggaggaggtggtggtggtggatatggggggtcgtcaggatacggtggtgcttatggtggcggcggcagcagcggctatggtggtggtcagagtacgagttcttgggactgaactgaattctggttagaagtgaaaaatgggtcaacctgttgggtgtgaaaaatgggtcaaccgttatcgattagtccctgttggatggagcgaatgcctgaaatttgttgcttgacttgcgagtacggtgtcaggaggtttcccagtgccttaatcttgcattttgtgttgtactagggattgcttatgttattatctgaattggtggtttcttttctacgc

SEQ ID NO: 44670 - DNA, 395 bp, Zea mays
  Clone ID: LIB3066-052-Q1-K1-A12
tcggactcgcgtacatcgagagatgcgtccctttgttaccttagttgaaaattcagtggcgctggggtatgtcgtgattctatcgttagttttctgctaaatcaacttaatgattgatcttaattatgtatggttgaggtgagagatcgaccatattagttctctgtacgtagtgaccgatctcgtatgaggacactatatgccagttttactgtgattattgatatgatcctcatgtaatcgatcgacatttagctcgatctgggaaggcgagaattatggaggacgtgcaatcgatcacagttcgcgtccactgatagcgtgctagattccggcatttcacagtgatactcatacatcttgcgatcgatctccagataatgcaccttgatctc

SEQ ID NO: 44671 - DNA, 218 bp, Zea mays
  Clone ID: LIB3066-052-Q1-K1-A2
tcccactcgttcgtgttgatgctgtaaaaaaataaatattaaaaaaataaaaataaaaaaacaggtaaaatcaataaaataaataacaaaaagaaaaatttaaatattcatatattataaactaatacattaaactctctattttacatactgtactacacatacatgtacttatatttttaactaatctccctgtactacattacttacctcttgtc

SEQ ID NO: 44672 - DNA, 421 bp, Zea mays
  unsure at all n locations
  Clone ID: LIB3066-051-Q1-K1-G9
acccacgcgtccgctttcttcgaacgcaaaaagaaccccacccgacgtaccgcgagccggcgatggcgacggtggcgatggacatctcgaagcccacgccggcagcgtccggtgacgaagtagcggcggcggcgaaggggaggagcggcggcgggggcgaggggctgcggcagtactacctgcagcacatccatgacctgcagctccagatccggcagaagacccataacctcaaccgcctcgaggcccagcgcaacgacctcaactcccgagttagaatgctcagggaagagttgcagttgcttcaagagcctggctcatatgttggtgaggtggtgaaggtcatggngaaatcaaaggttctggtgaaggtacatcccgaaggcaaacatgtggtggatatagataagagcattgatat

SEQ ID NO: 44673 - DNA, 420 bp, Zea mays
  Clone ID: LIB3066-051-Q1-K1-F4
cccacgcgtccgcccacgcgtccgcccacgcgtccgaagaaacctcatggaacctggtgataataatacttccaatgctgctgctgctgctgctgcttccagtagtgcaactgcttctcggacaatcacagtggacgattctttgccatcaacctccctccaaatcaggttcgcagacggcagtcgcttggttgcccgtttcaacacaagccacaggattagtgacgtgcgggcatttatcgacgcgacaaggccaggagccagtgattacacgctgcaggccgggttccccccaaagccgcttgaagacacggccaagaccatcgaggaagccggcgtggccaactcggtaatcattcagtcagtctagcttggcagaacaggtgccgcaaccctattccatcgaacacgctaggcatc

SEQ ID NO: 44674 - DNA, 401 bp, Zea mays
  Clone ID: LIB3066-051-Q1-K1-F5
aacagaacgccggctcgttcctcgccgtgcgtcgcctctccggtggcgccagccagcaccatcgtcaccactcttccccggctgaggtcgtgggcgtgtccactgcgtggctcgttaaggggctttcatgcgtctgcgcgcagaggagggagagcgacgtgcgcctgtccttcgatttgagtcccattcaggaagagtgcttgaataggttgcagaaccggatagaggtgcagtatgatggttcaaatctggagcatcagaaagcactggaagccctttggcgttcttcttttcctggaactgaacttctagggctagtatcagaccagtggaaagagaatggatggcaacgtaaagatccatctacagatttcaggggcggcggctttatatctttggag

SEQ ID NO: 44675 - DNA, 420 bp, Zea mays
  Clone ID: LIB3066-051-Q1-K1-F6
cgccacgcgtccgcccacgcgttcgcttacgcgtgggcggacgcgtgggatgcgaagaccagttttctaccctaaacacaagaacccagatgcataataaaaggtgaaagctagcagaagaggtacctaactctaccctactatagagaaaaagtcagcacattgcaagcaataataatggagacgacgacgaagctccggtggagccggcccggctccttcctcctcgtcgccgcggcgttcctggcgtccgccgccgcatcgggcgtcaacgtcagccagttcgacgaccacttgcagaagcggacagagctcgccgaggcgtcggcgagggaggcgtacaggcccgacccgtacaacgtcaccaacagcttcaacgccggcgtccacagagctgtcaacagcagtcggcgtgagatg

SEQ ID NO: 44676 - DNA, 388 bp, Zea mays
  Clone ID: LIB3066-051-Q1-K1-F7
attgcatgcggagtcttcaaggggatttcagctggcactcatgcattcaagtaaaggctccaattcgagataccggtgcgtttcaataagcaggttcaacagtatctttcgttaaaaaaaacagctctgcttttcgggcggctgctatgtcgcactgcacagtgtggcgtagcgcagcgatggcaagctaatgcctaagaaaaaaacatacgtgcatatagaaaccactgatattagtgtagacgctgacaacctacggagaaatttgtaatggcagttcagggatgtaaatctttttacgaggcaacaggtcacagttcttattgtctggtagtgatagcagtgtgcgcatttcaatatattctctgatggaattgtcttggggttg

SEQ ID NO: 44677 - DNA, 60 bp, Zea mays
  Clone ID: LIB3066-051-Q1-K1-F8
aaaaaaaaaaaaaaaaaaaaaaaaaataaaaaaaaaaaaaaaaaaaaaaaaaggagaagg

SEQ ID NO: 44678 - DNA, 386 bp, Zea mays
  unsure at all n locations
  Clone ID: LIB3066-051-Q1-K1-F9
cccacgcgtccgcccacgcgtccggatcgccaataatggagtttccgcaccaccggcagcaccacggccatcgccgcgacgacgacgaagacgaccgcagaggcccgccttccccggtctacggcggctacggccagncaccgccacccgacccgtccggccgcccgcccgtcaaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgggcacaaggtcggcaacaagaggccttactacggcggcggcggcggcggtcttggtggcgcctacggagcgcgg

SEQ ID NO: 44679 - DNA, 417 bp, Zea mays
  Clone ID: LIB3066-051-Q1-K1-G1
aggtctgactggaacagcacgttatgctagtgtgaatactcatcttggaatagaacggaggaggagagatgatctggagtctgttggctatcttctgctatattttttaagaggaagcctcccatggcagggccttaaagctggcactaagaaacaaaagtatgataaaattagtgaaaagaaaatgcttacctcggcagagattctgtgcaaatcttacccgccggagttcgtctcatatttccactattgtcgctccctgcgatttgaagacaggccagattactcttcaatgaagaagctctttcgtgatgtatttatacgggaaggataccaatttgattacgtatttgactggactgcactcaagtaccctcaaatgggctccaacaacaagcttgttcaacaaccaagtgc

SEQ ID NO: 44680 - DNA, 422 bp, Zea mays
  Clone ID: LIB3066-051-Q1-K1-G10
cggacgcgtgggcggacgcgtgggcgattccatttctaccccgagacctccagcgcggcgcccctgaaccctcagccttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcggcg

SEQ ID NO: 44681 - DNA, 418 bp, Zea mays
  Clone ID: LIB3066-051-Q1-K1-G11
ggcgtacttgcgtttgccgtctcttccctgctgccgtctctgtccggagggcaagccatggcggcgggcggggacggcgtcgctcgccaggcggagctccgccggatcgagggcaacatctgcttcaagaaggcgcgcctcggcgccgccatcgactgctacaccgaggcaattgcgctctgccccgacgtcgccgtctactggatcaatcgggccctatgccatttcaagcgcaaggagtgggccaaggtcgaagaggacagcaggagggctcttgcgcttgattacactttagtcaaggggcactatctgctggggtgtgcgctactcgagaaggaagaatctgctcttgctatcaaggaattcgaaaaggctctaactctcttaaagtctgtggattcaacgtatgaaatggctg

SEQ ID NO: 44682 - DNA, 410 bp, Zea mays
  unsure at all n locations
  Clone ID: LIB3066-051-Q1-K1-G12
gccaccaggcggtcgccatacgattcaccgcgcacgtaacatgagaacagcgaaaacgaagatgcttccccgggcggcagcggacgaggagacgagagagggagagatggggccggacctcctgggacttggcttgctgccgccgccgatggccggcggcggccacggaggtggttcagcggcgcatcagaagacgggattcgacgagcccctacgtttcgccgctgacgcccctttgccggtgcgcgcttgcgtgcgcccgcggccccggcccgtggacgtggacgacggcgtcgtccctgcagcacctccggcgagcatngccgaagccgccgcgtcgtcgacggcacggtgggcgccagctgagctggcgtcgtccccgacgaagctcggttctttcagggagatct

SEQ ID NO: 44683 - DNA, 423 bp, Zea mays
  unsure at all n locations
  Clone ID: LIB3066-051-Q1-K1-G2
cacgacgcgtaccaggtcgtgtaccggatcaacgtcggtgggcccgccatcggccgcgcggaggacacgctgggccggcgctgggagagcgacgcggcgtacgtgcagtccaaggaggcggtgaaggacgtgtcggtgcccaccagcaccatcaagttccccgacggcacgtcacggctggtggcgccggcgctggtgtacgccagcgccgcgaagatggcggacgccgacgtggcgagccccaacttcaacctgacgtggaaggtggacgtggacgcgtncttcagctacctggtccgcctcttcttcgccgacatcgtgagcaaggccaccaacgacctctacttcgacgtgtacctcagcgggcgcaaggccgtgtccgggctggacctgtcgacggtggccggcggcgagctggcggcg

SEQ ID NO: 44684 - DNA, 189 bp, Zea mays
  Clone ID: LIB3066-051-Q1-K1-G3
cggacgcgtgggaaaaaaaaaaaaaataaaaaaaaaaaaaaaaaaaaaaaaaaaagagaaagcaaaaaaaaaaaaaaaggacatacaaatctaaaggaatccaaaacttgggtacccgttcttgcgattccatacttattttatcgtgcttcctacatcaaatttattgtctggggtttcccaacttca

SEQ ID NO: 44685 - DNA, 422 bp, Zea mays
  unsure at all n locations
  Clone ID: LIB3066-051-Q1-K1-G4
gggcacggagatggagagagcggcccccgtgaggagctcccacacctcgacggctggcctgctcgcgtggcctcaccccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggccgagagcgccgtcgtcgncgtcgcaactgcctcccgtgatcgtcaggctagccagatcaccttttcccaggacgggaccgttcctaccaggaaggcaacttcagtggctggggtggcaaggcagcgtgagcttagccataccgtcgagagtgagggggacagtaagatga

SEQ ID NO: 44686 - DNA, 379 bp, Zea mays
  Clone ID: LIB3066-051-Q1-K1-G5
cggacgcgtgggctagatcgcgcgccgccctttttttttttttttttttttggttgttttttttttttttttttttttttttttttttttttttttttttttttttttttttttttttttttttttttttttttttttttaaaaaaaaaaaattaaaaaaatattaaattttaatttaaaaaaaaaaaatttttaaatttaaaaatttttaaaaaaaaaaaatttaaaaattaaataaaaaaaacttttttttaaaatgaaataaaaacgggaaaaaaaacacccagggaaaaaatccccaaaaaaaaaaagtataaggaaaaaaaattttttaaaaaaacttttaaaaaacctctaaaaaaaatttttttatatgggg

SEQ ID NO: 44687 - DNA, 377 bp, Zea mays
  Clone ID: LIB3066-051-Q1-K1-G6
gccgacgtggccgccgagctccggagcagggccggggtgcccgtcttcgtgatggtgccgctcgacaccgtgcgcaaggacggcaactcgctcaaccggcgcaaggccgtggaggccagcctggcggcgctcaagagcgccggggtggagggcatcatggtggacgtctggtggggcatcgccgaggccgacgggcccgggcagtacaacttcaacgggtacatggagctcatggagatggccaagaagaccgggctcaaggtccaggccgtcatgtccttccaccagtgcggcggcaacgtcggtgattcagtcaccataccacttccgggatgggtcttggaggagatggacaaggaccaggacctggcctacac

SEQ ID NO: 44688 - DNA, 414 bp, Zea mays
  Clone ID: LIB3066-051-Q1-K1-G7
cccacgcgtccgccgccctttttttttttttttttttttttttttttttttggtttgaagtagtagagatatatatatatattctgcaagaaacaagatgcttagctggaacgcaatagaatatggaaaagtgaaacggaagaagaatgcatgcaaatgcaaggtcatcgatcagacgaggcaatccagggcctggaggctccccaggaggttgatggttaacttgccagatgcacccaacagaaagaagattcttagcgtgatactagcaaaagaagatttggcagatgatgtagatctggaggcgctagcaaacctgacagatgggtattcaggcagtgatctgaagaacctgtgtataactgcagcacatcgtcccataagggaaattcttgaaagagagaagaaggagag

SEQ ID NO: 44689 - DNA, 418 bp, Zea mays
  Clone ID: LIB3066-051-Q1-K1-F3
cccacgcgtccgcccacgcgtccggtgaaacacccactactatatcaggctttcaggggcatgactgtgaattggtgatgtcagattaatatacaggttagttgcttgtttctaggtaaccagaggtgtggtttacaacaccaaaatgctagaggagccgatacaaacattttagtttaatttctacatctattaggccttttgttttttgaatgagatgtgcagtgttgattgcggcacatacttagaagtgttccaacataagctggaattctgtcatacggaaggataaacttgtataccaagggaatgctgtattattatctttgcccatttatggctacattagcttgcttgtttctattctctttaaccatttcatctgtatactagacagttgcttgacttactattcaaa

SEQ ID NO: 44690 - DNA, 227 bp, Zea mays
  Clone ID: LIB3066-051-Q1-K1-D9
tttactacttttatatttttcttaccaatattaattttttttttttctattacgggggggcagctgggattaatcccacctcaattgcatgcttcaaccatctccgaaacaaccaccgcatgaatctgtctttcccacaacacttcctgtccacacagatctccaagagcagcttggagaccgacaatttcgctagcaatcccatactatacaagcccgtccgaaca

SEQ ID NO: 44691 - DNA, 428 bp, Zea mays
  Clone ID: LIB3066-051-Q1-K1-E1
cgcgcatggggctcgccggggacgggtcggcggacaccgcccacctcagtaataatgaaaatgggcggttcgtttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttcatcactgataccaaggctgctatcgccgaaacttacaacctcacagattcagaatttctgaaagctgatagctgtcaaactcgagatgctggctcaactgcctcaacagctattattgtaggtgaccgtttgcttgttgcaaatgttggagattctagagccgttatttct

SEQ ID NO: 44692 - DNA, 421 bp, Zea mays
  Clone ID: LIB3066-051-Q1-K1-E10
cccacgcgtccgcccacgcgtccgcccacgcgtccgcgctcctgcgccgcccgtgcgatccggtcaccggccggggagggctcagaaacctttcatccaatacatacatctatctgagccctttcccgcggtgaggcccgaccggagtccacacacacacacacacggtgtcgatggcggccgtaataaggagccgccgcgtgtccgttgtcttctacgtcgtcctcgccgcagctgcagccgcggcgcaggcatccaataacgtcacctgcgacgaggattactgggcggagcgcgccgaggtggctcggtcgcgcaacctcgccgactacgtcagcgaccccgtggccgccacgaaccgtttcaacgcggacgtgctgagggccacgacgcggcgggcgctggcgaggtacgatggccc

SEQ ID NO: 44693 - DNA, 421 bp, Zea mays
  Clone ID: LIB3066-051-Q1-K1-E11
cggcgcgtgggcggacgcgtgggggaggccgccgcgcccatgctcaccttcgaggcgggcaagacgtaccgcctccgcgtgtgcaacaccgggatcaaggcgtcgctcaacttccgcatccagggccacgacatgaagctcgtggagctggagggctcacatacccctgcaggacgtgtacgactcgctggacgtgcacgtcggccactgcctttccgtgctggtcgacgccgaccaggcgcccggcgactactacatggtggcctccacgcggttcatccacgacgccaagtccgcctccgccgtaatccgttacgccggttccagcggcgccccgccggggcccaacatgaccgagccaccggccggttgggcctggtccatcaaccaggccaggtcgttccgttggaacctgacggcc

SEQ ID NO: 44694 - DNA, 422 bp, Zea mays
  Clone ID: LIB3066-051-Q1-K1-E2
ggagttcagaaccatcagagcatgcctcttctttggcatgggtgcatctggcgtgagacctgttcttcacaagctagtactcttctggcaccaaccggaggcattgcacacgaccggatacgaaattctgatggggctcttctacgggctgggagcattggtatatgcggcacgggtacctgagcgctggatgcctgggaagtttgacatcgccgggcacagccaccagctgttccacgtcttggttgttgccggagcctacacacactaccacgcaaggcttgtgtacctcaagtggagagacctgcaaggctgctgaaaggtactgcatcgttgaggatgtggatagattgtagattccgtgaattcaggctgaaggtcatggtctgttgtaaattgtaacagtaatcatgaaacaattg

SEQ ID NO: 44695 - DNA, 421 bp, Zea mays
  Clone ID: LIB3066-051-Q1-K1-E3
gccggcctctacgacgagatcgtcatggtccccaaggacaaggtcaacatcttcgtgtacggcgacgggcctaagcaaagccgcgtgaccggccgcaagagcttcgccgacggcatcaccaccatgaagaccgccaccttctccgtcgaggcgtccgggttcatctgcaagaacatggggttccacaacacggccggcgcggagcggcaccaggcggtggcgctccgggtgcagggggacctcgcggcgttctacaactgccggttcgacgcgttccaggacacgctgtacgtgcacgcgcggcggcagttcttccgcaactgcgtggtctccggcaccatcgacttcatcttcggcaactcggcggcggtgttccagaactgcctcatcatcacgcggcggcccatggacaaccagcaga

SEQ ID NO: 44696 - DNA, 417 bp, Zea mays
  Clone ID: LIB3066-051-Q1-K1-E4
cccacgcgtccgcccacgcgtccgcccacgcgtccgcccacgcgtccgcccacgcggccgcgcacattccgaagtggaggcattaatgtagatcatatcgctttcgatccaaaggagaccaaccgctttgttgctaccgattgcttggatggcaaagtgatgatttggagcctcgactctcccgaacctgaatatcatctgcctaagacggattttaagggtatcatgttcctggaattcttcacacgttatggtcggcagtgtttgattattgctcatgaagatcataaagcacacgtatgggactttcggttgcgcaaatttgtttctgagaagcgaaaattattatctcgtgaagcttctgtcttcttacgtcctaatgtatcgttactacttacaccttcatctaaaggcact

SEQ ID NO: 44697 - DNA, 413 bp, Zea mays
  Clone ID: LIB3066-051-Q1-K1-E5
cccacgcgtccggcagcatgaagatcaaggtggtcgctcctccagagaggaagtacagtgtctggatcggaggatccatcctggcatccctcagcaccttccagcagatgtggatcgccaaggccgagtacgacgagtccggcccatccatcgtccacaggaaatgcttctaattctttgggcccgagaaatgcaagccgtgggggagccgttaccgccgccagcctctcctgcccccgttttcgttgccgtttcttcattagcgcgaacaaagttttgtgccggtctatcggccgccgctttcctcccctattcatcaagactgcaataactgtcgctacctatgcttctcacctgtgatttttggacacaatatgttaaggtccattcaattctaatgagacgcctgatga

SEQ ID NO: 44698 - DNA, 416 bp, Zea mays
  Clone ID: LIB3066-051-Q1-K1-E7
cacgacaagatggcgtgcacaaacaatgcgatgagagccttgttcctcctggtccgcttctgcatcgtgcatggtgagaaggaagagtcaaagggcatcgatgcgaaagcgtccaggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaaggg

SEQ ID NO: 44699 - DNA, 408 bp, Zea mays
  Clone ID: LIB3066-051-Q1-K1-E8
acgacctccgtgctccggcgatgcagcggatttcgctacgacttctgcgctggtcgtacaccgccgcctccgcctccctctccaccacctcctcctccctccgcggcctggcagtatcccatggcggttggaccacccgaccgtcgctgcagcctccggtgcgaaccgcggcgccggtcgaactcaccaggtggccgccgcggaggggttactcccagttcgcgagcgggttcaccccgctgaagccgaagccgctgggatccatcctcgacatcgaacgcgccaagggcctctcccccgaccacctcgtcgccgcatgggatgactatcatttaggaaggggtcatataggtgcatctatgaaagcaaaactttaccatctcttggaacaaagatcagcttcatgcc

SEQ ID NO: 44700 - DNA, 410 bp, Zea mays
  unsure at all n locations
  Clone ID: LIB3066-051-Q1-K1-E9
gtgctgaaccacatggagcacgaactgtttgctgttgcagctgttatggctgggctagcaatactcggattcttgttctccgtactggggttgcggtttcttgtctccctactggtgatcgctgcttggatccttctcaccaataccatcatcagttctggtcttttcctcctcttgcacaacgtggtggcggacacgtgcgtcgcgatgggcgattgggtggcgcacccgcaggcgcacacggcgctggacgacatcctcccgtgcgtggacgtggccacggcgaacgagtcgctgtaccggagccaggaggtgacgtcgcagctggtggcgctggtgaacaacgtcgtcgtcaacatctctaaccggaacttcccgccggggctccgnccgctctacttcaaccagtc

SEQ ID NO: 44701 - DNA, 418 bp, Zea mays
  unsure at all n locations
  Clone ID: LIB3066-051-Q1-K1-F1
ctcgaagccgaaggcctcgtgccttctcttcctccctggcatggaggaagtagctggttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctnctccagtagcccttccactcgcaagaagcgcggggcgttcagcctcttcagggcgatgttcctgtccttcggccggagcgacgacagcatgaagaagacagacgacgacaccacgagccccaagaagaga

SEQ ID NO: 44702 - DNA, 421 bp, Zea mays
  Clone ID: LIB3066-051-Q1-K1-F10
cggcgcgtgggcggacgcgtgggtgggaggcaggcgacatgggtggcgggaaggacgacggccacgatccctcgaaggcggacaagggattccacggaggagggtacccggccgccgccggtggatactacggcggccagtaccccggcggcggctaccctgctccaccgggcggcggtgcgtaccctcccggccctgggtacccggtaccacctggtgggtacccgcctccgggtggctaccctcagcctggcggatacccgccgtcgcacggggcgtacccggcgccgggtgcaggcgcgtatcctcccagcgggtacccccatcaaccggtctacccacagcctggctatccatcgatgcccggtcatggtggcatgtacggaggaggccacggtgcagggggctctgcaggccacgg

SEQ ID NO: 44703 - DNA, 418 bp, Zea mays
  Clone ID: LIB3066-051-Q1-K1-F11
cggacgcgtgggtgcaagaggaggaattagaatctgcaatatccctttgtagtgcgttggagttccttaatgtgcattcttgtccaaagatcaatgctttggattttggcagactccgtttgggttgccccagtctgaagcgcatccagagcagcctcatctcataatacagaggctgctaccatataaaggagggcaattcatgcaataagccgctgctcagatttgaagaaaaaaacaaggggatgtttggtttctagggactaatttttagtccctacattttattctaatttagtctctaaattgctaaatatggaaactaaaactctattttagttttcgtatttggcaatttaggaactaaaatggaataaaaatatagggactaaaagttagtccctagaatccaaacacc

SEQ ID NO: 44704 - DNA, 417 bp, Zea mays
  unsure at all n locations
  Clone ID: LIB3066-051-Q1-K1-F2
ggcagcaggcccgcagccaagagccaacgttgccacgcaggagaatatcagtgcgcgcaggaactggctctaagcgctctgcgcctccaagaacgcgtggaactccgccctggccctcgccagacgcggcgtgatgcacggcgatgatgggcacgacgacgacgacgacgcatccgccgccgccaccgtcgagaacctcacgtgcctctgcgaagacgtcgacgccctggccgagtcgagccgcgacgatgccgagttcttcagtatccccttcttcgccgcgggtggttcgccgtcgaacacgaacgccatcttgaccggcgcctccgcgtcgtcatccgcgcagctggtcttggccacctncgtcgcgtggcagtcgacggcgtcgtgctgcgcggccacatgcggcggcggaag

SEQ ID NO: 44705 - DNA, 416 bp, Zea mays
  Clone ID: LIB3066-051-Q1-K1-D8
aaagaggttatcagggaaaatgatatattatacttcataatggaatacatggagtgtaatctctatcaacttatgaaagaaagggtcaagcctttctccgagtctgaagtccgcaactggtgttttcagatatttcaggctcttgcatacatgcaccagaggggctactttcatcgtgacctcaaacctgagaatctgttggttagcaaaggtgtcataaagctagcagactttggtcttgcaagggaagtctcatcattgccaccatatacagaatatgtctcaactcgctggtatcgggcaccagaagtcttgctccagtcatctgcttatgattctgcagttgatatgtgggcaatgggtgccataatggctgagctgttgacactccatcctctctttcctggaaccagtga

SEQ ID NO: 44706 - DNA, 382 bp, Zea mays
  Clone ID: LIB3066-037-Q1-K1-G1
atcgatgcgaaagcgtccgggcctggtgggttcttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtcatcaccggcaagggaaaccttgacgggcagggcccagccgtgtggagcaagaactcctgcaccaaagagtacgact

SEQ ID NO: 44707 - DNA, 392 bp, Zea mays
  Clone ID: LIB3066-037-Q1-K1-G10
ccctcgcctcccccataccggggcccggtaaccagcatccctcggcagccgctgccgaccgatccgtgtccgtgcgagacgcgggagggattggcgcccgaggctgaccgggatgttctccggcgactggacgccgccgtgcggcagctgctgcaccaagaaatacgccagcctcgtgcagatcccatggagggtgttctgcaagaaggggtgcaacgcggacggcgacacctgggacgagtgcataggaaaatgtactgaaatatgctacaaagatccggtgttagaagatcgccagtggagcgcttacattgatcgatctccagggcaagatagctactctttggaatgcttcaatgcttgtgtgtctggctgtggattcagatttgaca

SEQ ID NO: 44708 - DNA, 454 bp, Zea mays
  unsure at all n locations
  Clone ID: LIB3066-037-Q1-K1-G11
gaaatctccacccgcacccgcaccagcaccagcacctattagctcgcctcccccacttatcaaatctcctcctccaccggttccggttagctcaccaccaccactactaaaatcgcctccacctccagtatctatgagtttaccacctccatctgtgaaatctccaccgccgttgccaccaaggtcacctccagcgccagtgaaatcaccacctcctccaccaccagtaagttcgccgccaccaccagtaccggtgaggtcaccaccaccgccaccaccatcaccgattagttcaccaccgccatcaatgaaatctccaccctcaccagcacctattagctcgcctgccccacctaccaaattccctcctccaccggtttcggttagctcaccaccactagtaaaatcacctccatcttcagcatatgtgagtgaaccgnctccaacggtgaaa

SEQ ID NO: 44709 - DNA, 405 bp, Zea mays
  Clone ID: LIB3066-037-Q1-K1-G12
cccacgcgtccgcccacgcgtccgcggacgcgtgggtgggggcttcgcgctcggcctggccatgaaccactgcatgttcgacggcatcggcgccatggagttcgtcaactcgtgggcggagacggcgcgcggcgtcgccgagctcaccgtgccgccgttcctggaccgaagcgtcctgaaggcgcgcgacccgcccgtgcccaccttcccccaccacgagttcgccgagatccccgacgtctccgacacggcggcgctctacggcgcgcaggagctgctgtaccgctccttctgcttcgacccggaccggctggagcgcgtgcgcggccttgcgctcgccgacggcgccctgggccgctgcaccaccttcgaggcgctgtcggggctggtgtggcgcgcgcgcac

SEQ ID NO: 44710 - DNA, 415 bp, Zea mays
  unsure at all n locations
  Clone ID: LIB3066-037-Q1-K1-G2
gtctccaatttctctgacttctccctgagcctttgcggccggctggagctggacggtccccgggcagcgcaggcagacggactgcgggagtcacctgcatggcctcagctgctactgcaaccctccccaaggttcacttgaggccaagatgcaacagctactttcaggtgaccggtcaagtccatgcccacaccaaaacatgcggtgcctgcaagtgtccgacccatattcacgggttgctcgtttcaactggaggaaagaggacattcctgccggtgtctgcagctggatcaggtcaaggctcatcggtcactgatgccgacaggaagaacgatttgtcgatggagaacgtccagacgttcgttgtataccgcgacggtgaaaagattaatgtacgagtgcatntgcctggaaa

SEQ ID NO: 44711 - DNA, 449 bp, Zea mays
  Clone ID: LIB3066-037-Q1-K1-G5
atccaaccagctgccgagggaggaatcctagcggaacactgtccaggtgacggcggcgcgctaccggtgacgggggatacggcggcatcgtcccctcctccatccccggcgcggcggagccagcagccgtcctgcagatcagctcaacaaagataaccttgcgccgcctcctaagaagatcaagactacccagccaggttctacagaccctcaaaaccttaatcgttagatcatcgccgttctcatgaagaattccggaggaggcgccgcccatggcgatggcggcgacatctacaatgtccgggccgtcgagatcctcgccaacgaggccctcctgctccccatcaatgaggccgtcccaatctacgagaatctgctcgccactttccccacggccgccaaatactggaagcagtatgtcgaagcctacatggccaccaacaacgatg

SEQ ID NO: 44712 - DNA, 426 bp, Zea mays
  Clone ID: LIB3066-037-Q1-K1-G6
agaaggacttcacggacatcaacgtcacggattgcactcttaagaagacgatgctcggcgtccgcatcaaggcgtccgaggacgccgtcttcgtgctcaccgtctccaagatccactacgagaatatcaagatggaggactcagccaaccacatctccatcgacatgaagtactgccccaacaagttgtgtactgccaacggagcctccaaggtcaccgtcaaggatgtcaccattaagaacatcaccggcacctcctacacacgcgaggccgttagcctgctctgcactgtcaaggtcccatgcaccggcgtcaccatggatgacgtgaacgtcgagtatagcggcaccaacaacaagaccatggctatatgcacgaacgccaatggcagcaccaacggttgcctcaaggagcttgcatgcttat

SEQ ID NO: 44713 - DNA, 437 bp, Zea mays
  Clone ID: LIB3066-037-Q1-K1-G7
cccacgcgtccgggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacagcggtggcgggcgccgt

SEQ ID NO: 44714 - DNA, 389 bp, Zea mays
  Clone ID: LIB3066-037-Q1-K1-G8
tcgcccacgcgtccgacaaagcagtcgaaaagaatgaatggaagccattgcctctaattcaggaagcttttattggtctgactgctggagcaattggtgcttgttttggtagtcctgctgatctggcactcattagaatgcaagccgactcgaccctgccagctgcacaacgacgcaactataagaatgctttccatgcactctaccgtatcagtgctgatgagggagtccttgcgctttggaagggtgcatgttcaactgtggcgagagctatggcactcaatatgggtatgcttgcttcctatgaccagagtgtcgagctatttagggacaaatttggcgcatgagaaatttctactggtgttggagccagagcttgttctggattc

SEQ ID NO: 44715 - DNA, 464 bp, Zea mays
  unsure at all n locations
  Clone ID: LIB3066-037-Q1-K1-G9
gcttgtttatgattgcacatcaaaggaatgcaagaccagcggatctagtatttgcagagggtgtgttgtttgcatctctagatgtttgcgatgtgggagatgtatcgacagtgagtttgaatttgaagagacattttttctggggagcatttgccgtgactgtgtcaagtattcaccccaccacagaaaaatagatgtttgattctgttatccattggatggatacagttgtaacattggatttctgtgattgatgctcccatccatcagacatcttgactgagtatttctaacaaggaaaaaaaagagagaaaggtctaccagtttgctatcggtgtangtgcagcagctgatatatntgttttgcttgcangaaaaacgaagaataacagtataacctaagaaatcagaagatcaaagtatggtttccgtatcatggtgtcagcagtgaatggtgacaactg

SEQ ID NO: 44716 - DNA, 337 bp, Zea mays
  Clone ID: LIB3066-037-Q1-K1-H1
tcgaaaacatagagtgtcgacttttctattggtgtgattgggggcactaaatacctaacacattgcactcagactacatatactgtgtttgtgtgttgtatgccgtatgcgtgtgtgagcttgcgcaaattggacatctaggccgtgcgtatcctgcgatgaaaggcgccgtcatcggcgcatcgaccgtcctggtcgtggcggtggtggccaccatctgcgtcgtttccttcaaaggcagcggcgatggcgggagggccgaagagggcgagatgtccacgtcggtgaagtccatcaagtccttctgccagcccgtggactacagggagacgtgcga

SEQ ID NO: 44717 - DNA, 361 bp, Zea mays
  unsure at all n locations
  Clone ID: LIB3066-037-Q1-K1-H10
gcagcaagcaactgcaaagcagcaagctctactcttcttctgtactgaacgtgtgactagataacaacaagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggagacgactactgccgcagcggcggcgacgactacngccgtggcacc

SEQ ID NO: 44718 - DNA, 364 bp, Zea mays
  Clone ID: LIB3066-037-Q1-K1-H12
cggacgcgtgggcggacgcgtgggaaagccagctatgagaatgtttcgaagaagtggatacctgaactgaagcattatgcacctggtgtgccaataattctcgtagggacaaagcttgatcttcgagatgacaagcagttctttgtggatcatcctggtgctgttcctatcactactgctcagggagaggagctaagaaagcaaataggcgcgccatactacatcgagtgcagctcaaagacccaactaaacgtgaaaggtgtcttcgatgcggcgataaaggttgtgctgcagccgcctaaagcgaagaagaagaaaaaggcgcagaggggggcgtgctccattttgtgatctaataatgatc

SEQ ID NO: 44719 - DNA, 322 bp, Zea mays
  unsure at all n locations
  Clone ID: LIB3066-037-Q1-K1-H2
cggacgcgtgggctacagtgcagacaccgtatatgctggtggagccactgcctacatcctgtggacatccttcgacaccactctgacaggcgtactgcaggaagagcatcaccatggccttgacgccaggttcctgccgcagatcgatggcctatcagaggtagcagcatactatccaactgccaccgattaggccagcatatggcagttcgaccagatgggactttcagagaccttagacgagcaggtgccttctncattgcagatgagcagcagtgcatatgccttgatgccgatcgctacagactatgatgagtgcttc

SEQ ID NO: 44720 - DNA, 426 bp, Zea mays
  Clone ID: LIB3066-037-Q1-K1-H3
ctttctctttttcttcgtcttcaaatgttacattgtgttttcaatattgtactaatataatatgagcatgtattcttacataatcatatcaatattgcaagaagtcctctattttttaatcgtgaaacttctctggctctggactgacagcttttttgagcatttgatctcgaacactctgctttattgacttggttttgcagctatctggtttcaaaatacgatcatgtatcacttcagcatgttgtatgcctcccatgacttggagcccattatagcaactgatgacgacgtatgcgcaccatctaaccgattaaagaaaggcgctcgttgaagcgaggatggtggggagtagatctcgcaccggcgttggatatcggacagggggaagaaggcactgagggccaaaaaccaccacaacggtga

SEQ ID NO: 44721 - DNA, 380 bp, Zea mays
  Clone ID: LIB3066-037-Q1-K1-F9
caattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctgcatcctcaccgtcatgggcgtctccaagtccaccttcaagtgcgccaccgtcggcatccagggcatcgcctggtccttcggcggcatgatcttcgccctcgtctact

SEQ ID NO: 44722 - DNA, 444 bp, Zea mays
  Clone ID: LIB3066-037-Q1-K1-E5
ggcaaatgctctcctaggtggcctgtgggcgatcgtcgtcgtcgcggtggtcgtcggcgtggtcgccaccgtcacccactccggcaagaaggccggcgacgacttcaccgtcccgggggaagcctccattgccacgtccggcaagtcggtcgagtccctgtgcgcgcccacgttgtacaaggagtcgtgtgagaagacgctctcccaggccaccaatggcaccgagaaccccaaggaggtgttccacagcgttgccaaggtggcgctggagtcggtgaaaacagcggtcgagcagtccaagacgatcggcgaggctaatgccagcgactccatgaccgagagcgcgcgggaggactgcaagaagctcctcgaggacgccgttgacgacctcatgggcatgctcgagatggccggcggcgacatcaaggttgctatcagccggtc

SEQ ID NO: 44723 - DNA, 427 bp, Zea mays
  Clone ID: LIB3066-037-Q1-K1-E6
cggacgcgtgggcgagaggagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctgcaccgaggccgccgccgcgggcgccccaactgcctccgagtcgtccgccgaggctcccgctggcgctggcgctggcgctgccgctggcgccgtcgcctcggcgccctccgccagcagcggcgcgcccgccctagacgccgcgcccgccgcgctcctcttctgcctactcgcctactacctacactaagcgtgtgcgtgcg

SEQ ID NO: 44724 - DNA, 347 bp, Zea mays
  Clone ID: LIB3066-037-Q1-K1-E7
gggttggcttctcctccccctccggttcgggttcgggttcgtgaggttctccggggttcggtttcgtgggtgagcggatcgagatggcggcgtctgatgttgagtaccgctgcttcgtcggcggcctcgcctgggccacggacgaccactccctccacaacgccttcagcacctactgcgaggtcctcgagtccaagatcatcctcgatcgggagacgcataggtcccgcggcttcggcttcgtcaccttctccacggaggaggcgatgcggaacgccatcgagggcatgaacggcaaggagctggacggtcgcaacatcaccgtcaacgaggcccagtcccgcggc

SEQ ID NO: 44725 - DNA, 446 bp, Zea mays
  Clone ID: LIB3066-037-Q1-K1-E8
atctcttcctcctctctcatctaagccggtggccagggggcataacccagccgacggggtacggcggcgtgggggtataacccggccggcgaccacggaccgcgactacgatcttcatagtcgaggccctgctaccttgggccccgaggtccttgacatttcaatgtggagaaaaggatataccgtgcctttattttgaataatagttatccaagaatttgttctaggcgaattcgatgacgacgcgactgctgcataccatgaaaatatcacttctgagttagttgacgatgaccatcatgtgaaagatatatctcagaggtatcatgttcacttgtatacaaatgggactgtatgcgatctcacagatattccgcgggagacagaggttagatttgtctgctcggagcctactgtactgattagttcagtcaaggagatctctt

SEQ ID NO: 44726 - DNA, 361 bp, Zea mays
  Clone ID: LIB3066-037-Q1-K1-E9
ctcgtacacgagatcaaccaacggcatcgctgccactgcagcaggagtggcagcaactactcacagaaaggtcggcgttgttccgtttggcatgtcaaacatgtattagtgactggatcatggccgaatcatggtgaatcctctgtgcggttgctgggtctatgctgccttcaggtggctaaacaccgacaacttgaagcggccaatcaaacctttggctggatgctgcaagtttagagtgcagtagacagtgttttttctgtgtggtcaggaaaagaagaacaccgctggcggcatgaagcctgccaaaaaagtttgtatctgcctgtgcctgagaagtgtgcccttggtgtgcacactg

SEQ ID NO: 44727 - DNA, 437 bp, Zea mays
  Clone ID: LIB3066-037-Q1-K1-F1
acgcgtacgctgacgcttgcggcgattcgaaataatcgggtataaatagctcgggagtgcctgaagcgcgcacatatatattcctgccaagataaaggtaatggagtcgacacgcatgttccagcacggtcgtgatcctacttatactgatcattgtgtacaccgatatggcgcacgcaagggaatgcgagaagtacagtgagcgatttcttggagcattcatgatcgcagacaactgcgccaatgtgtgccgcgctgagggcttcttggccggcaggtgcagcaccttccgccgtcgatgcatctgcactatgcagtgctaaacaagatcgatcgatcgctcgacatgcattgacaacctattcttaataacgttcattatctcgttcttatctatgactaatgtcatgtatgtcctcgtgactgacatgtatatt

SEQ ID NO: 44728 - DNA, 338 bp, Zea mays
  unsure at all n locations
  Clone ID: LIB3066-037-Q1-K1-F10
cccacgcgtacgtccacgcgtccgcacagtgatgcctttcgtggtggaagttgtccttgagattgcaaaattgtgtgatgtgtattcgatggagcgtcttcttgatgatgagagtgagggacaggttttatcggtcctgagtgaagctgggctttttggttgtggtggattgctaaaagatatggttttcttctgtagcaccgtgaatggtcgtacatatcatgatcggcaactcgagcctgattggcatatttacacgagtccttgagatgntcaccaatgagctaggtttatcaaatttcaactgcacatcttcccgcagcgacctgaaagaatag

SEQ ID NO: 44729 - DNA, 305 bp, Zea mays
  Clone ID: LIB3066-037-Q1-K1-F11
tcgccacgcgttcgccacgcgtccgcacagtgaagccttccgtggtggaggttctccttgaggggcaaaattctgtgatgtgtatttgatggagcgtattcttgatgatgagagtgagggaaaggttttatcggccctgattgaagctgggctttttggtggtggtggcttgataaaagatatggttctcttctgtagcacggtgaatggccgtacatcttttgttcgtcaactcgagcctgattggcatattgacactagtcctgaagttgatcactaattagcttggtctattaaatatcaac

SEQ ID NO: 44730 - DNA, 424 bp, Zea mays
  Clone ID: LIB3066-037-Q1-K1-F12
ggcaaaggctctcctaggtggcctatcggcgatcctcgtcgtggcggtggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaagactgcaagaagctcctggaggacgccgtcgacgacctgatgggcatgctcgagatggccggcggcgacatc

SEQ ID NO: 44731 - DNA, 372 bp, Zea mays
  Clone ID: LIB3066-037-Q1-K1-F2
gcgtacggtgctacctctgacgatgaggacgccgtgtaccgacccttcatgatgccggttggcaccatgtccggctccttgtatacagctacgatgaatccacctcagtgggaatctcactgataccttggtgcaacccactgctttgagcaaccacctctgcccgactcaacactgccactggcatatccatacagcggcacgatacatttccaagatggagcgcgctctccaggcctcatcaagggcacatattgaattcggatcatccctgcctctgaccagagtggattttgaatctgcagatggctctatcacctatacaaatgtacgagctgacattctgcattcattgcgatgccaaccgaaacc

SEQ ID NO: 44732 - DNA, 430 bp, Zea mays
  Clone ID: LIB3066-037-Q1-K1-F3
agtcggtccagacggcggtcgagcagtccaagtcgatcggcgaggccaaggccagcgactccatgaccgagagcgcgcgcgaggactgcaagaagctcctggaggacgccgccgtcgacctgaggggcatgctcgagatggccgtctgcgacatcaaggtgctgttcagccggtccgacgacctcgagacctggctcacgggcgtcatgacgttcatggacacctgcgtcgacggcttcgtcgacgagaagctcaaggccgacatgcactccgtgctgcgcaacagcacctagctcagcagcaacgcgctggccatcaccaacaagtctagcaggatccctgataaaatggacctcatgcatgttcagcaaggactcgcgccgcctactgctgtcgtaggatcatgattagaaaggctggcccgtgtgga

SEQ ID NO: 44733 - DNA, 132 bp, Zea mays
  Clone ID: LIB3066-037-Q1-K1-F4
agtacgcgtagacggactcgtggcaatccaagtcgatcggctaggccaatgccagctactgcatgaccgaaagcgcgcgcgaggactgcaagcagctcttgcaggacgctgcatacgacctgatgggcatgc

SEQ ID NO: 44734 - DNA, 228 bp, Zea mays
  Clone ID: LIB3066-037-Q1-K1-F5
cccacgcgttcgcggacgcgtggggtgatttgaaataattgggaataaatagttcgtgaatccctgaaacctgcatatttgtaattctggccagaaaaaaggaattgaagtcgtcacgccagttccaagccggccttattcctgttcttccggttaatgggttcaaccattttgcaccagccaaggaattccaaaagttccatgaaccaattggttgggccttcctta

SEQ ID NO: 44735 - DNA, 449 bp, Zea mays
  Clone ID: LIB3066-037-Q1-K1-F6
gcgaatcgccggaccggtcggcgacggagacgacagagcccaagtcgaagcgatccgattttgccggcggcagcgaccggagtatggggctgggaggccggggcgtggtgggagacaggtggtcgcaacgcatcctctggatttgcgccctgggcagcgccgtgagcctctacttcgtggcggtggagaggcaggctcagaatcgtgcgcgggcggtggcggagggcctcaaggcgctcgacggcgccggggatgacgtgtgacagcggtggacgctgccgtgcagagggcctcctttggttcacatgttcacagaacctcatagcgttgcaataatgtactaaacatctgtgctcagtctttgtagaattaaatgtggatcaatgtgagtgttctcctatttcacataattcatctgagcctttgttgctgcacagaaatgttgatcc

SEQ ID NO: 44736 - DNA, 442 bp, Zea mays
  Clone ID: LIB3066-037-Q1-K1-F7
gttgcccgacagctggaacctgaagggatcctttgcaccggttttggtcctgggaagctacttcgttctgataacggcaatttcttctgggctctgtgccagacaccgatctttgtctggcacaaatcctgtgtgaggtctcaagggcagcgagcacttgataatgtgcgcgctctacctccaaatgagtgtctcgagacacactctgatctttgtgacccggtgcccgagctggtcctttgtggagcgccctggtctgctgctggtcaccgcgtttctgctcgtccagcttgtcgcgacctttctcgctgtctacgccaactatggcttcttcacgatcaacagtatcttctgtggctgttccactgttgtctggctctacagcatcgtgttctactatcctctggacctgatcaagttcttcatacgcttcgtgctcagc

SEQ ID NO: 44737 - DNA, 449 bp, Zea mays
  Clone ID: LIB3066-037-Q1-K1-F8
cccgatcgccaccgccgaccggactcccctcaaaggcggccacagcacagcgagcatgggagaccggcatcagcatgggcctggcagcggcgtggaggacccggcgacccttcttccgcgggtgccaaaccgtgcggccaaactgaacccaggtggtggggttcctgaccctgctgcgctctggcgccgtgctgctgctgctaacgggggtaacgctgacgggcgccgtggtggcgctcgtcttcctgggccccatcgcgctgctcaccagccccatctgggtgcccgtagccgtcgtgatctccgccatcgtcgccgccgcgctctccgactgcgccttcgacgacgccgcgctccccgtggccacctgtatgtaccgttacttcacgggccgacaccctgtgtgcgcagaccgtgtggactacgcgcgcatccggatcgccgacacc

SEQ ID NO: 44738 - DNA, 379 bp, Zea mays
  Clone ID: LIB3066-037-Q1-K1-E4
gaggaggggcctgcaggctgcagcagctggaggtaccctcttctcctcctgctcctctagtgtattctgcgtgccacgccctgcaatccctcgccaacattttgagccacgcgcgacgctgcctcttggcttggatccgcccgtgaaattcatccctgcgtcggctcacccacgcagcgccggcggcctccctcttgcgtacggagtagtaaaataagaattccggtcgcacctccgatccggccgtctttccatgagcggccggtttaaataggccggggacaaagatcgggcgcaggtgctggctggcacgcatcaggtttggctttcttttggtgctatctatctccttgttccctcggattgtccttgtcgttgt

SEQ ID NO: 44739 - DNA, 360 bp, Zea mays
  Clone ID: LIB3066-037-Q1-K1-D12
cccggattcagacaggtgctaccattcgatttgatttggcgtggagcactttcctatggccgcctccatcgcggcctcgtccttctttccagggtcaccggcgccggccgctcctaagaacggccttggggagcgcccagatagcctggacgtccgcggcgttgcggcgaagccgggagcctcgtctagtgccgtgagggcgagcaagacgcgcgcccacgctgcggtccccaagatgaacggtgggggcaagtccgcggtggctgatggggagcacgaaaccgtaccttcttcggtgccgaagacttttacaaccagctttccgactggagcatgctccttgcggccatcaccactatc

SEQ ID NO: 44740 - DNA, 430 bp, Zea mays
  Clone ID: LIB3066-037-Q1-K1-D2
aggggctgtatcatatattcaatagaggtcatgcgcttgtgcaccttactgcagatatatacacacgtacaggggcaagacaattttttgttgtgtgcatgggcctctgctcctccacacctggggaaggggaagggatgggacggggatttgcttgtgtgcttgctttgtgtttaattttgtacgtaggctgggaacatgtgtttggtgggatgatgatgatgatgctgctgctgctgcttataaactcaacattctttataccttgtattgtacaagtgcatgtacaagatgtgagtcgacccgtttgggttgagtaactctcgagtgttttttcttccatggtgtatcgttttcctgtttctccagaattttctgagcaatgtacagacagacaaacttttgtgtgaaaaatgaaatataattataa

SEQ ID NO: 44741 - DNA, 420 bp, Zea mays
  Clone ID: LIB3066-037-Q1-K1-D3
cgacggggtgttcagctacaaccagatgggcgacgtgccccccgccgtgtacggtcccctccatgtgatccccaatgtcatcaccgccgagttccgcaccttcatcgagatcgtcttcgagaaccccgagaagagcatagactccctccacgtcgatggctactccttcttcggcgtcgggatgggccccgggtaagtggtcgccggaggtgaggaagacgtacaacctgctggacacggtgagccggcacacgatccaggtgtacccgcggtcatggacggcaatcatgctgacgttcgacaacgcgggcatgtggagcgtgcattccaacatctgggagcggttctacctcggggagcagctctacatcatcgtcgtctcgccggcgcgatcactgcgcgacgagtacaacatgcccg

SEQ ID NO: 44742 - DNA, 427 bp, Zea mays
  Clone ID: LIB3066-037-Q1-K1-D4
cggggcggcattggccgtcggggaccttgaggtgctcaccgctctcgactcctcgaagactcactggtaccacttcaccgccatcgtggtctccgtcatggggttcttgaccgtcgcctactacctcttgtgcatctacctcgcgactaagctcctcggccgcatctactacaccgtggaggggtccgcgacgcccggctcccttccgtcgcacgtgtccgcgtacgtcaacggcttgtccttcttgggcacgctgtcagggcagctcttcttcggctggctcgtcgacaagctcgggctcaagaaggtctatggcatgacgctcatgctcatggtcctctgctccgtcgcgtctgggctctcgttcggccacaccccgtcgtccgtcatggcgacgctgtgcttgttccgcttctggctcgagttc

SEQ ID NO: 44743 - DNA, 404 bp, Zea mays
  Clone ID: LIB3066-037-Q1-K1-D5
cccactcgtccgggccgccctttttttttttttttttatgcgtatgaacacctgtaaataatcgtgtattcacttgtcaaaaaaaattgtagtattcagcaaacgagaagctgtaggcacgcagattacaggcagcatcatcatcatctaataataataattcaatattactgcccacattacagcaccaacgacctatgaccaaaccacggagctcctctccatggaagcgaacggtgacaaaaacacgccaaaatggattttaaaaaaaaaaacctcaagagcgacattgcgcgcaacgtcatcctcctccgggcagtctaggaagcggcggcagggacagcaggggtttcctgctccttcgccagagactcccagtcgaccttctgttctagatcgcgagc

SEQ ID NO: 44744 - DNA, 259 bp, Zea mays
  Clone ID: LIB3066-037-Q1-K1-D6
gaggaacaccccgtcctcctcactgaggcgcccctgaacccaaaggctaaccgtgagaagatgacccatatcatgttcgagaccttcaacaccctcgctatgtacgtcgccatccaggccgtcctgtctatgtatgccagtggtcgtaccacaggtatcgtgctcgactcgtgagatggtgtcagccacactgtcctcatatacgacggatacgctcttctccacgccatccttcgtctagacctggctggccgcgtcc

SEQ ID NO: 44745 - DNA, 435 bp, Zea mays
  Clone ID: LIB3066-037-Q1-K1-D7
cccacgcgtccgccgttcctcgtcgtctcgtgttgtttctcgcgttgccattgccccagctgtccgcccgcgcccgcggcaatggcaggcggcgtggtggtgaacgcggccgggggcaagacgtaccccggccgcatgacgccgttcgtgttcttcacctgcctggtggcgtcatcgggcggcctcatcttcgggtacgacatcggcatctccggcggtgtcacgtccatggcgtcgttcctcaaggagttcttcccttccgtgtacgccaaggcggcggcgaacaaggacacgaaccagtactgcaagttcgacagccagctgctgacgctgttcacgtcgtcgctgtacctggcggcgctggcgacgtcgttcgtggcggcgtccgtgacgcgggtgttcgggcgcaagtggtccatgttctgcggcggggtg

SEQ ID NO: 44746 - DNA, 449 bp, Zea mays
  unsure at all n locations
  Clone ID: LIB3066-037-Q1-K1-D8
cgacgacaagaagtactcgcgcaagctgctgaacaaggcgaagctgctgttcacgttcgccaagagccacctgggcagctacgacggcgagtgccccttctactgctcctactcgggctacaacgacgagctgctgtgggccgcgacctggctgtacctggcgacgaggcggcaggtgtacgcggacttcatcgcccacgaggccatctcgtcgagcgtggccgagttcagctgggacctcaagttccccggcgcgcaggtgctgctggccgagttcaacatgacctcggcgggcggcgcgcagaacttcaagtcgcaggcggacaacttcgtgtgcgcggtgctgccggacacggcgttccaccaggtgttcatcaccccgggcggcgtgatccacctncgcgacggcgccaactcgcagtacgtgaccagcacggcgttcctgctgg

SEQ ID NO: 44747 - DNA, 449 bp, Zea mays
  Clone ID: LIB3066-037-Q1-K1-D9
ggagtcctgcgcgctctcccagcagtccaacctggtgctgtacggcaggatccagtgcaagggcaagtgcaccgagcagaagggcatcacggctccggccatgaaggtctgccaggaggagtgcgacaaggcgtacgtggtgaatgctgtcgaggtcaccaaggcctgcagcgtcacctgcgccaaggagaagaacccgcgcctcagcgagaactgcaagaggtcctgcacccctcctccttcttgaagcgaacccccttgaaatgaatgaaccatgcatgcatgcatgtatgcatgcgccggggtgacgtggcgttcagctcaagcgctgagcgagtctatacgtacgtcgtcaccggctggccacgcatgcgataaccatctgatatggacggaactatatattgtatttctattaatcttgcattttctaagctaaatggtttttt

SEQ ID NO: 44748 - DNA, 418 bp, Zea mays
  Clone ID: LIB3066-037-Q1-K1-E1
tcgcgttcggccacatggtgaccccgcccaccgacacaccgtcgatcacgcccaccaagaagcaggacgacaagccgaagccgacgccggaggccgccaccgcggcgaactacgcgtcgttgtggtcgcccaagcgcctcatgcagcgcgctgcccgcgctttccgccgcagcaggtcgcggcgcccgcgtcaggacggtcaaggacctcgccgaggaacgggcctcagtgctcgccgccagcagcaaggtctctgatgaggcggcggcggcggctaccgcggtgccgcctgcaggtgccaagaccttcagcagcaacgatgcccgcgacggcgccatgggcagcgtgcaggacgagccgcggcagcagcgccacgatgactatcaccccgagatcgtccccgagaagatcatacacg

SEQ ID NO: 44749 - DNA, 442 bp, Zea mays
  unsure at all n locations
  Clone ID: LIB3066-037-Q1-K1-E10
ggcgcatgctgggaaacattaggttaattggagagttgtacaaaaagaggatgttgacggaaaggattatgcatgaatgcattaaaaaattgtttggaaatcatgatgatcctgatgaggagaacattgaagcattatgcaaattgatgagtacaattggtgatatgattgatcatgtaaaggcaaaggagcacatggatgcctattttagtatgatgcagatgatgtcaacaaatcagaagttgtcttctcgtgtaaggtttatgttgagagattcaatcgacctcaagagaaataaatggcagcaaaagcgtaaagtcgaaagtcccaagaagattgatgaggttcacagagatgcagcacatgaaagacatgcccaatcgagtaggttgggacgtggtcagctgttaagtctgttccaagaagagcacatnctatggat

SEQ ID NO: 44750 - DNA, 442 bp, Zea mays
  Clone ID: LIB3066-037-Q1-K1-E11
cccacgcgtccgcccacgcgtccgcgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaggccgtcgcccacctcaacggcctcgtccgggagcccaccgacgccaagttcctcgagctcaagtcgtggctctcctccacgctcggcggcaccttcacctgcgaggacgcctgcaaggacctgcccaagaccagcgacaaggacgacgtcgtcaacttcagcctcgacttcgagaagctgcagcgcgtcacgctcgacctcatcaccgaggcgttcggcaccatgtccgcaggcatctgcctgccacccttcaacgccggagcgcccttcta

SEQ ID NO: 44751 - DNA, 392 bp, Zea mays
  Clone ID: LIB3066-037-Q1-K1-E12
gaaccactcaagcaagctgagctgaaagcagttagaaacgagataaaaccagatcctatgtccacgatgagggcaccccaagttccttccatgctaccttttaacaatcttgcttttggcgcaacatttggtggtccagctagtctgaagcccatgacaatggctccaatgccaatggccatgcctatgtcaccagctcctctcacaaagaagccaactccagcagcagcaactcctctttgtggtaaaagtgataccgataacttgaagatggctaaacaggtgctgaatgaagatatctcaaagttgcaatctcaggttaataaactgaaacaaaaatgtgatgcccaagaagagcaactgcagaaagcggaaaggagagctgaacattc

SEQ ID NO: 44752 - DNA, 427 bp, Zea mays
  Clone ID: LIB3066-037-Q1-K1-E2
cccacgcgtccgcccacgcgtccggatgcagccaacaacttcgcccgtggtcactacaccattggcaaggagattgttgacctgtgccttgatcgcatcaggaagcttgccgacaactgcactggtctacagggcttcctcgtcttcaacgctgttggtggaggaacaggctctggccttggttccctcctcctggagcgtctgtctgttgactacggcatgaagtctaagcttggtttcactgtgtactcatcccgccaagtttcgacctcagtggttgagccatacatcagtgtcctgtccacccactccctactcgagcacactgatgttgctatcctgctggacatcgaggccatctatgacatctgccgactgtcccttgacattgatcgcccaatcttcactaaccttaacaggcttgtgt

SEQ ID NO: 44753 - DNA, 397 bp, Zea mays
  Clone ID: LIB3066-037-Q1-K1-E3
tcggccccacgtacatctgctccagatccaggcacggcacggcacggcagccgggccaacccaagcccgtcttctcttctctatcgtccgtcccgcactagccgcgacgtgacaagacaacgcgacgcgcgcgcatacgtcgtccaaggcacgcatgggccagccaagccaaccaatcgcgttcgtccgggtctggtggtggccggaatgggcctcctcgatcagctctgggacgagacggtggccggcccgcgaccggactacggcctcggcaagctccgcaagtactcctacttctgcaccgcctacgtactctcctcgtcgtccatcctggcccacgagccggctccggcgccggcagtgacacgcagcatgaccatcgtccgtccgccgtcgc

SEQ ID NO: 44754 - DNA, 328 bp, Zea mays
  Clone ID: LIB3066-037-Q1-K1-D11
cccacgcgtccgcccacgcgtccgctccctctccgtcccccaagcaaagaaaagaagctagcgtagctaggcgtagaacgaatgacgacgcagggcggcaacaggtcgacgacgacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgactgtggaggtggtgtgccggcacttccgcgcgtccaaggtgacgc

SEQ ID NO: 44755 - DNA, 408 bp, Zea mays
  Clone ID: LIB3066-056-Q1-K1-H9
cggacgcgtggggtgacacgcaaggagcagcagcagcagcagggctcgcccgacggcgacggcgccgacccggggcggttcaccttcgactcgtcgccggtgttcgtcccgccggcggcgctcgcgatgctgagcgtcgtcgccgtcgccgtcggagcgtggagggcggttaccggtggcggcggcggcggcggcggcggcccgggcgtcggggagttcgtgtgctgcgcctggcttctgctctgcttctggccgttcgtgaggggcctcgtcggcggcaggggaagctactgcatcccctggagcgtcaggatcaaggctgccctgctcgtggccgcgttcgtgcacctgtccacgcgcaagtaacttgcccgacccaggcgtcgacttaccactgctactagtgct

SEQ ID NO: 44756 - DNA, 469 bp, Zea mays
  Clone ID: LIB3066-056-Q1-K1-H8
gcgcgaacaagttctgggcgccgacggcgaagccggcgctggcagcggagccctgcacggggcagctgaacccgctgaaccccaagacgtaccgcgtggcggaggacgtgctgcgcgacctggcggccttgttcccggacccgtacctccacgcgggcgccgacgaggtgaacacggcgtgctgggaggacgaccccgtggtgcggggcttcctggcggacggcggctcccacgaccgcctgctggagctgttcgtgaacgcgacgcggccgttcctagtccacgagctgaaccgcacgtcggtgtactgggaggacgtcctcctggggcccaaggtgtcggtcgggcagacggtgctgccccacgacaccaccgtgctgcagacgtggaacaacggcgccgagaacaccaagcgcatcgtggcggccgggtaccgtgccatcgtgtccttcgcgtcctactactacct

SEQ ID NO: 44757 - DNA, 461 bp, Zea mays
  Clone ID: LIB3066-056-Q1-K1-G4
cccacgcgtccgcccacgcgtccgcccacgcgttcgcggacgcgtgggcgcgcacacacacagacacacacacacacacacacacgacgtcgtacgcggcagctagcagagcacgcacgatcgccgcagcgtacgtactagcacagaggacgacgaccgacgccatggcggacttcttcgcgcgcggcggcgcggcggcggtggcggcgctggtgatggtggcggccgtgctggcggcgtcgtgggccggcgtggcccgcgcggacttcgcccaggaccgcgccatgtgcgcggaccggctgatggggctggcgacgtgcctgacgttcgtgcaggacaaggcgacggcgcgcgcgccgacgcccgactgctgcacggtgctgaagcatgtggaggccgccagcaagctgtgcatgtgcgtgctggtcaaggaccgcgacgagccggcgctggggttcaag

SEQ ID NO: 44758 - DNA, 463 bp, Zea mays
  Clone ID: LIB3066-056-Q1-K1-G5
atagtttgcttggtcctgtaaaaacatggcaaattcaagattgtattgatgttcataaattgctggagacagtctttggtgatcagaatgttgcaaataggtggaaggcacggtgcgcggaatattttccgtactcgacgtactttgaaggcatcaagagcgctatttcaacctatgccattgaccatagtctcgagagcccaccagaaaatggaattgcttcaaaccctcatctgaaatcaaaagatggagaacaagggagtttgaatgggactctgcatattgtagatgatttgagcagcctaagcattcggtaatgcacgaacaagttgctgaatggtcacaactggaacacaacattttagaactggagccagtacccaattaaccaaagcgtacacgaacaaggtgaacatagtgctctggtgcaagtagttgtcggcacatcacatatgaagagtat

SEQ ID NO: 44759 - DNA, 421 bp, Zea mays
  Clone ID: LIB3066-056-Q1-K1-G6
cacaataagatggcgtgtatagacaatgcaatgagagccttgttccttttagcgctcttttgtgtcttgcatggtgagaaggcaaagtcaaaggacaacgatgcaaaagcgtccgggcccggtgggtccttcgacatcaccaagttgggcgcatccggcaatggcaagacggatagcacgaaggctgtgcaggaggcatgggcatcagcgtgcggcggtaccgggaagcagacgatccttatccacaatggcgacttactcgtcggaccactcaatttcacatgcccatacaagggcaacgtgaccatccaggtgaatggcaatctgcttgcgactactgacctaagctagtacaaggatcatggtaattggatcgagattctactcgtggacaaccttgtcattaccggcaagggaaagc

SEQ ID NO: 44760 - DNA, 400 bp, Zea mays
  Clone ID: LIB3066-056-Q1-K1-G7
gggcacgcctcaagaacggcatcctcgatctggggttaacgatccaggcccagaagcagtcggagctccctgagcaggtcctctgctgcgtcaggttgaacaagatcgatttcactgaccaagaagttccaacaatagtcaccgttgatgacacctgacgcatttgatcaaaatggtcatcagacgtgcgagctattattaactgctgcaaggctagatccatgggattcagaggcgacacaagaactgatgactccacgccttggtttctgcctaatatgttcgccgatctgcctacttttaagcacgggctttttcttgtcttccctgtaactataatataataatgtatattatatacaagacgatacaaccctgcgggtgttggtcatgttcctaa

SEQ ID NO: 44761 - DNA, 478 bp, Zea mays
  Clone ID: LIB3066-056-Q1-K1-G8
gggcgagctgctcagggacatcgtcggcagcgcctactacatcgcgcccgaggtgctcaagaggaagtacggcccggaggccgacatctggagcgtcggcgtcatgctctacatcttcctcgccggcgtgcctaccttctgggcagagaacgagaacggcatcttcaccgccatcctgcgagggcagcttgacctctacagcgagccatggccacacatctcgccgggagccaaggatctcgtcaagaagatgctcaacatcaaccccaaggagcggctcacggcgttccaggtcctcaatcacccatggatcaaagaagacggagactcgcctgacacgccccttgacaacgttgttctcgacaggctcaagcagttcagggccatgaaccagttcaagaaagcagcattgaggatcatagctgggtgcctatccgaagaggagatcacagggctgaatgagatgttcaagaacatt

SEQ ID NO: 44762 - DNA, 419 bp, Zea mays
  Clone ID: LIB3066-056-Q1-K1-G9
gtcatcggtttctcctcagacatcggttacgctctcggtgacacgacggaagactgcaatgtttacacggggaagcggctgcacgcggccttgttcttcgtgatgggattctggctgctggacttttccaacaacacggtgcagggccccgcacgcgcgctgatggcggacctcgcaggcagccacgggcccagcacggcgaacgccatcttcgtgtcgtggatggcgatcgggaacatcctgggctactcgtcggggtccaccgacaagtggcacacctggttcccgttcctgcagacgagggcatgctgcgaggcgtgcgccaacctcaaggccgccttcctggtgtcggtggtgttcctgggcctgtccacggtggtgaccatgatcttcgcccgcgaggtgccgctggacccggc

SEQ ID NO: 44763 - DNA, 414 bp, Zea mays
  Clone ID: LIB3066-056-Q1-K1-H1
cggacgcgtgggcggacgcgtgggctcagactcggcgtgcaagaaactagagagagtctgctgcgagaacttagagtgagtgctgaaggcagtgacctaagacattttatacatggtgccgatttttactgcatttttttctacattctttttttgtgatttgattatctaaacatgtgaattttcaggtcttcatattcttctatctcctagttttttaatattttttctttgcttataattgactgattataaatgtttttattctcttctttgattatttcctaattatattctctcgatctgttcaacttttaaactacgggctttttctttgtcttccctgtaactataatataataatgtatattatatacaagacgattcaacccttgcggtgttggtcatgttcct

SEQ ID NO: 44764 - DNA, 319 bp, Zea mays
  Clone ID: LIB3066-056-Q1-K1-H10
cccacgcgtccgcccacgcgtacgcggacgcgtgggccgtgagatcgtggagcagagctggactttggactagtgcataaggatgctcgtcgtgcccgataggggcacaataagaaagcgtgaaaaaaaacacacccactccttgtgtttctggttcgacaggcttgtcgaaacattgaagaaccccagtgatcggtttgtagtctgtcgtcatcgttctgccccgatcaagagccccggttgctcatggtggcggctgtcgtaatgtagcggttgttgacctatcttctcatgaattgaaaggatcctgactatgtac

SEQ ID NO: 44765 - DNA, 399 bp, Zea mays
  unsure at all n locations
  Clone ID: LIB3066-056-Q1-K1-H11
ccacagaaacttttctctcggtccgttcgatcgatcgctgccgtgtcgtttgccagacaccatcagcacctaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagcgcggccgacctggcctncgggggcaggaggtcgtccggcgtgccggtgttcgtcatgatgccgctggacaccgtcaaagagtgcggcaccgcgctgcaccggcgcaaggcggtgc

SEQ ID NO: 44766 - DNA, 194 bp, Zea mays
  Clone ID: LIB3066-056-Q1-K1-H12
tcggggacatgcgcgcgcgcgcgccgttgtacatttgaatggtggcaactcgcaggccatggtccacgaggagaaagtatgcgtgcagaaggaggtgaaggaagacattaattaggtggtggtgattgtacctgtttttttttttgccttcttctttggtgatttgttgatagaaacaagtggtttttcaagta

SEQ ID NO: 44767 - DNA, 429 bp, Zea mays
  Clone ID: LIB3066-056-Q1-K1-H2
cggacgcgtgggctgacgcgtgggcggacgcgtgggcggacgcgtggggtcgggcgttacaagcaaatcaagcgaacagaaggtgtctcgagcactgacatagttgggaggatattgctaacattcaggcagaaagatgctggcactgatttaagtgttgtcattgctgagaagtctggagagaaatcaaatgatgaagtgaaaagcttggtctctcattttgttcatagataagagatctttgcaagatgatgttcttcattaatctcaatgtgcgttttacagcgtttctatgtcttaattacccatggatcaaaaatactgagactctcctgacactccccttgacaacgttgttctcgacaggctcaagcagtttagggccatgaaccagttcaagaaagcagcattgatgatcatagctgggtg

SEQ ID NO: 44768 - DNA, 429 bp, Zea mays
  unsure at all n locations
  Clone ID: LIB3066-056-Q1-K1-H3
ctgtctgctgttctcgcaccatctacaaagagcgagaagaaagtaaggagcatcttagaggagctctgcggcaatgcccatagtatttattggatccgaagacgacgtaggcgtcgccggtctgggaggtgaaacagaggcgcacccttacgtctccttcaccataaattttgtctgagaccggcatgttcctggccgtctgcggcccaggcaacatttcgagcagaactgccataaattctttgttgatttgtcggttcatgtgctcctgtaattcacatcacagagagaccagccgatcaataatgtagtttctgaggacatgtttccctgcagtattgcaccttgggagcgcattgtaaatggcctggaacagttgtctactggatttgtntatttatttacaataaaagccatgtgaaaataagt

SEQ ID NO: 44769 - DNA, 388 bp, Zea mays
  Clone ID: LIB3066-056-Q1-K1-H4
cagatcgcggcggaggccggcgcgtacgcgcggtggctcatcccgtcgctggccgcctacgtgccgctgcagtgccacgttcgcttcctgcagacgcagagcgtggtcctgcccgtggcggccagctgcggcgccacggcgctctgccacgtgctggtgtgctgggcgctggtgtacaaggccggcatgggcagcaagggcgccgcgctcagcaacggcgtctcctacgccgtcaacctcgtggtactggcgctgtacgtgaggctgtcgggcgcgtgcatggagacatggaaaggcttctcgcgggaggcgtttaaggacctgtggcgattcgccgagctcgcctggccggccgacatgatgatctgcttggagtggtggtcgtttg

SEQ ID NO: 44770 - DNA, 438 bp, Zea mays
  Clone ID: LIB3066-056-Q1-K1-H5
cggagtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcgtcgtcgtcgtcgtcggaggaggaggaaggccggcgagaaggagaaggagaaggagcaggagatggagaaggcggtcgcggcggagaaggctgcccagcaggagctgctcaagtacgccaaggagaagggcatcgtgttaccgaccaacggcacggggtggtacaagggcatcgcccgggagttcgtggacgcccacaacgagctccgcgcgcgctacggcgtgcc

SEQ ID NO: 44771 - DNA, 451 bp, Zea mays
  Clone ID: LIB3066-056-Q1-K1-H6
cggacgcgtgggcggacgcgtgggcggacgcgtgggcggacgcgtggggtcgggcgttacaagcaaatcaagcgaacagaaggtgtctcgagcactgacatagttgggaggatattgctaacattcaggcagaaagatgctggcactgatttaagtgttgtcattgctgagaagtctggagagaaatcaaatgatgaagtgaaaagtcagctatctcatttccttccaacttctcgccggatcatgcagttttcaaatgggcaggctccttcgccaggtgctcgtgttgtctatgtagatggcacatttgatcttttccacgctggccatgttgagttcctcaggagtgccagacaacttggtgactttcttcttgtcggtatctatgacgacgagtctatcacggatagaagaggctgtcggtctataatgcatcttcatgagcgtactc

SEQ ID NO: 44772 - DNA, 461 bp, Zea mays
  unsure at all n locations
  Clone ID: LIB3066-056-Q1-K1-G3
cggacgcgtgggcggacgcgtgggggcaagggcgcaaccaataatagcaagtgtgatcatccgttgatccatgttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcgcccaccagcgcctcctcggctgcgttcccggccgtcggcgccgtgctgagcgcctccgtgctctccttcttcgcctactacctgcagtaaaattaaaggaggatcggagggagaggctgctggctgccattgcctgtattcgngtggatcccgntatatatatatatatatatntaagtactntaatttgggtctgaacatgtcgattgatccattc

SEQ ID NO: 44773 - DNA, 415 bp, Zea mays
  Clone ID: LIB3066-056-Q1-K1-F10
aatagttctatctcaccgtaacaactgctcattacatcctttatgagaggctgatcgattggtagatacgtactcgggtggagcagagcaacgagagacatggcgacgacgacgcgtgttgccgccgacgacaccggcgtgctgctggtcctgtcggcgttggcgaccctggcgcgggccgaggacccgtacctgttcttcgagtggaaggtgacgtacgggaccaagtccctgctgggcgtgccccagaaggtcatcctcatcaacggcgagttccccggccccaggatcaactgctactccaacaacaacatcgtggtcaacgtcttcaaccagctcgaccatccgctccttttcacctggaacgggatgcagcacaggaagaactcgtggatggacgggatgccaggcacgc

SEQ ID NO: 44774 - DNA, 321 bp, Zea mays
  Clone ID: LIB3066-056-Q1-K1-F11
aaaaaggcaacaatcaaattgggaaacctggcttggctttacactgacatgttggtaatgacaaatcatcagaccagatctggcattcttggccaatgggtttgtatggcactctcctatctagcaagaaggatgttcatatggtcgagacagcatctatataaaaggtgtggctggtggaaaatggataattcaaaggaaatggaagaaaactggctctagtttagaaccggtgtaaatgcaggaggaagtctgactaatactattattctgttcattgtacacatgtaccattgtaccgaacgcagagaaatgcagcgc

SEQ ID NO: 44775 - DNA, 447 bp, Zea mays
  Clone ID: LIB3066-056-Q1-K1-F12
cgattaattattatatatatatgcatgctatctactatgatcgatcgcttctcgaccttcttgcatcgatctgcatgcatattataatttatattatattgatgccacgccgcatgcaggtctttccaaggcgtacgtactatatcaaattattttaatttccttacatgtatatgtatgtgctgctgttggatacgtacgtatatatatatgttctagggttttctcatccagaaaagttggataggaaagaaacagcacctcggaagaaacttgagacaaattggttgcaaagtgttactgggcagccaagaactcaagaaccaagctgtcggttatcacttaacgagaaattttctaattgggattctcctactttccgttcaaagagtactactggactaactgataaatcgagttgcaccatgttgcataaggataaatctt

SEQ ID NO: 44776 - DNA, 395 bp, Zea mays
  Clone ID: LIB3066-056-Q1-K1-F2
cccacgcgtccgcggactcgtgggcggacgcgtggaccaattactataatctggttaattatttctcagaaatggcttcatacaacaggtgaaaaagtttatgcgtgttctaaacatcaagtatccacctaccaaatgaatatttcatggtccttgttcatctagcacttacgtggcaccagtagtatacagatggctcatacttctgtcctactggatgcacatggtgttcctgatactcaagggttgcgtgacgccttggaacatcctcatctacatcttggagtacgattccctatacattactcatgtaccacgatcactaaactggacatgaagtctatggaacacgatagctcgacacatggtgctcggacttgttatagaaactgttc

SEQ ID NO: 44777 - DNA, 276 bp, Zea mays
  Clone ID: LIB3066-056-Q1-K1-F3
cacacgccacgcagcgcacgcgacccacaaattacacgcgcggttagaggatggcgatgaagcgtccacttgggcaattgaccccaccagcgaccgctgctgcttcgtttctagctcgagagagtttagagggctgcttgattccgaagctccgagctcgagggattgaattgagcccccccaagatcagaatctggagcaacgggatttggcttcccgcttggtgcccctgattggagtacgcttcttttagggcggatgagaagctgctcggct

SEQ ID NO: 44778 - DNA, 414 bp, Zea mays
  Clone ID: LIB3066-056-Q1-K1-F4
cccacgcgtccgctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctgatggaccggctgctgatgactccgccggtgctgctgcccttggaagtggag

SEQ ID NO: 44779 - DNA, 442 bp, Zea mays
  Clone ID: LIB3066-056-Q1-K1-F5
cccacgcgtccgcccacgcgtccgcccacgcgtccgcccacgcgttcgcccacgcgtccgtgcacgcgtccgcccacgcgtccgcccacgcgtccgagcaaacctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagacgagagcggcggagagcggcgaggcggcggatgcgaagaagatccaggacgacttctgctcgacgctgtgcgagggcaagaaggggacggacctggtcgtgtgcaaggagtcctgcgctctttccagcagtccaacctgtgctgtacggaggatccatgcaagggcagtgcaccgagcagaag

SEQ ID NO: 44780 - DNA, 455 bp, Zea mays
  Clone ID: LIB3066-056-Q1-K1-F6
aatagttctatctcaccgcaacaactcctcattacatcctttatgagaggctgatcgattggtagatacgtactcgggtggagcagagcaacgagagacatggcgacgacgacgcgtgttgccgccgccgccaccggcgtgctgctggtcctgtcggcgttggcgaccctggcgcgggccgaggacccgtacctgttcttcgagtggaaggtgacgtacgggaccaagtccctgctgggcgtgccccagaaggtcatcctcatcaacggcgagttccccggccccaggatcaactgctcctccaacaacaacatcgtcgtcaacgtcttcaaccagctcgaccatccgctccttttcacctggaacgggatgcagcacaggaagaactcgtggatggacgggatgccaggcacgcattgtccgatcctgcctaacaccaactttacgtacaagtg

SEQ ID NO: 44781 - DNA, 433 bp, Zea mays
  Clone ID: LIB3066-056-Q1-K1-F8
ggcgactgctacgtcgccaggagcggcatgttcatgctcgcgatggccctggtcctggtcacggaactgatcagcctcggcctcaacttggcgaccgaataggacgcggtggcctgggccacaacgctcagactagtgagaggcgatgagcgcgatgatacgtgcgtacgcggagctggcgtacgctgtacaactggactggcgatccaatcactacggcacgcacgctggcatgctggcagatgcaggggagaagcgcagcgccgaccaacaggaggctgctgataagcggaagggatagtgcgtgatgcataaggacacgaccgcgtacacaaccgtaagtagtaggcgttgagcgaactgaagtggttggacgaacgagcacagattgattatcgaatttatgccggtacgttagatctgctgcagtcgt

SEQ ID NO: 44782 - DNA, 443 bp, Zea mays
  Clone ID: LIB3066-056-Q1-K1-F9
gggcggcgagggaagggctccgcgtcgtgtcccttctcttcctcctcctctctccaacaccccatccatcagcgctgccctccgcattgctcttgataccatccagtacatcgattctccccccaagatcaaaggccggagaaggaggaagaaaggttagggagtcggctatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaaggaaattacaaaaaacttcagcagtgatgccctcattggcgagggctcgtatgccagagtctattttggtgtgctg

SEQ ID NO: 44783 - DNA, 433 bp, Zea mays
  Clone ID: LIB3066-056-Q1-K1-G1
cccacgcgtccggtagccgttgagacttgggaggcaggcgacatgggtggcgggaaggacgacggccacgatccctcgaaggcggacaagggattccacggaggagggtacccggccgccgccggtggatactacggcggccagtaccccggcggcggctaccctgctccaccgggcggcggtgcgtaccctcccggccctgggtacccggtaccacctggtgggtacccgcctccgggtggctaccctcagcctggcggatacccgccgtcgcacggggcgtacccggcgccgggtgcaggcgcgtatcctcccagcgggtacccccatcaaccggtctacccacagcctggctatccatcgatgcccggtcatggtggcatgtacggaagaggccacggtgcatggggctctgcaagccacggtgcgatgc

SEQ ID NO: 44784 - DNA, 421 bp, Zea mays
  Clone ID: LIB3066-056-Q1-K1-G10
cccacgcgtccgcggacgcgtgggggagatatgccgccacgcacgaggaaaatcgcgcgtaagtccactggaccgattggtgtacctcggcaccagctggctccgagacatgaggagagcagcagcggcagtaatgaccccattggagacctagaagcccaggtggagcaacttcgaatggagctacgtcatagaaactaggtgtgggtagaagatggtcagcgtataaatgagttaagagctgacatctgccatttgcaagacgagcttgttgaacgggatttggcaatcgattcggctatcaactcatgttccattgcttgggatcgagaagccaaagctcgagcccgtgtggaggagcttagcacggtcgtcgacaacttgcaggtgtactgcaatacattacatgaagaagttcatg

SEQ ID NO: 44785 - DNA, 411 bp, Zea mays
  Clone ID: LIB3066-056-Q1-K1-G11
actgccacgcattccgaatgacgagtctgcaccatatcttgacgctggcgagaattgtagagcgaatctgactgagttcaagatgaacgttagctaacgtgtgctccaggctcaggaaatgctatcaaagaagaacatgtcccagttgaatgagtatgccatcggcgtgctggaatcctcatccaattatctcatgccatcattctattgctaccccctagatatggacatcaacctgtgtcactcgtatagcacggatgggcctcactagacactactttcgacaggagctaatcctataaattcgaaagtgctgaatctcatgtaatgatcaagctgtcgaatgtgaactacatgctgcctgctactcaaaagatgtcctgcataaccacatgttctgctacctgcaac

SEQ ID NO: 44786 - DNA, 416 bp, Zea mays
  unsure at all n locations
  Clone ID: LIB3066-056-Q1-K1-G12
gccgcggcggggcgagacggcggtggtccccattgacgtggcgtccgccggcggcgggcgaggcgatgagcggcccaagagagagcgccaccggagtcacggccccggccgccacggtccgcaccggagtcgcccgccgcccccgcccccgccggcgttccggccgttccggcggtggttcccgttccttgtgccgctattcatcgtcgccaacatcgtcctcttcgtgctcaccatgtacgtcaacgactgccccgcgcacgcgcgggccaccggcgccgcgataggcggatcggtcggcgagagcgccaccgcgcagggctgctggctcgcgcccgagctcgggaggttcgcgttccagtcgttcaaggagaacccgctcatcggcccttcctccgncacgcttgttggaaatg

SEQ ID NO: 44787 - DNA, 465 bp, Zea mays
  Clone ID: LIB3066-056-Q1-K1-G2
gtggcgacttcgtgaagtcgctgctctctcccctgtcaacgctgctggttgctgggctcgtcgtccttgacggtgaaaagtgggtcaaacatcgaaggattctgaatccggcattccacgcggagaagctgaagggaatgctgccggcattcttagcatgttgcaacgaactggttgacagatgggagaaacagatctctgcttccgctgaaccaactgagctggatgtctggccagagttccaaaacttatcgggagatgtgatttcaagagctgcattcggtgttagctatgaagaaggcagaagaattttcctacttcaggcggagcaagctgaacgccttgttcaatctttcaagacaaattacatccctggcttctctctcctgccaacagaaaacaacagaaggatgaatgaaatcgacagggaggtgaagacggtcctgaggggcataatagagaaga

SEQ ID NO: 44788 - DNA, 381 bp, Zea mays
  Clone ID: LIB3066-056-Q1-K1-F1
cacaaaccacgcagcggaggcgacccacaaaaaacacgcgcggcaggaggaaggcgaggaagcatccccttgttcaattgaccccaccaccgcccgctgctgcttcgtttctagctcgagagagtttagtgggttgcttgattccgaagctccgagctcgtgggattgaattgagcccccccaagatcagaattggagcagcgggttttggtttcctgcttggtgccgctgattggagtacgcttcttttgtggtggttgagaggctgctcggcttccgccgaccatgtccgtgccggcgatagccgtgtacaccagcccgcccggcgccgtctacgcgccgccggagctcgagtccagctcgcgcggctcggcgccgtgc

SEQ ID NO: 44789 - DNA, 391 bp, Zea mays
  unsure at all n locations
  Clone ID: LIB3066-040-Q1-K1-B7
cccacgcgtncgaaaaggtttgaatttgctgcgcttagagtcagcagaagctatcttgggagcgactggtttcaaacctgaaaattgtctgcaaacagcaattcagccttctcttgaaggtattcctaatggtggtgtggatacggctacagaacatccgcctagcgtagataattaccagacaagctataatggctctgaatgggttgagctattagtcacagagatgagaaatgcttctgacataaacgatgcacgggctcgtgcgtcaagagctctggaggctttggagaaaacgattgtagagcgtgcaggagctgaagctacacaaaacctgcataaggaaaacatgatgctcaaggagcagttgactgttgttctgcgagagaac

SEQ ID NO: 44790 - DNA, 402 bp, Zea mays
  Clone ID: LIB3066-040-Q1-K1-B9
tcgatcaccggacgccttgtccgtttggcgtttaatttggactggccaagaaaatgcaaggggccctgcttgtgctgcaccttccgcaaaataaatgggtaggaagcccaaagggtaatggaaatggcaaaggaacagcacttcgtgcttgttcatggcgaaaggcatggggcctggtgctggttcaagctccgctggctcctcgagggcgctggccaccgtgtcacgtgcgttgacctggccggaggcggcgtcgatcctaccgaccccaacaccatccggtccttcaagcagtacgacaagccgctcatagacctcatctccaacttgccagacggagagaaggtgattctgatcggacatggcgctggagggctgagtgtgatccatgcaatgcatgaa

SEQ ID NO: 44791 - DNA, 197 bp, Zea mays
  Clone ID: LIB3066-040-Q1-K1-C1
ctctctctctcttatctccttccaagattcccccatttttttgttgttgtcccccccattcttgctaggatcattccttgatctttcgctcgctccagtacgcctgttttccagctccggagatcccatctcggccacctcctgcggtctccaagctccaagaggccagattccagcacaaatttgaggtcaatttg

SEQ ID NO: 44792 - DNA, 364 bp, Zea mays
  Clone ID: LIB3066-040-Q1-K1-C10
ggaaaacccggcgggacccacgcgtccgccgacgcgtccgcccacgcgtccgctgtgaggtgaaccagcagcctccaataaaatcgaccgcattcaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcaatgctggcctccaccgaggccgccgacgccggcgccccagccgcctccgagtcgtcggcgtccgccgaagcccccgctggcgccgccagcgccggcgccggcaccggcaccgccagagtgccctccgccagcg

SEQ ID NO: 44793 - DNA, 200 bp, Zea mays
  Clone ID: LIB3066-040-Q1-K1-C12
ggcaaggtcgtcggcctgccgatgccatcgtcctaccgcgccgtctagagcgtcgagggatcgcgcacggtgctgtacacaactaaaggagagcgagaggggactttttctcgcgtttccttctctagccagccttgtctgtcccctcctcgtttattctctctctctcttttttcgttcgcttccgaggaataataccc

SEQ ID NO: 44794 - DNA, 390 bp, Zea mays
  unsure at all n locations
  Clone ID: LIB3066-040-Q1-K1-C3
gagcccgagagcttcccttgccggcgagtattcagtccggctcacgcgatctgactttcgcggaggttcttgaatgtgatcgcatcattgcaacaaatccaagttaaacagattgctgacaacagcattgagcaagcattgatagaaaatcctcctaatgtgctgaaatggaagccatcagaaagagctaaacggtttcgacgatgcaggtcaactccctcagatcccaccgatcaaaaacctgcagaaaacggatctgtgcttaaagccaaagagttattcaaggagaaaaggccgagcttcatgcttgtaggcctcctccttttcgcctacctactagtgggtgtcatcatctnttacctattcatggatcaattatctgggaagaca

SEQ ID NO: 44795 - DNA, 373 bp, Zea mays
  Clone ID: LIB3066-040-Q1-K1-C4
cccacgcgtccggtctcggatgccatataggagttggtcctcatggactgcggccaggacggcgttgttccacggcctgaacaccaggcgccgcccaattgctgcgccaccgaggtcccgcagagcccgacgctctcttccgaagaattcctccagttcaagaggaaggccaccacgatcgtggaggagtacttctccacggacgacgtcgccgcgacggcgaacgagctgcgggagctccgcgtcccgtgctaccacttctacttcgtcaagaagctggtctccgtggcaatggaccgccacgacagggagaaggagaaggcggcggtgctgctgtcctcgctctacggcgacgtcgtcgaccgcccgcagc

SEQ ID NO: 44796 - DNA, 387 bp, Zea mays
  Clone ID: LIB3066-040-Q1-K1-C5
ggcgacggcaagacgacgctgcttcactttgttgtccaggagatcattcggtcagacgacgtgcgtgcggttcgggccgccaaagagcagagcaacagcagcatatccagcgtgacttctgacgatctcaccgaggatgtcagcgacgacacggagcactacaagcagctaggcctgggcgtcgtttccagcctgggagacgacctccagaacgtgcggaaggcggcaatcctggacgccgatgcgctgaccatctcggtggcgagcctggggcacaagctggtgaaggcgaacgagttcttgaacacgggcatgaagagcttagacgaggacagtgggttccatcgcaagcttggcgagttcatcgagcagtcccaggtgcgcgtg

SEQ ID NO: 44797 - DNA, 213 bp, Zea mays
  Clone ID: LIB3066-040-Q1-K1-C9
tttgtcctgagcatgtcagcaagtaaggacgtgcttgcccttgcttcactcgaggtggacctctccagcattgagccagggaccacggtgactgtgaagtggcgtggaaagccagtcttcatcagacgccggacggacgacgacatcaagcttgccaacagtgtggatgtggcatccctgcgccacccagagcaggatgcaaagcgtgtgaag

SEQ ID NO: 44798 - DNA, 386 bp, Zea mays
  Clone ID: LIB3066-040-Q1-K1-D10
cggacgcgtgggcggacgcgtgggcgctagcgagcgagagagacgcacatctatctgcgagcttacgccgcggcctcgatcagagtcagaggcgaacacccccatggcggcggctggcggcggcgcacgagggaaggtatccttcaagatcatcctcacctccgaccccaagctccctttcaaagtgttcagcgtgcccgaggcggcgccctttaccgcggtgctcaagtacgccgcggaggagttcaaggtcccgcctcagaccagcgccatcatcaccaacgatggaattggcatcaacccccagcaaagtgcaggcaacgtgtttctgaaacatggttcggagctgcgtctcatccctcgcgatagggttggagctgtagtca

SEQ ID NO: 44799 - DNA, 402 bp, Zea mays
  Clone ID: LIB3066-040-Q1-K1-D11
cccacgcgtccgctcaacagggagaacatcagtgaccggcatcctattcaggcataggcagtgatggcagggagtttcttgagcgcatgtcattgttaattatccttggcatgggaaaggtctttctggtcaggcctgttctcttctagctttccatttgttgcttcttctagtgccttattctgtttcaacacctcttccaatttcttcctgagccttcgattttctttgacatagttgtgcagccggtcaatgactaaagcaaggaataaggagtatcccatgagtgacgcctcgaggaggtgtcgcgcaagaaggacctggtcggtgggggtgagccccacgaccccggagccgtcgagctccccttcggcgtggccgcggatcttggccatgctgtgg

SEQ ID NO: 44800 - DNA, 370 bp, Zea mays
  Clone ID: LIB3066-040-Q1-K1-D2
gagagagagagggagagggagagtctttttctctacctgcccgacccgagcgccggcgcgatggaatggggcggcgagcaccaccacccgcttagcgtattcctccgggacgcgaggctcgcattcagatgggacgagctcggtcaggagatcatgaggatcgcggtgcccggcgcgctcgcgctcatggctgacccagtcgcctccctcgtcgacaccgccttcattggccacataggtccagttgaacttggagctgtaggtgtatcaattgccgtgtttaatcaggtctcaagaattgcagtgttcccacttgttagcgtcacaacatcatttgttgctgaggaggatgctatgtccaatggcagag

SEQ ID NO: 44801 - DNA, 189 bp, Zea mays
  Clone ID: LIB3066-040-Q1-K1-D3
tcgcgacgcgtacgactaggtctagatccctcgccgtcgcgctcgtccgcgtgctccgcggcgtcgatcttcccacattggccttcatgacgcctcaattctacaccttcttcgtcgggcccatcggcgcgctctacgcgatgtcgctctgggtcttcaacttcggctatatctacctggccggggcat

SEQ ID NO: 44802 - DNA, 334 bp, Zea mays
  Clone ID: LIB3066-040-Q1-K1-D4
atgctgctctatgtggctgcctttgctttccatgcagccacaaggctggcccgcaggtgcgggttcaggccaccatgcatcctatccacgaggctggaccgcgccctccatggaaacttgtcatggttctacgaggacctggactgtatcatgcatgagcccgaggtctcgtctctggctcattgcaagagccaaggccggcttgcacggtacagcgatttcattgaataatgccttccatcatgcaacttggagctggtgccctataagaggccgtgtactatcaggcttcaacaattagcaggttgtcacttgctagcggcacaacatcatt

SEQ ID NO: 44803 - DNA, 351 bp, Zea mays
  Clone ID: LIB3066-040-Q1-K1-D5
gcggagcccacgccttgactcgctcctttcgagtggagcgcacaggcaccggccgtgtaccagttagggagcggatcgagggggctcggcttgagtggaggagatggaccgcaaggatgtctggatcctcgccatggacatctacttaccgtcctcctgcgtgcagcaggaagcacttgaggcccatgatggggcgagcaaaggcaagtacaccattgggcttgggcaagattgcatggccttttgcagcgaggtggaggatgtcatctcaatgagtttgactgttgtcaattctctgctgaaaaaatacaagattgatcccaagctaattggtcgcttggaggtgggaag

SEQ ID NO: 44804 - DNA, 172 bp, Zea mays
  Clone ID: LIB3066-040-Q1-K1-D7
ctttctttctcatcttattaaaagagatttggcacgaggaactacattgaccaaaacctttggggcccttcaatgtctgttagcggtggcattaatgttccagtgattccgactccgctttttgccaatgcttcagccgagaaaagtggcaaaaacttcatgattgatttca

SEQ ID NO: 44805 - DNA, 296 bp, Zea mays
  unsure at all n locations
  Clone ID: LIB3066-040-Q1-K1-E1
ggaaccaccactcccggggccaaaatgggaccgggggaaatcctagcttgaggtgccgccgccgccgctgctgcttacngagcacacaagctttctcatggccatagcggacacggtggacatgggccctttggaggccatggtcgtggtcgtggtggttatggccgtggtcgtggccaccacggcaagttcaagcatggcaagcatggacacggcatgttcggcggcaagttcaagaagtggaagtgatgtgttgatcgtaactagcggtggtaatggatcacgatttaaatgtt

SEQ ID NO: 44806 - DNA, 265 bp, Zea mays
  Clone ID: LIB3066-040-Q1-K1-B6
cgcacgcctccggcgaacaccaccattttccctgcgatgcctataccaatcccggcggcgctctttcggggacgatgagctactacaatccccacggccatggcggcgcgcccccgtcttcgccgagcccctcccagtatgcgcccccgccgtctccccaagggtacccaatggacccgcacgcggagcgcgggatggagcaccaccaccaccaccagtacgggccgtcttcgccgtagccgatgtacgcgtcgtcgtacgggca

SEQ ID NO: 44807 - DNA, 236 bp, Zea mays
  Clone ID: LIB3066-040-Q1-K1-E10
acgaatcctgctgaatctacaggcactaaatgggtatggtgtaattaatgagccgcgttgtatttaagccagctagtcattatagtgatatgttaactggggtattcattatttctgtaatactgtcaaatcttttttctaatttctctattaagccgagatatgtttctaaaacaaaaatatggaaaaaaaccttcacgtgtatagcattctacaacacaaaatatttataactg

SEQ ID NO: 44808 - DNA, 370 bp, Zea mays
  Clone ID: LIB3066-038-Q1-K1-H2
ggacggacgggtacttcgtgccggcgctgttcctgaacccggcgtaccaggacgagctcgacgggatgttccctcggaaggactcggtgttctacctcctggcgcactacctgttccacccgacgaacgaggtttgggggctggtgacgaggttccacaggtcgtacctgaggggctcggacgaaaggctgggcatccaggtgagggtgttcgacggagacgccccgttccagcacatcctggaccagatcctcgcctgcacttcgcaggaacacctgctccccgacgtggcggtgacgcaagagccgtcggcgggccgcggcgcgcggtccaaggccgtcctgatgaccggcctcagctcgtggtacta

SEQ ID NO: 44809 - DNA, 411 bp, Zea mays
  Clone ID: LIB3066-038-Q1-K1-H4
cggacgcgtgggtgacggtgctgctcctcctctctctgctcgccggcggcgcgtgcctcgcggcctacgtcctgctgacgacgcaggagacgccggcctggctccccgccgtcggcctagcgctcgtcgcgctcccgtgggcgttctggatcctcacttgcgcgtaccggtgcgccgccgcgcgggccgcggagcgcatgacgatggccgtggcgccggctgctggtagcatgtgctcgcgctccggctcgtgagcagtaaccgtaagacacttagccgtgcgaattcactttcaggtcaattgttacatgatggttctatacacgtcattgcattaagaaatcaagatcatatacatgctggtatccgtccgtccttaacagtatttaacgatcgctgaagctgcacaac

SEQ ID NO: 44810 - DNA, 360 bp, Zea mays
  Clone ID: LIB3066-038-Q1-K1-H5
accacgcgtccgctcacgcgttcgacgacgcttggggcgccgtccagctcggcgaccgtgtgtcgctgggagaacgaggtgctccgacttgtcgaggagtgcagaggcgttgtcatggacatccaggaggagatgccggcggacgacccggtgttgcgtccctggcagatggcctacccggctgccgtcatgcccatcggcgccccggacatgctccactactgatgattgccttcaccaaccacaccaccatacatctgaggctgtcagctggggctggttggcaacaatacaagaagaattggctgcctgttaacaacattgacatctactacctacctggctgctttgagaattaca

SEQ ID NO: 44811 - DNA, 58 bp, Zea mays
  Clone ID: LIB3066-038-Q1-K1-H6
cccacgcgtgcggtgagattgctgttacttttaccggcgaaccgcgaccacctcggag

SEQ ID NO: 44812 - DNA, 411 bp, Zea mays
  unsure at all n locations
  Clone ID: LIB3066-038-Q1-K1-H7
cggacgcgtgggccgctctcgtcttcgccatactcatgaccgccgccgttgcggagcaggggccggcgcccgcgccaaccagcgacggcacatcaatcgacctggggattgcgtacatccttatgctggttgccctagtgctcacctacctgatccacccgcttgacgcgtactgcccctacaagctcttctgatccctgcgcctttccgtttggtcatgcggntaagggcgcgataggattttgagttaggcaacgtgcttatgtgaggctgggaggtttaggatgatgattgcggtcatctggtcttgcttggtatgatgtattggaggctcgaagctgctggtgttctgattgagtttgtatcggacggactccatgatctttgagctcagtccctcagttctgctct

SEQ ID NO: 44813 - DNA, 385 bp, Zea mays
  Clone ID: LIB3066-038-Q1-K1-H8
atcgacggcaagctccgctacggcttcaacggcatctcccacagggacaccgagacgccggtcaagctcgccgagtacttcaacgtcaccgacggggtgttcagctacaaccagatgggcgacgtgccccccgccgttaacgggccactccatgtcatccccaacgtcatcaccgccgagttccggaccttcatcgagatcgtcttcgagaaccccgagaagagcatagactccctccacctcgacggctacgccttcttcggcgtcgggatggggcctgggacttggtcgccggagatgaggaagacgtacaacctactggacacggtgagtccggacacgatccaagtgtacccgcggtcatggactgcgataatgctggcat

SEQ ID NO: 44814 - DNA, 311 bp, Zea mays
  Clone ID: LIB3066-040-Q1-K1-A10
cccggcgggagccacgcgtccgcccacgcgtccgccgacgcgtgggtggtcgtcggggtgtactgcgcgagcaggtatggagctgttattggcaaccggcgtcatgcgccgaaaatggaagtcgaggacctgacggccggactggccagcggcaggatatgtgctgaggagaacatcgaccagctggtggctcctgaggcagaacgcccagccgatgccacggtcacggacacgctggctgattaacggaccattgtgccattgttgctgcgagagagatgtgcgtcagccaacatgtgtgctattgcttt

SEQ ID NO: 44815 - DNA, 368 bp, Zea mays
  Clone ID: LIB3066-040-Q1-K1-A12
gaccatccctgcaaattaccgcgatggtgcccaagatcctagtcatccttgtgtggcgcgccgttgcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttcttagttacttcgaccgcatcaagctggacgagattgagacacgcaccagcatccttctcacgctgctcttcgtcaccgacaag

SEQ ID NO: 44816 - DNA, 330 bp, Zea mays
  unsure at all n locations
  Clone ID: LIB3066-040-Q1-K1-A5
gcacacagctcatcagttcttcttcgttgtcttggctagctgcctagctagctagctggttcctcactcctctccgagaaccccctttttcatctctctctctcgcctagctcctttcgcgatgttatcttctctgctggcctcacaactcgagagagactcgtgaaaagaatccagatatataaagagatcgagggcagctagcttaattattagcatgtcgatgagcttcttgagcatggtggaggcggagctgccgccggggttccggttccacccgagggacgacgagctcatntgcgactacctcgcgcccaagctcggcgccaa

SEQ ID NO: 44817 - DNA, 337 bp, Zea mays
  Clone ID: LIB3066-040-Q1-K1-A6
cccggcgggacgcacgcgtccgcggacgcgtccggcgcgcgccatcgattgtgtggggaggagggtggggcggaccctcggccatttgggatttgtgcgcgccattgacggcgtggggaggagggtggggcacagcagatggggaggagggcgcgatggggtggaacctcggcgacctaccatcgacagcgtgggcgttgatggcaacctcggatgatggggatcgtagagctgaggggtaggggatccttgacacctgcctttgatggtggggtaggagatccttgtcacattacgacgatggtggcgcggatgacaggcgttggtgcctgcacgc

SEQ ID NO: 44818 - DNA, 367 bp, Zea mays
  unsure at all n locations
  Clone ID: LIB3066-040-Q1-K1-A8
acgagccacaccgnncccatctacgagggatatgcccttccccacgccattcttcgtcttgggctggcccggcgggaacttaacgacttcctggtgaaaaatccggcttgaccgcggtcctctttaacaaccaccgctggacgggaaaatcgtgagggacatgaaggagaagctcgcctacatcgccctggactacgaccaggagatggagaccgccaagaccagctcttccgtggagaagagctacgagctccccgacggacaggtcatcaccatcggcgccgagcgcttccgctgccccgaggtcctcttccagccatccttcatcgggatggaagctgccggcatccacgagaccacctacaac

SEQ ID NO: 44819 - DNA, 381 bp, Zea mays
  Clone ID: LIB3066-040-Q1-K1-A9
cccacgcgtacgaccagccttcgcccaagcgttcgggctttccttcgggaaaggaaccaaaccagccggggcaaccgtgccgtcttcggttcttccatccgtcctaaccccggaaagtattcgaccacggaagcagcataacctccgtacatcccatccccggtcgcctgtactgtactcgtcccgctctagacgatcgatggccgccacggcagcggaagagatggaaaggattgtggaggcggaatgggatgagggtaagcaacggatgaggcataagcagcggcgccgaccgcttgcgctgccggcacggcctgtttcactcatgctcaatggggatggaagctgccggtatcgacgagagcagctacaactgcatga

SEQ ID NO: 44820 - DNA, 400 bp, Zea mays
  Clone ID: LIB3066-040-Q1-K1-B10
cccacgcgtccgcggacgcgtgggtttggctaccctcgtcgtcgtctcactcacccggccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagc

SEQ ID NO: 44821 - DNA, 417 bp, Zea mays
  Clone ID: LIB3066-040-Q1-K1-B12
cccacgcgtccgcccacgcgtccggtatgacaagctggtgctcgccgaggaggagctggcgcgtttcagatccgcgggcaaccacgcggtctccggtgacggcggagacgtcatggcccgtgccgtctgcagcgggagcccgagctcatcgttctcgactggcacctgccagcagcccggaggaggcggcggcggcggcgatcacctgggggacgacgacctgctctatgttcctgactatgcctacgctgacagcagcgtggtcgagtggtttagcctgtatggactgatgtaatcgatggtatggtatgccatcgtcgtcggcagattaattctagctagctactcatcgtagcgtgtcattgctgtgctgaattgctgatttctatgtgcgccctcttaatcatatgtgcataa

SEQ ID NO: 44822 - DNA, 305 bp, Zea mays
  unsure at all n locations
  Clone ID: LIB3066-040-Q1-K1-B2
ctctagctatttgtcccccctagctcgtttgttctctcgtcccgtcgtccggttcatttccgcttccgaggaataataatcaaccaaaggggctctgctctatctcaagaagacttcattcatgtgggcaccagcagtcactcactgccaggggcgggcgaccagggagattaagaggcgatggtccgcttcaatgcatgcatgcggatatatgcatgcgtaaacacatcgagacgccgnaaaattgntcttttatatttatgtatatgtacatgcatatgtctnctgattcaactttgatgttt

SEQ ID NO: 44823 - DNA, 235 bp, Zea mays
  Clone ID: LIB3066-040-Q1-K1-B4
ggcctagctcgctacggcatccatcatttgaacgaggagcaggatacaaacaccgtgccgccatacacaggtacgcaagaacgccactaacatggctaggctgcccttgagagcataggtggttctgtgcctcctgtttgcgacgcgggtcgcagggagccatcatcgtcaaggggatggtgtcattcgacaattggatcatctgcaaggtactggacaacttgaacaagaacct

SEQ ID NO: 44824 - DNA, 358 bp, Zea mays
  Clone ID: LIB3066-040-Q1-K1-B5
cgctcgtcgcggcctggctgcccggcacggaggcgcagggcatcaccgacgtgctgggcggggactatgggttcacggggaagctgccgcgcacgtggttcaagtccgtggaccagctgcccatgaactacggcgacaagcggtacgacccgctgttcccgttcggcttcgggctcaccaccaaggctgccgcgagtcacgattagcaattagagttagactctgcttttgctttttcggtgttgatgaaatagttagcgggaacggcaaataagcacttttttttgtagaagatacacaaagctttttttttgtaggtgtagttaaaaaagaatgataaaataattgatttaggcct

SEQ ID NO: 44825 - DNA, 316 bp, Zea mays
  unsure at all n locations
  Clone ID: LIB3066-038-Q1-K1-F12
cccacgcgtccgcggacgcgtgcgatcattcgtgcgctaccatctccgtccacctcatggatacatcaatcagcatgttctctaatcttctgcccatcgatgactctgatcaaattcttctatcttcaccaagcaacggaagattcaaaaatgatgccactgaacatattgctcttgcgtccttcaaccatgcaaaggacaataactatttctataatctntcatgtaaattattaacactcaatgtaatgcaaaaagtagcatatgacaaaagcttcaatcagcctttgtcttgcagaaactattcatccacttc

SEQ ID NO: 44826 - DNA, 376 bp, Zea mays
  Clone ID: LIB3066-038-Q1-K1-F2
cgctgctctgattctcgtcgtcgccttggctacatgtacaaacaagtttgttgatgcacgcgtggtccaccctatcgtcaccctcgaggccgacggctcatcttccacctctggcgatggtcgtcgcctgatcagctccaccaaccaagatgaacttggagcgctatgccaactgatgcactacaagacgttgtgctccacgatgactactctgcctggggtgactacgccagatcaactctcagatgcatccctgcggattacatcgctgaaggcatcgatcgctgacattaagctcgacattgcaatcaatgcaggcagtgctcacggtaactcgatgatgtccgcgctatagacacgcaaggagagcttcgcg

SEQ ID NO: 44827 - DNA, 420 bp, Zea mays
  Clone ID: LIB3066-038-Q1-K1-F3
cccacgcgtccgattcactaacccaagacataacatggatgtgaatgtgagaaccatgtggtcgtcgatgcgggcacaggttgcgatggctgtggtgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacattacggacatgaacta

SEQ ID NO: 44828 - DNA, 316 bp, Zea mays
  Clone ID: LIB3066-038-Q1-K1-F4
accaagcgtacgctaatatggcgctgctcgtagcctgggtgcgcctgcgccaccgactggggctgcgcacccggtacatgtcgaccacgttgtggagatacgcgtctcctgtcgagacggcgtatgatacggtgatcccagacgtcatcacaggcgagaccatcacggtcacgctctggcacggactagctggacgctgaatcgacgatgcatctgcagccgagcgttaccgggtccgatctcgacggtggtatctgcggctacgaggacctgaacaatgccgctcttgcatattatgatgggcatgcgctaacat

SEQ ID NO: 44829 - DNA, 381 bp, Zea mays
  Clone ID: LIB3066-038-Q1-K1-F5
tgtgtctcctctcctacctccccgtctccctgcctggaagagaccgcaccagctcgtccgggagttccacccccaatccccacagcttcccgcaccaactaatccgcccaatttgcgggccactcccggcggaaattcgtgacaaagccgcggttttttcttccttttttctttcgctcccccgcccccgttttcccttttgactccgtcgccgggtctgctcctttattgctgcgcctgcctgattgtcttttctcgtctgaacgcgcggtattccgagggcggcgaccgcggattcgcctacggaagcggcgatttggtccacaggtggcgaaaggatgatggatttggggagattgctctagctagcgtggttctgat

SEQ ID NO: 44830 - DNA, 381 bp, Zea mays
  Clone ID: LIB3066-038-Q1-K1-F7
cccacgcgtccgccagcccgcccctcaacctcacccagcgcgacgaagccggggggcgagggctccagcgccgccgcgccagcgacctcaccccccgggagccgccggcggtacccccctccctatcacgcctcatcgaatcctcaggtctaagtttttttttgttttgtgagttatccaaagttggaccgcaaagatgagtactgctaatcactatcagcacatcaagtgaaccaagcctgttgtaggcaaagcaagaaaattgaaggatctcatgataaaaagtgataataggatatgtgctgactgttgtgcacctgatcccaaatgggcatctgctaatattggagtgtttctttgcttaaaatgtggagatggtca

SEQ ID NO: 44831 - DNA, 429 bp, Zea mays
  unsure at all n locations
  Clone ID: LIB3066-038-Q1-K1-F9
cctcagccaaggactggagaggtggcatggctgccagctttaacatcattcctagcagcgaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgtggaagaggatctggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgncacatgttcaag

SEQ ID NO: 44832 - DNA, 205 bp, Zea mays
  Clone ID: LIB3066-038-Q1-K1-G10
cggacgcgtgggcggacgcgtggtatctttgcggccctttttttttcttatttcgcgtgtaaagatcaatcagcatgtcctaatctatgctctccattgttgccgcacatcaagtgtcttgatgttcaccacgttactgtacatacaaaattcttgcgtcttagcatatcgctcttgcgttattaaactggcaaaggaaaatgac

SEQ ID NO: 44833 - DNA, 338 bp, Zea mays
  Clone ID: LIB3066-038-Q1-K1-G11
cccacgcgtccgcccacgcgtccggaaaaggggcatgggacacatcatgatcatggtatggtcttgttcctgcaaggacaaaaaacatagattagttatcttcagcatgtatgttcttttcttattttacacaactagcaaacatacgtttgtgtagcaagttagcaacagaatgcacagcttgttatgtagtcacatgggcgatttgtggcttggagatttattcaatgatcgtgccatctgttgcaattaaaaaaaaaaaaaaaaaaaaaaaaaaaaaaaaaaaaaaaaaaaaaaaaaaaaaaaaaaaaaaaataaaaaaaataaaaaaaaaataa

SEQ ID NO: 44834 - DNA, 274 bp, Zea mays
  Clone ID: LIB3066-038-Q1-K1-G12
gtccgccgacgcgttcgcccacgcgtcctgttttatctcaccgcaacaactcctcattacatcgggatatgttaagctgatcgattggcagatacgtactcaggtggagcagagcaacgagagacatggcgacgacgacgcgtgttgccgacgacgacacctgcgtgctgctggtcctgtctgcgttggcgaccctggcgcggtccgtggacccgtacctgttcttcgagtggaaggtgacgtacgggaccaagtccatgctaggcgtgcccca

SEQ ID NO: 44835 - DNA, 249 bp, Zea mays
  Clone ID: LIB3066-038-Q1-K1-G2
cagccccatatccatgttccaggtgacttttctcaagtgcggcggcgtggtgctaggaaccgccatccaccacgcggccatggacggcgtgggcgcgttccagtttatgcagacgtggtccggggtggcacgcggcctggacgtggcggaggcgtgcgggccgcagccgttccacgaccggacgctcctgcacgcgcggcgcccgccgtgcccgacatccgaccacttcgtctactccccggcgttcct

SEQ ID NO: 44836 - DNA, 386 bp, Zea mays
  Clone ID: LIB3066-038-Q1-K1-G3
atcaccgcggccagcgactacaaccagtcgctgcagttccgggacctggacagggagaagaagaagatcgacatgcaggtcacccgcgacggctaccgccagatagtgtccatatatgacattgtcttcggggatatcgtccacctgtccatcggcgaccaggtgccagcggacggcctgtacatcgacggctactcggtagtggtcgacgagtcgagcctatccggcgagagtgagccagtgcatatgtacagtgcaaaacctttcctgctcggcggtaccaaggtgcatgacgggtcggccaggatgctggtcaccgcggtcgggatgcgaactgagtggggaaacctcatggaaacgctgagccaaggctgtgaggacgagac

SEQ ID NO: 44837 - DNA, 394 bp, Zea mays
  Clone ID: LIB3066-038-Q1-K1-G4
cccacgcgtccgagcagcatctcgagtaacacagttgagcacgacgatgggatccctcgcgaataacatcatggtcgtgggcgccgtccttgctgcgcttgtcgtcagcgggtcgtgcgggccccctaaggtgcctcccggcacccaacattaccaccaactacaacggcaagtggctcaccgccagggccacctgttacggtcagcccaacagtgccggcgctcctgacaacggcagtgcgtgcgtgatcaagaacgtgaacctgccacgctacagcggcatgacggccttcagcaacgtgcccatcttcaaggaccgcaagggctgatgctcatgctacgaggtgagatgcatggaaaaacctgagtgctcgggcaatcctgtcacggtgtt

SEQ ID NO: 44838 - DNA, 167 bp, Zea mays
  Clone ID: LIB3066-038-Q1-K1-G5
atttcttcgtttttagggaaatttggatccataccattaaaagatcaccactttggggccggaccattactatcttacttacatgagggcccacattaatcaatgacatgtacggtccatgatatatatctaaagtttggatcttttaatggtaaaaaaaacaaaaa

SEQ ID NO: 44839 - DNA, 478 bp, Zea mays
  Clone ID: LIB3066-038-Q1-K1-G6
cccacgcgtccgctctaggctccggttccggaaacagcgggcgccattcccgggcgaggaggccggcccagatccgagtacggcggcggcggctgcggcggcgagatgactggtggcggcccggccgcggcgtcgcaggcgtacggcgaggcatggtactgggacgagcgctaccgcaaggaggccgggcccttcgactggtaccagaagtacccggccctggcgccgctgctccgcctctacctcgcgccgcaccaacgcctcctcctcgttggctgcggcaactccgtctttggtgagaacatgattgacgatggttatcaagatgttgtcaacattgatatatcttctgtggtaattgagcaaatgaagaagaaataccacgataagcctcaacttaaatacatgaagatggatgtaaagaacatgtcagattttgagtctggttcttttgatgcttgtattgacaaaagaacac

SEQ ID NO: 44840 - DNA, 364 bp, Zea mays
  unsure at all n locations
  Clone ID: LIB3066-038-Q1-K1-G7
cggacgcgtggggtgaaacactatcttaaactagcaatactgcgaacgtcacatgcatcgtggccgcaagcgtcctgtacaggttttcctggaggacgacgagccctattctgcttcagggtcaaaacccgccgctcctggcaaggctaccgaaggtgccaagaaggccgatgacaagagcccaagcagcaagaagcttgcagtggcagctcctgccgctgtgcagtctacatagtcaattgcagctttagtagcccgcataaagagcataacagcgctggcaactggcgccttcatatngcatgtaatccccagaagactttagtctggtcgtggtcgtaagtataacctcgttcccagcgtc

SEQ ID NO: 44841 - DNA, 343 bp, Zea mays
  Clone ID: LIB3066-038-Q1-K1-H10
gtgttccattccttgacaaaagtttcatttttgtagcaatggacattgatcctgaatggaagatgataaaacgtgacctgggtcgaattgagaaatgggttatccgtaatgcatttgatgatgaggagaggccctatttacctaagcacattctctacaggcaaaaggaacagttcagtgatggtgttgggtatagttggatcgatggattgaaagaccatgccagccaacatgtcttcgattccatgatgatgaatgctggctttgtttacccagagaacacacccacaacaaaagaagggtactactacagaatgatattcgagaaattcttttccaaacc

SEQ ID NO: 44842 - DNA, 431 bp, Zea mays
  Clone ID: LIB3066-038-Q1-K1-H11
gttcagatcataacaaaaatggctgctgccaatggagtaagacgtgtttgggttggacaaaacagtctcatgtctactcctgctgtatctgctgtcatccgtgaaagaattggtgcagatggatcaaaggctactggtgccttcatcttgacagcgagccataacccaggtggtcctacggaggactttggtatcaaatacaatatgggaaatggtggacctgcccctgaatccgttaccgacaagattttctctaatacaacgacaatctctgaatacctcatctctgaagaccttccagatgttgatatttctgttgtcggtgtcaccagcttcagtggacccgaaggcccctttgatgtggatgtctttgactctagtgtaaattacataaagttaatgaagacaatttttgacttcgaagcaataaa

SEQ ID NO: 44843 - DNA, 421 bp, Zea mays
  unsure at all n locations
  Clone ID: LIB3066-038-Q1-K1-F11
cttctcccccgcggccatccgcttctacattgccgagatcgtctccgcggtcgccgagcgccacgccgcgggcgtcgtgtaccgtgacctcaagcccgagaacgtgctcctccgcgccgacggccacgtcacgctcaccgacttcgacctgtcccgcctcctccaccccagcaggtcgtccgcggagtcgtcgtcgcccccgcggccagcgtcgtcccgcggccaccacaaccgccggtcgcgcgtccccgcgcggagcgactcggttctcagccagcaggtcaagtcgtactccaactccaacaactccaggccccctcaccagccctggtccgcggcgtcgtcgccgcggcagcagctccagagcctggtccgctacatcatggggagcggcgacgggaccggngtgggcaggaagagc

SEQ ID NO: 44844 - DNA, 392 bp, Zea mays
  Clone ID: LIB3066-053-Q1-K1-A12
cgcctgtcttgctgaagctgaactgctgatccgtcttccaagctgtggtgtcatcccctgagttctgatccaagatgtatctccagtattacatcaatgagaagggggacaaggtctacaccaccaagaaggagtcacctcttggggtgccgacgcagtctgctcacccagctcgcttctcaccagatgacaagtactctcgccagcggtacctgttgaagaagagatttggacttctgccaacgcagaagccagcactgaaaataggtatctgaggaaacatatcaaacactgctaggcactactatgacatctcagcgcattcaggcactatatgtaatgctatgtgtttgacaggtctcaagtgctaatcaaggagggtaacagctttg

SEQ ID NO: 44845 - DNA, 449 bp, Zea mays
  unsure at all n locations
  Clone ID: LIB3066-053-Q1-K1-A2
ggcggcgcgcgggaggaagctcaagttcgacatcatccccacggtgcacctgtaccggcacgaccgctgggagctgccgagcctggcgcgcgtcgttggcgagcgcgagtggtacttcttcgtgccccgcgacggcggcgggcgggcggccaagcagcagcccggctccggcggccggcctagccgcaccacggagcgcgggttctggaaggccacggggtcggaccgcgccgtgcggtgcgccgncgaccccaagcgcctcatcgggctcaagaagacgctcgtctactacgagggccgcgcgccgcggggcaccaagacggactgggtcatgaacgagtaccgncttcccgacgctgccgacgctagcagcgacgcgcgcgtgccgcangtggacgtggtgctgtgcaaggtctaccgcaaggccgtgtcgctcaaggagctggagc

SEQ ID NO: 44846 - DNA, 467 bp, Zea mays
  Clone ID: LIB3066-053-Q1-K1-A3
ccaagatccaggacaaggacggcatcccaccggaccagcagcgtttgatcttcgctggcaagcaggtggaggatggccgcacccttgcggattacaacatccagaaggagagcacccttcacctggtgctccgtctcaggggtggcatgcagatctttgtgaagacactcactggcaagacaatcacccttgaggtggagtcttcggataccattgacaatgtcaaggccaagatccaggacaaggagggcatcccaccggaccagcagcgcctcatcttcgccggcaagcagctggaggatggccgcaccctggcggactacaacatccagaaggagagcaccctccacctggtgctccgcctcatgggtggcatgcagatttttgtgaagacattgactggcaagaccatcaccttggaggtggagagctctgacaccattgacaatgtgaaggccaagatccag

SEQ ID NO: 44847 - DNA, 385 bp, Zea mays
  Clone ID: LIB3066-053-Q1-K1-A4
cactgaaccaccctataaagcgcggggtctcagtctcaccggcacgtattcaatcccagtcgcacgcatagtatctcctagagcctcatctcctccctctctcgagccaagagcagagcagctaccaaacaagctctactttcgcttccgatccatggagctcgacgccgacaacctgagcgccaccgagctccgactcggcctgcctgggaccagcagcagcagcagcgacgactggcagaagaagccgtcgccctccgtcggggccaagcgcgctctggacgacggcaccaagagcgaggcctcggggaccagcccggacgacagagacctcgacttcgaccacgaccacgacaccgtcgagccttccaaggcgcaagtggtc

SEQ ID NO: 44848 - DNA, 64 bp, Zea mays
  Clone ID: LIB3066-053-Q1-K1-A5
cccacgcgtccgcccacgcgtccgcccacgcgtccggttctagatcgcgagcggccgctcggga

SEQ ID NO: 44849 - DNA, 453 bp, Zea mays
  Clone ID: LIB3066-053-Q1-K1-A6
cactgatccaagacaaaacatggctgtgaatgtaagcaccatgtggtcgtcgatgcaggcgcgaggtggcgatggctatggcgttggcgttcttggtgagcggcgcctggtgcggtcctcccaaggtcccccctggcaagaacatcacagccacctatggcaaggactggctggacgctaaagcgacatggtatggcaagccgacgggtgccggtcccgatgacaacggcggcggctgcgggtacaaggacgtgaacaagccccccttcaatagcatgggcgcgtgcggcaacatccccatcttcaaggatggtctgggttgtgggtcctgctttgagatcaagtgcgataagcctgtggagtgctccggcaagcccgtggtggtgcacatcacggacatgaactatgagcctatcgcggcgtaccacttcgatttggcaggcacggcgttcg

SEQ ID NO: 44850 - DNA, 440 bp, Zea mays
  Clone ID: LIB3066-053-Q1-K1-A8
gagcaaccaatggttaaccttgaaatgtgcatgactggtctggacaagaagaaagcttctggctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcagcgggcgtggccatgccgggacatggggaaaggcacttggtgcagaggtctatgactgcaacaacatggt

SEQ ID NO: 44851 - DNA, 398 bp, Zea mays
  Clone ID: LIB3066-053-Q1-K1-A9
cttgtttgcgcctcgccgttgattgatgcgctcactcatctcacatgggtgggactctttgctcttggagcaccacctgtctagtgggagctactccagcctctagacaccaactccagcgcccccgtatggaacaacaactccaccctcactgtctggacagcaagattcattcacctgtcatatagtttcatcgatgaatctgaaacttttattgttcctgtgttgcccctatccaaaggtcatgttccttggatcaactgtaaggtgaaccttttatcctgatattatgatgtggttatgtattctattttctcaacagtaggagtacattctaaagatcataggttagaaatcttgcgccataagatagctgctaaagaaaatgaactaaaagg

SEQ ID NO: 44852 - DNA, 463 bp, Zea mays
  Clone ID: LIB3066-053-Q1-K1-B1
cccacgcgtccgcaagaccgtcgaccagtactatgtcggatccaacaacagcatccagggcgcgtgcgtgatgaacaccctcgactccgtggtcgacgcgctcgccagggaccccgcccgcaagttcgtcgtcgtcgagcaggcttttttccaaaggtggtgggcagagaaaatcccaaacattcaggcagtagtccgcaagctcgtggattcgggtcagctagagttcataaatggtggatggtgcatgcatgatgaagctgctgtccattatattgacatgattgatcagaccacgcttggtcaccggatgatcaagaaacaattcaacaagactccaagagctggctggcaaatcgatccttttggacattctgcagttcaagcttatttgcttggagcagagcttggcttcgattctttgcattttgcaagaatcgattaccaagataaggaaaaagcg

SEQ ID NO: 44853 - DNA, 389 bp, Zea mays
  Clone ID: LIB3066-053-Q1-K1-B10
gattgaggtggcatcaggacagacataggtggctgggatgggagttcttgcctatttctgtggccaggcaacaatgttaaataaaaggaatgtgttatattgtgctttcaagatgataaattgtggcaaccaggttttgattatgtaggcaatattttgacaagctactcttatccagcatgaatgacttcatgttagtgcgattgagtagatgttttacttctgttgccatcaccagttcaacgctgtactttcaattgattcggtcccgtgttttctagtttgcgttgttacagatgaatttgacttaagttttattgataattctatttgtattgcttgcaattagaaattgcaatgtgggtttttggatgtatctacgtgccacc

SEQ ID NO: 44854 - DNA, 399 bp, Zea mays
  Clone ID: LIB3066-053-Q1-K1-B11
accacgcgtccgacctcagacagacttcctgagagccatctcagtccgctggcagcagatgtacgatctgttatgagacgacgtatttagggatgtgtaggatgaagaggtgctgcgagccactcataggcgactctggcaacgctgagctggctgctgaagctcctgctgcctataccggcaatggctacacccaggccttgaacgtcgtcaagggtgtcaactctggctccgtcttaacgacctacattatctgaacgtccgtgacatgagaccgacccaagagcatgataacagctagggaccagagactcggaataatcagcactactctgatgatcaagctcgatcacgacgcaaatgctgaagtatgccctcacaccacaatcggcgatgaac

SEQ ID NO: 44855 - DNA, 395 bp, Zea mays
  Clone ID: LIB3066-053-Q1-K1-B12
aggatgacgagcgaggcccccgccgtccgcgccgcgtccatccactgggtggcgttgagccccgcggggcggaacagggacgggtcctccgaccccgtgccccactcggagtccgtgaaggtgttcatgccgaagtggaagaacatgatcacctcgcggcgctgccatctcagctgcggcgccgacgggatcggcagcaccggcagcggcggtggagtcgcgcgccacgcctctgtcgcggagacgaggacggctacggccagcgccgcggcggccaggcacagcagcgggcttgccatcgtgctgctgttattgtcacttctctgctcgcgatggctaagtgtagcggtatatactggcccaggcctgtagctgtagggagggggagatgcgtt

SEQ ID NO: 44856 - DNA, 437 bp, Zea mays
  unsure at all n locations
  Clone ID: LIB3066-053-Q1-K1-B2
cccacgcgtccggtccgggaatccgggctgtacattcggcgtggctccaggggacacggacgcctgccgccggtgatgcctgacgccaggcgctccatggacgggcgcagcaccctgccggagctcaccacgcgcccaccgttccgcgagcgctcgctcccgtcctcggccaccaagaacgtcgtcgtcctgccgggaaaggactactccgaggcgccctcccgctccgcgaggcacgactcgttcggcggcgacctcgacttcggcccgagcacgcgcttctcctccatggacttcggcgacaacctcgacctcactgccagccccgctcgggagcccatgtcaccggccaccggcgcgcaacgggatattgaggtcgagatgcggcgcctncggctggaactcaagcagaccatggacatgtacaacgcggcgtg

SEQ ID NO: 44857 - DNA, 462 bp, Zea mays
  Clone ID: LIB3066-053-Q1-K1-B3
cccacgcgtccggatgtatcaaactggtctccgtttatgccaaatggtttcaaatctgtagggactggagccacagtagtcttttttgcatatgttggatttgatgcggttgctaattctgctgaggaagccaaaaggccacagagagacctacccattggtatactaggaagccttatagcatgtgtgttgttatacgttgctgtatgcttggtcattactggaatggttccatatacattacttggtgaagatgctcctttggctgaggcttttgctgctaagggcctgaaatttattactgtattgattagtattggagctgttgctggacttacaacaacacttcttgttggcttgtatgttcagtcacgtttgtactttggacttggaagggatgggcttttaccttcagtatttgctgaagtacacccaacaaggcatactcctgtacagtctcag

SEQ ID NO: 44858 - DNA, 397 bp, Zea mays
  Clone ID: LIB3066-053-Q1-K1-A11
cggacgcgtgggtgcaaatccatttcttgccttgccggcacagctctgcatagcgcctccgaagctttaggattaggatttggatttggatttggatttggatcgggtgtgtttcctgcgtaaccatgagcgagatcatgaagctaaagcgtgggatcagcaccaaaccaggagaccacctcgtccaaaatggccaacaacatccatgtcacgaatgggaggagcaacagcgctactggccctcgccgcgggcgccgccggcgagcccgacggagtcgcccaggaccccaggcgggagccagaagaaggcggttctgggcaaggtgaagagcaaggccaagaaatggatgcacatgctgcatcacaagaagaaacccgcgccaccggaggagatgat

SEQ ID NO: 44859 - DNA, 447 bp, Zea mays
  Clone ID: LIB3066-052-Q1-K1-G5
gcagcagtaggtcgaaaatggcgatgaggtcgctagcgctactggtcctcctcaggctgctggttgttggtgtggcgcaggcggtggagttggagatggagttggtgcctgctgatgcaattgcgatgactatggatcatgagccgccgcaggagtgcgcgaccccggtgagcgtggaggaggcgtgccgcggcgcgtcggagacgcacgccggcgtggcctacgaccactgcatggcgtcgctgggcgccgacccgcgcagcaaggaggccggcaacaagaacatgcacgcgctggcggtgctggccaccaggatggccatcgaccacgccgtcagcaccgagtccaagatcgacgacctcgcggagctggaagcggcgtcgtcggatccgcaggcgcgcgcacgcttcaaccactgcctggagcagtacggcggcgccgtcgacc

SEQ ID NO: 44860 - DNA, 447 bp, Zea mays
  unsure at all n locations
  Clone ID: LIB3066-052-Q1-K1-G6
cccacgcgtcctgtgctacggccctacgcggcgcagggccggtcgcagttccaggaggagggggaggtgctgagctgcatgcggcaccccaacatggtgctcctcctcggcgcgtgcccggagtacggatgtctcatgtacgagtacatggccagcggcagcctggacgactgcctgttccagcgctgcggcggcgcctgcgggaccgtcatccgctggcagtaccagttccgcatgtgcgccgagatcgcgacggggctgatgttgctgcaccagaccaagccccgagccgctggtgcacctgcacctcaagcccaggaacatctgctggaccgaactacttgagcaagatcagcgacttctggctggcgcggctcgtgcctccgtccgtcgncgacaccgtgacgcagtaccgtatgacgtgcaccgcggtgaccttctgctaca

SEQ ID NO: 44861 - DNA, 421 bp, Zea mays
  Clone ID: LIB3066-052-Q1-K1-G9
gtgcgagcttacatggagacgctcaagaagaaccatcagaggctgctctgcgaggggctttcaagatcaaagaagtcgtccacagaccctcggcgcacgttctgccgcccgcatcccgcatccgcgccgcaacccgcagccgtccggcaaacgcccgcatctgcggtagcgccgcagccgcggtttccatcctcctgcaatcgccagcgcgccctccgcgctcctgccgtgatccactcctagatcccggaggcatgcgtcaagggcggcggtgaccatctcagtgggcatccgctgttgcgtcgcggccgagcgggatggcgtcgacaaggtcaaatctcgcccactgcatcactttgcgccacccctagggtccctcggttgttgatccccaacacagaccaccagccaccgaggcgcc

SEQ ID NO: 44862 - DNA, 453 bp, Zea mays
  unsure at all n locations
  Clone ID: LIB3066-052-Q1-K1-H1
ggcaagcttttcttcaggagtgaaaggatcatgagtcaatggcatagtttatgcttctgaggctttgaatgcctgcagcccgttaacaatcaaggcagtcaagggcccgccatcttcctttgcattaattgtaagaggcggatgcacgtttgatgagaaagtgaaaaatgcacaggatgctggattcaaagctgcaattgtgtatgacaatgaaaataatggggtgcctggtttcatggctggaagctcaagtggcatacacatatacgctgatctcgtttcgaaggcctcangagaggtgctgaagaaatcttcaggacatactgatgtagaggtgtggatactacctacattcgacaactcagcctggtcgatcatggcaatctcattcatatcgctgcttgccatgtctgctgtattagctacgtgtctctttgtgagaaggcatcgaat

SEQ ID NO: 44863 - DNA, 302 bp, Zea mays
  Clone ID: LIB3066-052-Q1-K1-H10
ctagcgaggagtacttcataagaaacattataactctaaacgaaaacgcgaacgggttctgggagaagctgaatggcagtaacgggatcgcatgctcaagcagaccgatctcgtccatgttcgtaatggtgtaactctacctgtactgtctgcaagggatcactgacgacatgtactcctgataccggcttcacaaggaagactcagtggttgctataactatgtgtgtcgatatatgcgaagactggctcccgatcaccttgaacatcgatccatcctctctctaagacgttctggacagt

SEQ ID NO: 44864 - DNA, 161 bp, Zea mays
  Clone ID: LIB3066-052-Q1-K1-H11
ctctcgtactacatactcaatcaactaacccttctcatcaaccatcatcacacgcgcaaccgatcccaacacgctcgacgagcactccccatcttacgccgacatctccacaccccatgtcgctcccgacgccactccaatctcccttgacgtcgccgatc

SEQ ID NO: 44865 - DNA, 457 bp, Zea mays
  unsure at all n locations
  Clone ID: LIB3066-052-Q1-K1-H2
catacatcaaataaacaagcgcacacgaacaaatacctcgccgacaataatggcctncagggcctgcattgtgctcgccacggcgatgctagctacactattcgcggttggtttgtgcaccaccccgctcaccttacaggtcggtaagggatccaagcctggccacctgatcctcaccccgaacgttgccaccatatccgacgtggagatcaaagagcatggtggcgatgacttctcctttacgctgaaggagggcccgaccggcacctgtacactcgacaccaaggccccgctcaagtaccccctttgcatccgctttgctgtcaagtctggtggctaccgcatcgccgacgacgtcatccccgccgatttaaggctggcaccacttatatgacgacactcagcatctaatcagcatctgaagatgaactatatttcaaagagctcatctggcgca

SEQ ID NO: 44866 - DNA, 278 bp, Zea mays
  Clone ID: LIB3066-052-Q1-K1-H3
ggcacgttgccctgcttgtatcaactgacgacgattgcatgcgagaatgactgcctatgaggcttggcttgcctatggacggtgaaactaggtgcactgttcgagaatgaaacgtacattagcatactcaacttataccacaaactgttttcaaaaaccggtgactttatccgcgctgcaaacattgaaaccatatacgacgtatgacatcaaagatcatggtggccatgacttcaactttacactctaagagggccatgcacatctcctgtacactc

SEQ ID NO: 44867 - DNA, 406 bp, Zea mays
  Clone ID: LIB3066-052-Q1-K1-H4
tcgcccacgcgtccgcccacgcgtccgcttatgtgaagctgcctgactacaattctggaaaggtggaggtgcaatacttccatgagaatgcaacttttgctactgttgttggcacgaagccgactcctgtgattgatctttctgggacagtaagtgctcaaggagttgcatttggtgcataagctgggtatgacactgctacaggaaaatttaccaagtacactgctgcaattggtgtaaccaagccagactaccatgctgcattcattctggcggacaaaggtgacaccattaaagtgtcaggtgtttatcaccttgatgagaaacagaaggcctcagctgtggctgagctaacccggaggctcttaacaaatcagaacacactcacagtctgtggactgtacac

SEQ ID NO: 44868 - DNA, 448 bp, Zea mays
  Clone ID: LIB3066-052-Q1-K1-H5
cgtagttcggtcacatggtgacccctcccatctgtcacaccggcgatgacgcccacggggaggcatgactacaagccgaagcctacgcctgatgccgccaccgcggcgaactactcgtcgttgtggtcgcccaagcgcctcatgcagcgcgctgcccgcgctttacgccgcagtacgtcgctcgcccgcttcaggacggtcaaggacctcgccgaggaacgggcctcagtgctcgccggcagcttcaaggtctctgatgaggccgctgcggctgctaccgaggtgccaactgcaggtgccaagaccttcatcagcaactatgcccgcgacggcgccatggtcagctgtgcttgacgagctgaggctgctgcaccacgatgactataatcctgagatcgttcgcgtgaagatcatactcgatgacgcgtttcctgtcgatgctgcttag

SEQ ID NO: 44869 - DNA, 347 bp, Zea mays
  Clone ID: LIB3066-052-Q1-K1-H6
gtctgggtcgctcgctacattcttgagaggatcacggagatcgccggtgtggtggtgacggtcgacccgaagccgatcccgggcgactggaacggcgccggcgcgcacaccaactacagcacggagtcgatgaggaaggagggcgggtactaggtgatcaatgcggccatcgagaagctgaagctgcggcacagggagcacatcgcggcatacggcgagggcaacgagcgccggctcaccggcaggcacgagaccgccgacatcaacacgttcagctggggcgtggccaaccgcggcgcgtcggtgcgcgtgggccgggagacggatcagaacggcaagggctactt

SEQ ID NO: 44870 - DNA, 438 bp, Zea mays
  Clone ID: LIB3066-052-Q1-K1-H7
gtctgggtcgctcgctacattctggataggatcacggagatcgcctgtgtggtggggacgggggaccctaatccgatcccgggcgactgaaacggcacacatgcgcactctaactacagcacggagtcgatgaagaaggaggtcgtatactaggtgatcaatgcggccatcgagaagctgaagctgcggcacatgtagcacatcgcggcatactgcgagggcaactagcgccggctcaccgtcattcacgagacctcctacatcaacacgttcagctggggcgtgaccaaccgatgcgcgtcaatgctcgtgttccgatagacggatcatatcgacaaggtctacttctaggaccgtcgcccagcatccaacatggacccatacgtggtcacctacatgatctccgaaaccaccatcatctggaagccctgaggtcta

SEQ ID NO: 44871 - DNA, 422 bp, Zea mays
  Clone ID: LIB3066-052-Q1-K1-H8
cccacgcgtccgcccacgcgtccggtcatctctattctatcttcttcctctctactcaaagccggcgatcagggcaaacccagcctgatcgacgaggacggctagggggcataacccagccggcgacaacggaccacgactacgatctccgtagtcggggacctgctcacttgggcattacagcccttgacattgactgatacaaatctctgggccctcgtttgtcttatgttaccacttaccagaattgcaatcgatagtgacatctcttggtatattcatgaagacttacacgagttgtgatagctagcttggatagacagaatgccccaggtgtggctgagctaacccgggagctctcaacaaatcagaacacactcacagtcggtggactggacacaagtgatccccagacagctttg

SEQ ID NO: 44872 - DNA, 444 bp, Zea mays
  Clone ID: LIB3066-052-Q1-K1-H9
ctgacgcagctcatcgcgtcgtcctccttcggcggggccgcgtcgtcgcgccggggcctcgcgcggcacgctcttcggctaccgcgacggccgcgtgtcgctgtcgctgcagcagaacgcgcggtgccagcccacgctggtggtcgagctggcgctcccgacgcacgcgctgctccgcgagctcggcgcccacgcgggcgcgcgcatcgtgctggaggtcgagaagcgcgccgagcagggcaccgtcgacggcaacgaggccatcgtcaccaccgaccacgacgggtgggtgctggaggagctcatgtggaccatgttctgcaacggcaagagggtgggctacgcggtgcggcgggaccccaccgaggaggacatcgccgtgctggagacgctgtgggccgtctccatgggcggcggcgtgctccccggcaggtcggacatgga

SEQ ID NO: 44873 - DNA, 369 bp, Zea mays
  Clone ID: LIB3066-053-Q1-K1-A10
ataaataataaagataataaaaaaaaaaaactttaaataatataaaataaaaaaaaaatgaaggatataaaaaaaaaaaaataaattaaataaaacaaaaaataattgtaaataattattggggttccctttttactggcccccttttttcctcctcttctttttactttgttgactttttttttttgttcccttgatttcttttttcctccctcgcttttacaaaacctgtgttggaactccctttgtttcccctactttaattccctttttcccattcccttttttcccggttgggttatttcccaatggcccttccccttttgtctttccccgcatttgctaatcataattgccttttggcccccc

SEQ ID NO: 44874 - DNA, 455 bp, Zea mays
  Clone ID: LIB3066-052-Q1-K1-G3
tcgcccacgcgttcgcgataaagtccccgctcccgtgaaagagaaggtggatgtgaagctccaggagctcaaagaggcaatatctgggtggatcaacacagagtatgaaggatgccatgtctgctttgaaccatgaggtgatgcagattggccaggcaatgtataaccagtctggtgccagtgctgctgggtctactcctggtgctgaggctgggcctacccctggtaccggaccagtgcagaatgatggggatgtcattgatgcgaacttcacagatagcaattgaggggtgatcgatgcatgaccatgtgttgagcatggttggcataaaggagagtgagcaaatagttccttttttgtgttgggatttttactgtaggctatctagtatggagttgatagcggtagtgtttcgcgaacttttctctcgtgattttgactcaacaattggctg

SEQ ID NO: 44875 - DNA, 281 bp, Zea mays
  Clone ID: LIB3066-052-Q1-K1-F10
tctctgactctttggtttactcattcttcgaactcttgcaacattcttacctcacagggacttagttctcattcatttgaaggcagaccatgcatatcaaacaggaagacaccaggcctaacacgcatgcatcctactacatacaacaacacttacccgattgactatactacaccgatcaactgtctcttccttgccaggcctgtatacttatatgcatctgactaaatcaaatcttccatgcttctacgctgacgcttgcgactccccaaacttctacg

SEQ ID NO: 44876 - DNA, 446 bp, Zea mays
  Clone ID: LIB3066-052-Q1-K1-F11
cccacgcgtccgtgatcatgggaagacaactctgttggattatatacgcaagagcaagttggtggcatctgaagctggtggtataacacaagggaattggagcatatcaggttcttttaccagtagatggaaaccatcaagcctgtgtttttctggatactccaggacatgaggcgtttggtgcaatgagagctcgaggagctagagtaaccgatatctgtattgttgttgttgctgcggatgatggtgttcggccacaaacaagtgaggcaattgcacatgcaagggcagcaggggtgccaattataatagcaataaacaagatagacaaggagggagctaatgcagaacgagttatgcaagaactttcccaaattgggataatgccagaaatgtggggtggtgataccccaatgatcgagataagtgctcttactggggataat

SEQ ID NO: 44877 - DNA, 399 bp, Zea mays
  Clone ID: LIB3066-052-Q1-K1-F12
cccacgcgtccgtgatcacggtaagacatgtctgatgtatcatatacgctagatgaaggtgcttgcatatgaaactcggggcgcaacgcactggaatcacgcatatccctgtctatgaccagagaagagatgctatcactgctgcgcatgtgtggatacttcaggacactatgcatgtggctcattctgagctgcaaccgctagctgacccgctgtccgaactggtgtggtccatgcagagtatcgagctcatgcacgacacagataaagcaagttcacgtgctaggacacgtggcgtgtcctgtatggtcactattcacaggatcatcgtggcataagctcctgcatacatacttatgctagatctttcccaatttactataccgcctgaagaggata

SEQ ID NO: 44878 - DNA, 66 bp, Zea mays
  Clone ID: LIB3066-052-Q1-K1-F2
aactctcgtaatccaccctttgtacattaccatctagagttgctcctttttttccatgagcggaag

SEQ ID NO: 44879 - DNA, 414 bp, Zea mays
  unsure at all n locations
  Clone ID: LIB3066-052-Q1-K1-F3
tacacctgtagaaggattgagagaatggctggatgctgttcagacagcanggataccttgtgctgtcgcatcaccccttgacaggagatgcatgatcgaagctttggatcggatggcgctaacaaatatttcaaggcgatcgtgactgacgaagatgatatggagtcgatagcaaatcgatttctgtcagctgctatgaagttggatcgtaaaccctcgaagtgtgtggtgttcgaggatgacccaaggggcgtgacagacgcccacaactgtactatgatggcagtcgcattgattggtgctcatacagcgtatgagttggtacacgcagaccttgccattgcaaagtacagcgagctctcagtgatcaacctcagaaggctgtttgcgaacaagggaatcagcttcatggac

SEQ ID NO: 44880 - DNA, 450 bp, Zea mays
  Clone ID: LIB3066-052-Q1-K1-F4
tcgcggacgcgtggcccctaccaaccaggaaccgtccaatggccgccatggctcgttccgtatgcctcggtctggcgccccttttcctactctccctcctcgtgtccagcgtgatcagtgcgcggaccgtggtcgacaccgtgcaggacgcgtgcagcaagacccatgtccacaagatctgcgtggacagcctcgacggcaagccggagagccagaaggcgacgccgcgcaagctggcggagctgttcgtgaacatcgcggccgagaagggatccggcatggccaccttcgtgcaccgcaagtgcagcgacatggatgacagcgacatattcaagtgctacgacagatgctccgacgacgtggaggaggccgtcgtccacctgaacggtctagttcgggagcccaccgacgccaagtgtctcgagctcaagtcgtgggtctctccacgct

SEQ ID NO: 44881 - DNA, 451 bp, Zea mays
  Clone ID: LIB3066-052-Q1-K1-F5
cccacgcgtccggctccccgtccttcggtaggtgcattgcttcggtggtccaccatggcgcggcgagcggtggccacgatgacgactaataagccccttctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggactggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggacctcaagcccggcgctcagttccgcgagaagctgttcctgaacatcagcaagccgttcatcacgt

SEQ ID NO: 44882 - DNA, 237 bp, Zea mays
  Clone ID: LIB3066-052-Q1-K1-F6
cccactcatgcggctcccaatcattgcgattatgcactggttcctactgacactctggtgggtcgtgcatggcgcgagggaagaaccaatgggcatctatgcctactcgtcctggcctcctgggtccttgaacctcaacaagccggcctcaacgggcaatgccgagccttacacaactaacgctgtacacagccgcatgagcatcgctctgcacacgcactagtacgccgacaaccg

SEQ ID NO: 44883 - DNA, 442 bp, Zea mays
  Clone ID: LIB3066-052-Q1-K1-F7
catggacatccagcataactcggtgacggcgctcgggcgcaccgaccccaacatgaggtccgggctcttcatccagaactgccgcctggtgcccgaccagaagctgttcccgtaccgtttaaagatcccctcgtacctgagccgcccctggaaggagttctcacgcctcgtcatcatggagagcaccatcgccgacttcgtcaagccataggggtacatgccctggaacggcgacttcgccctcaagacgctctactacgccgagtacaacaaccgctggcccagttcctgcaccagcaagagggtcaactggccctgcttacacgtcatctgacggaaggaggccgagccgttcaccgccgggccgttcatcgacggcgccatgtggctcaagtacaccgtcacgccgcacatactcggtttcaagttctaaaggccgcat

SEQ ID NO: 44884 - DNA, 379 bp, Zea mays
  Clone ID: LIB3066-052-Q1-K1-F8
cccacgcgtccggcattctcttcccttccctgagcaaagagaagtagccacaagcatgtggggcatcatcgacaagatccaggagacgctccacatcgggggcgaccacaaggaggagcacgagcacaagaagggcgaggagcaccacaagaagggcgaggagcaccacaagaaggacgacggggagcacaaggagggcatcgtggagaagatcaaggacaagatcaccggcgagcacggcgacaagtccggcgaccacaaggacaaagaccataaggagaagaaagatcagaagaagaagaaagagaagaagcacggggaaggccatgaccatggtgatggtgacggtcacagcagcagcagcagcgacagcgactga

SEQ ID NO: 44885 - DNA, 440 bp, Zea mays
  Clone ID: LIB3066-052-Q1-K1-F9
cccacgcgtccgcccacgcgtccgcccacgcgtccgcccacgcgttcgcgagaggggaacgagcagcctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggccttcaccgaggccgccgccgccggcgccccagccgcctccgagtcgtcggcgtccgccgaagcccccgctggcgccgccggcgccggcgccggcaccggcaccgccgcggggccctccgacagcggcgccgcgcccgccctcgccgccgcgcccgccgagctcctcttctgcctactcgcctactacctgcactaagccgacggac

SEQ ID NO: 44886 - DNA, 426 bp, Zea mays
  Clone ID: LIB3066-052-Q1-K1-G10
cccacgcgttcgcccacgcgtccgcccacgcgtccggcaaattcttcttgcatggagcttgcttcaaaggagattactgtgaattctcccatgactgcaatgatcaaccagataatgtttgcactttctaccagaaagggacgtgcacctttggtagccgttgcagaaatgaacatgttgaagttcattgtaactgcccccaaccagcaaccactgtagcgcgtgcatcctccaattcttctcagctagttgcttcttccagagatccccattgcagcgaatgccaaacggatttatgtgaccaaacacagcagatttgcaagtcaacagcagcactttctgcacatcaacctgcatgggttgttgattatcatgaccatgacactccagatgatactacaagctggccgttgcaccaagctgtgc

SEQ ID NO: 44887 - DNA, 368 bp, Zea mays
  Clone ID: LIB3066-052-Q1-K1-G11
cccacgcgtccgaaaacacgtacctccacgcgtacagcaaagactagttccatggagctcgtgtacacaggacatgactgagaagtctcccctcactgcaatgatcaaccaggagatgagcgcgctttctaccagcaaccggacctacacctaacgctatccgttgcaaagacgatcacggtcaacttaagagcatccggcaacacccagacaccactctcaagggcgcttactccaattactttaacctcgttgatgcctgcatataccaccatatcagcatatgccaaacggactaatgtaacctatcactgcacagttactagcctacaccaagactgtttacccatcaacctagctgggtcgac

SEQ ID NO: 44888 - DNA, 442 bp, Zea mays
  Clone ID: LIB3066-052-Q1-K1-G12
cccacgcgtgcgtcgaaatctgcgtggcacccatatggctgcggtcgatgcggcggaataagaacgtaatcatagacaccgaccccgtaattgatgacgcgatggccatcttcttggcgctgcggtctccggagctggaggcgctgggcctcaccactaccttccgcaacgtgcacaccgccctcgccacgcgcaacgcgctccacctgctggaggctgttggcaggactgacatcctcgtggcagatggatcccatgtaacgatcaagaaagccaccaagctgaggatcgcaagcttcgtccacggttcagacggcctgggaaaccaggacttcccttcaccagctaccaagcctgtagatcagtctgctgctgccttactggctgagcaggcaaatctgtaccctggtcaagttagcattgtcgccctcggaccacttac

SEQ ID NO: 44889 - DNA, 424 bp, Zea mays
  unsure at all n locations
  Clone ID: LIB3066-052-Q1-K1-G2
tcgcccacgcgtccgggccttatttttcagggctgggacgatccatatgtaactcgtactcatgaaggtctcctgaagtggaaataccctgagatgaattctgtggactgtctgttcgagcttacgaatgataatcgtcaactggttctcctttatgagagaggaaaaaagaaactcatggatggtgcccggatagcatttactgacgatgtagatccatcctctatcgccgggaggattgttgaatgctcctggaataaggaagaacagtgttggtcctgtatgcgtattagatctgataaatctactccaaacgacatcaacacataccggaaggtgatgaagagtatcacagataacattacccgangaaaagcttctcgaagagattgatgagataagtcttctcccgatgtatgctgat

SEQ ID NO: 44890 - DNA, 453 bp, Zea mays
  unsure at all n locations
  Clone ID: LIB3066-052-Q1-K1-F1
tcgcccacgcgttcgcccacgcgtncgcggactcttggctcctgacccccaagttgaaattgagggccaacagctgataatggaatatgccaatgtgggtgcggaggacagtcacttgggcatgtcgaattcggttcagagtgctcttcctcacgggcttcgtcaggtgaaccggatgatgtgtcaattgatattgcttccatgacaaagcatactaataaaaaccccaaaaagaagaagttcttctctaagcttcggaaactggtgctgggaaaagggaaagagaaccgtgaaatttctactctggagaggagagtgtctatttcaagttgttccttcgatgacttcactggaagggattcacatgatagctattcttcgttcatggcagaaccaaacatgcctgatagtcgacggcatggtgatcatggctttggtacacattcttctttg

SEQ ID NO: 44891 - DNA, 256 bp, Zea mays
  Clone ID: LIB3066-053-Q1-K1-E6
cggacgcgtgggtcttcattagcgcgaacaaagttttgtgccggtctatcggccggggctgtcctcccctattcatcaagactgcaataactgtcgctacctatgcttctcacctgtgatttttggacacaatatgttaaggtccattcaattctaatgagacgcctgatgaggctactagcaaacaacaccatgtgttcggattgtcattggttattgatgtcttgtgaatgaataatataaattttttttggtc

SEQ ID NO: 44892 - DNA, 454 bp, Zea mays
  Clone ID: LIB3066-053-Q1-K1-E7
gccaccacggcgaccgaggcggccaaggctgcaccggcgcaggagcagcaggccaacggcgacggcaacggcgagcagaagacgcgccactccgaggtcggccacaagagcctgctcaagagcgacgacctgtaccagtacatcctggacacgagcgtgtacccgcgggagccggagagcatgaaggagctgcgcgagatcaccgccaagcacccatggaacctgatgaccacctccgccgacgagggccagttcctcaacatgctcatcaagctcatcggcgccaagaagaccatggagatcggcgtctacaccggctactcgctcctcgccaccgcgctcgcactcccggaggacggcacgatcttggccatggacatcaaccgcgagaactacgagctaggccttccctgcatcaacaaggccggcgtgggccacaagatcgacttccgcg

SEQ ID NO: 44893 - DNA, 462 bp, Zea mays
  Clone ID: LIB3066-053-Q1-K1-E8
ggatccccccacaccttgagacctgcgttgtcacccacccatcaaggttggggccgggaggagagttcagccgttcctgttcctgataaaacgagagaaggatggcagtgtctcagggagctgtcctattcttgtttctcctcctcgtcgcagcataggtgggaaccatcgatgccaaaatgggagtagccatgcccatgcatgccttgataatggagaaagcgaaacagcaggagaaggagaagaaggaggagaaaagcacggagaaggaagagagtcaatgcttatcgccgagtctccagttcgagggcttctgcttcaacagcgacagatgcgccgaggtgtgcatgaaggagagctttcccggtggcgagtgcaagcgggacgtggccatgcgcaagtgcttctgcaagaagccttgctagttcatcggtcttgctaattgttgatgggtgcttcatt

SEQ ID NO: 44894 - DNA, 329 bp, Zea mays
  Clone ID: LIB3066-053-Q1-K1-E9
acgcaaagtgctttatcctgtggagctcagcatgctatctatgatctgtcatgcaactgaacgggtgtgagctaattgatgacaaacattgatgctagcatgaccaagatttacatggtactcctactggtacttcaaagcagaactgttctactggattaaaacatacattaggcaaatattgaggaactacaatattccttgatggatggaatgataactccaacttctgagattgatctagaattcataatcttggcatactacaaccattatgagtctaagtcagcgactctagaatttataatggatagaccttgcatgataat

SEQ ID NO: 44895 - DNA, 396 bp, Zea mays
  unsure at all n locations
  Clone ID: LIB3066-053-Q1-K1-F10
agcacctnctcttcccccggcgggcaacaactcaaccggcgcaaccggcacatcaggcatgggcgcctgcgcaaccaagcccaagacgcttgaagggcaagccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaagaggaggaaaccctggagaagaccgtcgtctaggaggagaagccagcggcagcagcccctatgcagaggaaagggtcgccaccgncgacgagaccacgacg

SEQ ID NO: 44896 - DNA, 394 bp, Zea mays
  Clone ID: LIB3066-053-Q1-K1-F11
cccacgcgtccgcccacgcgtccgaccagcgcagcagtttcagggcgtggtgaagggcagggaagctcaagcaagcatacaaggtgcgtagagaggatggttcgaccagtcagtggataggcccagagcttgtccaacctgaatacagtgcacagaaattttaagctaacacagttgtgcaggaacagtgagaaaacaacacttgcagcaaagcgaagaggcacctacctttcctggtcccgtaagtaggatcggtttctcggtttgttgaccccggcgccgctgaatagtttcaagacctgaaagaatttcaagaaattgatcaaagtctggattgaaatacgttatgctagcttaccattgacaaggcaaagagacagttgaactacggaaa

SEQ ID NO: 44897 - DNA, 450 bp, Zea mays
  unsure at all n locations
  Clone ID: LIB3066-053-Q1-K1-F3
cggacgcgtgggatctgttccggccgccaaacaaaaccaaaaaaaaaacacactgaacccaggngggcgatcccacagaaactgttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtctgtgagcgcggacgacctggccttcgggggcaagaggtcgtccggcgtgccggtgttcgtcatgatgccgctggacaccgtcaaggagtgcggcaccgcgc

SEQ ID NO: 44898 - DNA, 313 bp, Zea mays
  Clone ID: LIB3066-053-Q1-K1-F4
cgtggatgcccgcgccacagcctcttctgctgtcgcttcttgtcgccgtgctaacggtgtggccgtatgtctccaacggcgggcacgccaagcccctgacgcctgtcggtcgcgtggtacaccacaaccactgcaagttcacggtcgggccgtggaaacccgtccacgcgaccttctacggcgggcggtactggtcctgcaccacggcgggcgcgtgctggtacaaggacacgcgcgcgcatgggtatggcgtgcagacggtggccgtgagcacggtgcttttcggtgactgctcggactgctgcgggtgcta

SEQ ID NO: 44899 - DNA, 442 bp, Zea mays
  Clone ID: LIB3066-053-Q1-K1-F5
caagcacagagacaccaagcgttgaactcgcctaagcagctatcaaccaaccctagggagggggacaccgtacccatggctcgcgctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacgatgatgactccaccaattgaggccacacacgttggcccggttaaatttggaacaagacatggaagaaaaatgagagcaatgtctttaaaaccatgataatgtgtggtcatccactcatacatggatacatccttgctctccctctttttctttctgtttgattttcaatgtgttatcatg

SEQ ID NO: 44900 - DNA, 432 bp, Zea mays
  Clone ID: LIB3066-053-Q1-K1-F6
cggacgcgtgggcggacgcgtgggtgcattctttgcgatctcctttttcccccctcatcagatatgtgtacagtggcctgttgaatgcttcatagaagcatataggctgatgtctttttcatcactgtgcaacttgccaccaatattccatctctgtcgagtccaacacatatagaattgtactgtcttttttcaaagaggtgcagagatcatgcacaccaaagcagcagcagcatcctattgaagaccaggattttgaagaatctataactaatcaagaagcagaccattatgattgttggtacgagagcaggagatcaggtggcacgacaaaaagtatgctgagagcgcaaatgtattgttaagtaaccaggtgacattgtgctgcataacaaatgaatgaagtcaaatgaactgaataatttgtaaaaa

SEQ ID NO: 44901 - DNA, 394 bp, Zea mays
  Clone ID: LIB3066-053-Q1-K1-F9
cgtgctctaacagtggatgtggcatctgagaacattcgaacttggacactccaggggtttgatcaggggagaagcagcggacgcagcgcagctacgatttcaccggagtcacgtcgtggtttgcggccaagtgcgacctcatccttctcctgtttgatccgcataagctggacatcagcgatgagttcaagcgtgtgatcgggtctctccgcgggcatgatgacaagatacgcatagttctcaacaaggccgaccaagttgatgcacagcagctgatgagagtgtacggagcactgctgtggtcgctcgggaaagtcctgaacacaccagaagtcatgcgtgtctacataggttcattcaacgacaagccgatcagggagacagcggctgggcc

SEQ ID NO: 44902 - DNA, 456 bp, Zea mays
  Clone ID: LIB3066-053-Q1-K1-G1
cacagcgagcagaaaagtgagccttaccaaatgtttgagcatgagaccaacggcaacagttggaagtcctcccaaaattcttcatcgaagaacaattccagttcttgggacgactgggacgacccaggcaagaaagatgagcctgcgaaaccgcaccagagcagtgactcctgggctggctgggatgatgggaaggatgatggttttgatagccctagttacaacaatcacagcacctccaacaaggggagcaaccaaaacgggacatccggtggcacattttggacagaaggcggcttccgctgaaaccagtctcttttccatagagctatactttcagagttgttacatgccaggaaacgtgagggtccagtggttggtattatttgggatacttaaacagtctggtgaaagggattgtgtgttttgtaccatgtctacaacctgtattatatc

SEQ ID NO: 44903 - DNA, 389 bp, Zea mays
  Clone ID: LIB3066-053-Q1-K1-G10
cccacgcgtccgctgcgcttcatgatctctacgagctccagggcctgtccccgtggtacgagaacctatgccgccctgtcacagacttgctgcccattatcgccagcggcgtccgtggagtcaccagcaacccaacgattttccaaaaggccatttcatcgtccagcgcatatgatgatcagttcaagcagctcatttcggcaggaaaggatgcggagagcgcttactgggaactcgttataaaggatatccaagatgcgtgcaaactttttgagcccatctacgacgagactgatggggctgatgggtatgtctccgtagaggtgtctcctaggttggcaaatgacactcaaggaactgttgaagcggcaaagtggttacacaaagtg

SEQ ID NO: 44904 - DNA, 386 bp, Zea mays
  Clone ID: LIB3066-053-Q1-K1-G11
cccacgcgtccggtcaagtccctgtgcgcgcccaccctatacaaggagtcgtgcgagaagagactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaggactgcaagaagctcctggaggacgccgccgacgacctgaggggcatgctcgagatggccggcggcgacatcaaggtgctgttcagccggtccgacgacctcgagacctggctcacgggcgtcatgacgttcatggacacctgcgtcgacggcttcgtcgacgagaagct

SEQ ID NO: 44905 - DNA, 337 bp, Zea mays
  Clone ID: LIB3066-053-Q1-K1-G12
ggcagagcttcagcgacggacgaggaggacgtgccggtgcagcagcggttcatctggtcagggaagagaaagatgcggcgcctttttcacgactccatctctcttctggattactctcagtgctgcagcgtaaactcgcaattccctcctgtaaaagctggagcttttctgagcgtgtacgtgcgttggtggaacttgggcccccacccaagatctcacctatctgcactgggctggccagctgggcccgtcgccaaccaccgtgcttttgcgtcgccgcataaccttggctaagcgtgaactttgtcacaacaaccacgtttggcgtttccatgct

SEQ ID NO: 44906 - DNA, 459 bp, Zea mays
  Clone ID: LIB3066-053-Q1-K1-E5
cccacgcgtccgaacgacgacacacgaccatgcatgcatgagttggctacaaagaagggaggagcagctagctggtactggagatggatatggatgcatggggagaactacgtacgtgcgtacgtggaaagaacaaattaaagtagtcattttactcgcgcagagagagaaaagctttgtgagatggatcgtcaccagctagcttgcgtcgtcgtcgacggcgatgataagcaaataacattttacacgcagacagcagtagtaacagcaaatcgcgacccaccctccgccgcgaccgccatcgcgtccacggtacagcgtacagtcgtcctggtcgccgtcgcgcgcccacctcatcaagatcaggctttggccatgtccttgccgccgtcaactccttcgccaaccccagacccacccagagaggctagagcgaggccgcaggcggcggctgtggat

SEQ ID NO: 44907 - DNA, 460 bp, Zea mays
  Clone ID: LIB3066-053-Q1-K1-D2
ccgcccgtcccgcctgcctcgccgcaagcgcacgcgctcggctcgccgcgtcgggtcgccggagggcgaacgaaaccctaggatcagggaggctccgggcatcgctgctcgacccccatgacgtcctgcgggtgcctgatgctcgagaaggtggagggcgacgcgtcggcgaagacgagggtgaaggccgcgccgggcgccggtgccggcgcctggtgcggctcgtgcgctggggactggcggggccggtcagaggccatcttccccatctacgtgatggggagctcgcgggagagcaccgtggcggcggcgcgcggcatagtcgactcccccgaggaccccatatgggttgccgtcaaggcggaggccaagtctgaggcagaaaaggaacctattttgagtagcttcttgtatgccagtgtgctgtctcatgactgcctagagcgtgcattgagcttcg

SEQ ID NO: 44908 - DNA, 441 bp, Zea mays
  unsure at all n locations
  Clone ID: LIB3066-053-Q1-K1-D3
cccacgcgtccgcccacgcgtccgatcgagaggagaaccagcagcctccaataagagccaggcagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgncgnctcggggccctccgccagcagcggcgcgcccgccctcgccgccgcgcccgccgcgctcctcttctccctcctcgcctactacctccactaagcgtgtgcgtgcg

SEQ ID NO: 44909 - DNA, 454 bp, Zea mays
  unsure at all n locations
  Clone ID: LIB3066-053-Q1-K1-D4
cccacgcgtccgcccacgcgtccgcttgaagttcttgaacgtgcaggtatgacagactgtggagggatgttctactcctgtcgacatgaatggcaagctttctggtactgaggggccaccagttgatgatccgactcactatcgaggtcttgctggcgcactgcaatatatcactttcactcggcctgacatttcctatgctgttcagcaagtttgtctacacatgcatgatcctcgggaaccacattatacgttgatcaaacgtattcttcgctatctgcatgggacattggatcatggcttacatcttcgccccacagatgtttctgctttggttgcctactctgatgctgattgngccggttgtcctgacacccgtcgttcgacctctgggtatgctgtttttcttggtgataacctcatctcttggtcatccaagcatcaacctactatt

SEQ ID NO: 44910 - DNA, 412 bp, Zea mays
  Clone ID: LIB3066-053-Q1-K1-D5
gacaccgttacacccaacacaggtctacgagatgctgtcccttcacaagtctaaaacgtgggataacctaaagagatatgaaacccaaaccactgaccacagcgtcctgttaacactctgctatggaactttctctcatactcctgcacggatcttcattcctcaaaacctagcacctgagcttcatgattccattacagaatacatcccaccactactgactgataatccactacaaagagctcgtaatccccaatctactgctcaactacgccaaaaacatcatctaggaattgctccataccgactggatctggcggcatatgacactataccaagtcgcacgcacccatgacacttctttttcgctgtcctatatacaactgcttcttcgagtacgcacctacacaat

SEQ ID NO: 44911 - DNA, 463 bp, Zea mays
  Clone ID: LIB3066-053-Q1-K1-D7
cgacttcggtccgctcaccgagcgccgccgcgccgaaaaggcgcggcagcagcgcaggcggatcatgatcgccgccgggactatctccatcatcatcatactcatcgccatgggcagcgccgcggtcatgtacagcgggaagaagtcgtccagcgacggtggccacaagtctgcttccaaaggcaagtcgagcggcgggtcagactcggactcgggagcggaagcggaagcggaatcggaagcggaatcggaatcggggtcggaatcgaagacgaatctgaaggccgtgtccaagagcatcaaggcgatgtgctcgcagacggactacacggacgcgtgcgagaagagccttggcaaggccgcgaacgccagctcgtcgtcgcccaaggacatcatccgcagcgccgtcgaggtgatcggcgacgcgatcggccaggcgttcgaccgcgccgatctgatcctg

SEQ ID NO: 44912 - DNA, 463 bp, Zea mays
  Clone ID: LIB3066-053-Q1-K1-D8
agaaggttatgctagacctttagttgatcgaatagatgttcacaatagattcagacggcggctctatcgcccatcaactgttaccacggaatacagagaacatgtgaaagatctttcttgcgtgtcaaaagatttcggcaggattgtcattgtcgacaacaatccgttcagtttcattcttcagcctttgaatggaataccttgtgttccattttcagctggacaacattctgatgaccagctcatgatggttatatttccactcctgaagcatctttctctccagaaagatgtcagacctgtattgcatgaaaggtttcatatgccagaatggttccaaaagcatgggatcccccaaactaatcagtctgtgtaagttttgctgcccttgttttgatgaacgctgtgcctattatgctataagccccttaagggagagcacttgtatattattatcaatatt

SEQ ID NO: 44913 - DNA, 400 bp, Zea mays
  Clone ID: LIB3066-053-Q1-K1-D9
ccacctccagaggtgaagtctactgcaccaccagctccagttagctcgcctccacgtccagggaagtcgccacctccacccggccctgtgagctcacctgctccccctgtgaagactccaccaccaccggcaccggtcagctcaccaccacctccagtgaagtcaccgccacctccagcaccggtcagctcaccaccacctccagtgaagtcaccgacacctccagcaccagcgagctcaccaccacctccagtgaagtctcctccgacaccagcaccagttagctacccaccacccccaataaaatctcctcctccaccggcaccagttagctctcctccaccagcaccagtgaagccaccatcactaccaccaccggccccagtaagctcacctcctt

SEQ ID NO: 44914 - DNA, 328 bp, Zea mays
  Clone ID: LIB3066-053-Q1-K1-E1
cggacgcgtgggcggacgcgtgggcgtactctcaagtctccaccgaaaatacaaaccagcggagggtatattcggtggagacttgagagtacgtgagaaagagagaggttacgaagagtgattatatatataatccgctggtttgtattttctttcttctttggatcatcacaaaaccaaccgatgtaattattattagaccgacgcctcacaatcttggaacttattcattatgctagtgtatatctgtaatcccattccataatgttaatgttgatttgtggtcacgtttcaatgagaaaaaaataattgccagtgcaaaaataat

SEQ ID NO: 44915 - DNA, 389 bp, Zea mays
  Clone ID: LIB3066-053-Q1-K1-E10
aggcgtcgctatcgagattgcggaagccgtggttggtgcgctgagaggggagctggcagcggccgctgtgaatgcgcccatggtcccagctgagatcctgtcagagctggctccatatgtttctctggccgagaagctcgggaggctggcggtgcagctcgtggccggcgagagcggcatcaagggcgtgaaggtggtgtacaccacagcgcgtggccccgacgacctggacactcggctcctccgcgcgatggtgaccaagggcctggtggagccggtgtccagcacgttcgtgaacctggtgaacgcggactacacggccaagcagcgcggcctccgcctcacggaggagcgcgtggcgcacgacagccccgcggcggaggcgccgc

SEQ ID NO: 44916 - DNA, 376 bp, Zea mays
  unsure at all n locations
  Clone ID: LIB3066-053-Q1-K1-E11
cctctctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctganggaccggctgctgatgac

SEQ ID NO: 44917 - DNA, 392 bp, Zea mays
  Clone ID: LIB3066-053-Q1-K1-E12
cagagaacggactaggtgcgtgctctgcgctgacaagagcagcggcaggcaggtcgtcggtgcgccttgggtggtgaataattgaagaagaagaagaggcggagacttgagcaggtgatgtcttcgctgccaggaggcttcctgtgcgtgcgcgtcctgcgcgggatcgacctcgtcagctgcgacgccaagggcagcgacccctacgtcgtgctcagcctggatggacagaaactgaagacgagcgtgatgaagaagacggtgaacccgttgtggaacgaggacctcaccttggccgtcatggacgcgtcggcgcccatcaagctagaggtcttcgacaaggacacgttcagcaaggacgacatgatgggggacgcggagttcgacgtgga

SEQ ID NO: 44918 - DNA, 454 bp, Zea mays
  Clone ID: LIB3066-053-Q1-K1-E2
gaaggagcagcacttcgtgcttgttcatggcgaagggcatggggcctggtgctggttcaaggtgggctggctcctcgagggcgctggccaccgtgtcacgtgcgttgacctggccggaggcggcgtcgatcctaccgaccccaacaccatccggtccttcaagcagtacgacaagccgctcatagacctcatctccaacttgccagacggagagaaggtgattctgatcggacatggcgctggagggctgagtgtgatccatgcaatgcatgaatttgttgacaggatcggtcaagcatttttcgtggccgccacaatgctgccgtttggatttcaagccgatgaagataagaacgatgtaatgtttttgaagaatttgtttgccatctttttaaaccacatagacccttctagcaaatgataaaaaaatatagagtacacatcaaacaaacat

SEQ ID NO: 44919 - DNA, 465 bp, Zea mays
  Clone ID: LIB3066-053-Q1-K1-E3
ccgaattcccaggcaggcacgtcggcgaggttggcaggaagaccgaagaccgagccgtgcggtgggtcgggacgggaacgggacaggaccccaaaatctcagatccttcctgcccgcccgcccgtgcccgtcgacgcgtcgttcttgccggccgcgccccacctacgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaagggtggtccagaataagagctaatagcaatacagtacttggagag

SEQ ID NO: 44920 - DNA, 451 bp, Zea mays
  Clone ID: LIB3066-053-Q1-K1-E4
cccacgcgtccgttttttttttcaacaataataagcctaattatcatctctattttctttggacagaaagatatctatctactcacccattgtaaaaacacgtggaccaataaaggactttggggatggtgcggagtatatcacgggagaaatgccttgccgcagcatccatatcactctataatctactactcagatccgtgttaatgcccaccctgtgaagctggcgacatattgaattccagtaattgcgatcttagtaccaaaaggtatcaccgtgattaacccactgcacaaaattccgaggtaacttctgatactgcatttcagcaagatggttttccatgatatcaggagttatgccactaatgacattctcatttgataggtttgcatctggcgtgctagttgcaatagacctttcatcacttgagttgcctgaagtggaaag

SEQ ID NO: 44921 - DNA, 399 bp, Zea mays
  Clone ID: LIB3066-053-Q1-K1-D11
ctagaactagtctatcaccctcgaggtggagtcgtctgacaccattgacaacgtcaaggagggcatcccaccggaccagcagcgcctcatcttcgccggcaagcagctggaggatggccgcaccctggcggactacaacatccagaaggagagcaccctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgctggcaagcagctggaggatggtcgcaccctcgcggactacaacatccagaaggagagtacccttcaccttgtttt

SEQ ID NO: 44922 - DNA, 450 bp, Zea mays
  Clone ID: LIB3066-053-Q1-K1-B7
gctcagccagctccaccacgagaacctcgtcgacatcattggctactgcgctgacggagagcagcggctgctggtgtacgagtccgtgcccgccggcaccttagaagaccacctgttcgatctgccggcggacaagaagccgatggactggtgcacgaggatgaaggtggcgcacggcgccgcgcaggggctggagtacctgcacgagacagcgaacccgccggtggtgtacggggaattcaaggcctcccacatacttctcgacgagaagctcacgcccaagctctccgacttcgggctcgcgcagctcggtcaggccgggggcagcatgccggtggtggcgtcgcccatgatgggctccttcggctgctgcgcgccggagtacgatcgcaccgggcaggccaccatgaagtccgacgcgtacagcttcggtgtggtgctggtgcagct

SEQ ID NO: 44923 - DNA, 465 bp, Zea mays
  unsure at all n locations
  Clone ID: LIB3066-053-Q1-K1-B8
caccgttccaatcctctccgtcgtcgcgatggcggcctcctgccgccgccgccgtcgcgacggcaccgcagagctagctaccgacgaagacaaggcgggcaatggccaaggcgcccctgccgcttccgtcgctgctcgtcctcgccgccttcttcttccaccacccctgctgcacggcgcagggccgcgccgaaaacatctcggaggtcgaggccgcggtccgcgcccgcgcgtccgagctgctccgcgacgccaccagccagctcgtcgacctgcccctcccggccaacctctccggcgcgggcgtccgggcctcggccctcagcgtgcgcagcaacgcgctctgggccggcggcgtcaacaccaccggcttcaccgtcccgccgcgcgtcgtgccggccccgttcgcgcgccgnctcgccatcgtcttcgagctcttcgtgggaaactcgacngccgcgttcg

SEQ ID NO: 44924 - DNA, 393 bp, Zea mays
  Clone ID: LIB3066-053-Q1-K1-B9
gcgaaggaccccacccgaggcgccacctgcggtcgtgagggtggagatcggggatgaggcggcggcgctgcgcgaggcattggcgcggcagcaagcggcgctcgccgacgtccaggcggagctcgacgcggagcgcggggccgcggccggcgccgccagcgaggccatgaccatgatcctccgcttgcagcgcgagaaggctgaggccatgatggaggcacgccagttccgccgctacgccgaagagaagatggcccacgacgccgccgagctcgcggccctcgaggaggctctctcgaagcgtgaggccgggatgcgggcgctccagggccagacgccccgtcacgcctgcgccgtgccgtcggggggctccaccccacgacgcccctctgt

SEQ ID NO: 44925 - DNA, 456 bp, Zea mays
  Clone ID: LIB3066-053-Q1-K1-C1
cctcgtcgacgtctcactcaccccgccttcacgcctccctcaccaaataaggtcccgcccgtttgggacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttctgcaccggcaagctcgagcgctccatcgacggtgtgaccgacgcgaacggcacgtacacgatcgagctcaaggacagccacgaggaggacatctgctaggtggtcttggtggagagcccgcgcaaggactgcgaccaggtgcatgcggacagggac

SEQ ID NO: 44926 - DNA, 391 bp, Zea mays
  Clone ID: LIB3066-053-Q1-K1-C10
gtgctactccgccgcgccgcggcgctcctcgtcgtcgctgctgtctgcgcggacggcgccgccacgttctactcctccgaccccaacctcggatccgcgcgcgtcgtcttccagacgaattttggtgatattgagtttggtttctttcctcatgttgcacctaagactgtcgagcacattttcaaacttgtgcggcttggatgctacaacacaaatcacttcttccgggttgacaagggtttcgttgcacaagttgctgatgttatgtcaggtcgaaccgcccctatgaatgaggagcagaaaaaagaagcggagaaaacaattgttggtgaatttagtagtgtcaagcatgtcaggggaatcctctccatgggaaggcactctgatccag

SEQ ID NO: 44927 - DNA, 347 bp, Zea mays
  Clone ID: LIB3066-053-Q1-K1-C11
cccacgcgtccgcccacgcgtccgctcacgtttgcgattactctcttggacaactggccagggtcgtctttcacaatggacggttacatatatatccatacatcttataacaaacttcaatataaaagtcacatagatttaataattaggaaaaagaagtcataacactataagatcactggcttacattttgcccctttaaactaatcacaacttctgattacttctgcggattctagaatactacttgttaacgtcgactaattcgttcacagccaccacaaactaaagatatagagctataataatgataagcacaaacattaccctccaatattaatgctgat

SEQ ID NO: 44928 - DNA, 393 bp, Zea mays
  unsure at all n locations
  Clone ID: LIB3066-053-Q1-K1-C12
agtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgaccacgccgncagcaccgagtccaagatcga

SEQ ID NO: 44929 - DNA, 468 bp, Zea mays
  unsure at all n locations
  Clone ID: LIB3066-053-Q1-K1-C2
ccggacgctggcgtccgtggacctcgcgggccacgtggtggcggcgcccgagtactgccaggccggcttcagcaactacttcacggacgccttctggtcgcacccggcgctcaacggcaccttccacgggcgccgcccatgctacttcaacacgggcgtcatggtcatggacgtcgacaagtggcgcgccggcgggtacacgcgccgggtggaggagtggatggccgtgcagaagcggcggcggatctaccacctcggctcgctgccgccgttcctgctcgtcttcgccggccacatccgggcggtggaccaccggtggaaccagcacgggctcggcggcgacaacgtcgagggccgctgccggggtcttcatccgggccctatcagcctncttcactggagcggcaagggcaagccgtggctacgnctcgacgcccgncggccgtgctctgtggactacctatgggg

SEQ ID NO: 44930 - DNA, 396 bp, Zea mays
  Clone ID: LIB3066-053-Q1-K1-C3
ggactagcatgcagtccgagctcaccgagcaggcccgcaaaggtcgcaagatatacgtagcgtcggtcttctccggcgactagcccaccatctctagcgccgctgatgcggctgatctcgctggtctccagagaccgacggcgtccagcggtggccggaggagtcctgtgttcttcgtttccttaggtgtacttatgtgggttttggggtggcaagagagttttttttttgtgaactctggtgtatcggatcaagtgaatatgtacctacatgttgtgttcttaattctgcattgtacagctatacactatacaagggtacgggaatgctgaggtgtaacttccatgcaatatacttagttctattcatctaatcatcaaactatcagcaactttt

SEQ ID NO: 44931 - DNA, 433 bp, Zea mays
  unsure at all n locations
  Clone ID: LIB3066-053-Q1-K1-C4
ggtgtcctccgcccgtgcgctcatcggcctcctcgtcgccgcggcctccctcgccgtcgcggtctcngatggcggcgggatggcggcgcctgtgtacgggtacgcggcggngagccccaacgggccggagaactgggggaagctgagccccgcgtacaagctgtgcggggaggggaagcagcagtccccgatcgacatcgtcaccaagcaggccgtccccgccgccagcctcgacaccctcaatcgcacctacggcgccaccaacgccacgctcatcaacgatggccacgacatcacgctggcgctggagggcaaggttgggacggtgacggtgaacggcaaggcgtacagcttcgagaagctgcactggcacttcgcctccgaccacaccatcaacggccagaggttcccgctggagctgcacctggtccac

SEQ ID NO: 44932 - DNA, 175 bp, Zea mays
  Clone ID: LIB3066-053-Q1-K1-C5
ctgaccgcactcttacttttactattttttttacactatttttttttttttttcttactttattttttttagggacagttttattctatcattctcagtgatcaatactcctcactatacataatatacgaatactattattaatacaaacctcaatttaatgatcctctatcaa

SEQ ID NO: 44933 - DNA, 463 bp, Zea mays
  Clone ID: LIB3066-053-Q1-K1-C6
gacccacgcgtccggcaagagcaagcaagagaggacgacatggcggcgccacggagcctgggggaccgcgcgctgcgcggcgtggcggacctgataaagctgctcccgagcggcacggtgttcctgttccagttcctgagcccgctggcgagcaacaacgggcactgcgccacgctgaacaaggcgctgagcggggcgctggtggcgctgtgcggcgcctcctgcgccttctcctgcttcaccgacagctacgtgggcgcggacgggcgcgtgtactacggcgtggtgacgcggcggggcttgcgcaccttcacgcccgacccggacgccgatcgccgggacctgtcggcgtaccgcctccgcgccggcgacttcgcgcacgccgcgctctcgctgctcgtcttcggcaccctcgcgctcctcgacgccgacaccgtcgcctgcctctacccggtgctggagc

SEQ ID NO: 44934 - DNA, 295 bp, Zea mays
  Clone ID: LIB3066-053-Q1-K1-C7
cggacgcgtgggctcatgcgcgtcgcccactcgctcatcaagcgggccaccggtggggccgttgacgcgccggcgccggcgcccgccgcccgcgccaagattcattaattgattattaattcgttgattaatccgcggagcgccatacatatctcgatccatattgtatttgtttgtttatagtatatatcgatgtggggtacgtttatatgtacctgccattgtcatttcattaaaaaaaaaaacaaatacaaaaataaaaacagaaaaataatccataaaaatataaataaaa

SEQ ID NO: 44935 - DNA, 457 bp, Zea mays
  unsure at all n locations
  Clone ID: LIB3066-053-Q1-K1-C8
cccacgcgtccgaggattgagcacaggtctctccaatccaagtagttccagtacagggctgggcatgatgcaaccaaaatctgattctggatcactgtcgacgtcggtcaacaatgccgcacatgggctgctaagacttgcccctcctccatccacatcggttggaagagggcgcggtagaaatcaaggacagtccgcactctcccgagcatcaaggcctcatgccaactcggtatcaggacaacaacctatcctggatttactctagtaagagatggtcgcatctgttcttcgcgttcggattgtcaatgtgtacatcctcaaacctttgtaaggactgggggttcaactgcagtggtgctgtgagccgtgcatgcgatggacaactctcctatcgagcattttcatcaattcgctacacggccctacatcnctgtgcctgtgtgtgtaccactag

SEQ ID NO: 44936 - DNA, 397 bp, Zea mays
  Clone ID: LIB3066-053-Q1-K1-C9
gacaaaacatggatgtgaatgtgagaaccatgtggtcgtcgatgcgggcacagggtgcgatggctgtggtgttggtgttcttggtgagcggcgcatggtgcggtcctcccaaagtccccccaggcaagaacatcacggccacctatggcaaggactggctggacgctaaagcgacatggtatggcaagccgactggtgccggtcccgacgacaacggtggtggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatga

SEQ ID NO: 44937 - DNA, 464 bp, Zea mays
  Clone ID: LIB3066-053-Q1-K1-B5
agatcaccggccgtcgagcgagcagtctcccaattccacccaataactaataacatgtccgcgaactccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggggcggcaacgttgggatgcatcgtgtttggttcatccgattaattaattgttttttttatttacgtggtttgcgattggttaattggttgtttgttcgttcgtttcgtggtcgtgtga

SEQ ID NO: 44938 - DNA, 265 bp, Zea mays
  Clone ID: LIB3066-046-Q1-K1-E7
cagtggggctgctagaaaggtcttccaggttgtacatagcaaggaggtggatgttagcatgaatgcggtgtttgggcctgtgtcttgactgaaggcgcatagcaaaactaatacaaaaaatgcagtgtttgggcctaggcaatatctgatgaaaggttctggcttcgtgcccagtctactgtgtaattcgtgtgactagagtggtcgacatgtgtaaatcgaattaccgagtgcactacctaatcttctttagtttcaaaaacaa

SEQ ID NO: 44939 - DNA, 410 bp, Zea mays
  unsure at all n locations
  Clone ID: LIB3066-046-Q1-K1-E8
aaacccaccattcaagggtcttagcagaaatgatgtactggatggttcagatagtgctgaagcccaaaacacacaagaaccttctactcgatggggtctaggggactcatctaatttggcatctggccttgaggatgcaaacccttcatatccttatcttcctacagttcttgaggaacctggttcttctttctccgaagctgcagaggatgatccattgccaggcatagaagggcttcgaatcacaggtgaaccttttcctggacaagaacttcaagcaggtggatactccatcaatggtaccacaacttgtaattttgagtgggtgcgccatttagaagacggctcagtaaatttcatagaaggagcaaagcagcctagctatgttgntactgccgatgatgtggaca

SEQ ID NO: 44940 - DNA, 373 bp, Zea mays
  Clone ID: LIB3066-046-Q1-K1-F1
gtctccgatccgatccatcgtgcgagcatatccacggcgatggaggcgagagcggccatgagctggtactgcggctcccttctggccgtggccatcgcgctgttcctgtccgtgtccctcggcgtgcgcgccgccggcgccggcgccggcgtcgacatcaaggtgtcgtgtgcagcgacgccggacccggacgtgtgcctacgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcg

SEQ ID NO: 44941 - DNA, 338 bp, Zea mays
  Clone ID: LIB3066-046-Q1-K1-F2
gccacgcgtccgcatcatcgacacgtacggcggctggggagcccacggcggtggcgcctgctccggcaaggaccccaccaaggtggaccgcagcggcgcctacgtggccaggcaggccgccaagagcatcgtggccagcggcctcgcccgccgctgcctcgtgcaggtgtcgtacgccatcggcgtgccggagcccctgtccgtgttcgtcgactcgtacggcaccggcacgatccccgacaaggagatcctcaagatcgtgaaggagaacttcgacttcaggcccgggatgatcagcatcaacctcgacctgaagaacggcggcaacaggttcatca

SEQ ID NO: 44942 - DNA, 433 bp, Zea mays
  Clone ID: LIB3066-046-Q1-K1-F3
gccttaccctcgaagccgaaggcctcgtgccttctcttcctccctggcatggaggaagtagctgtttcgcctatgatcgttgccgccgtagtgctggacaacaatggcgctgacgcggtctcctgcactgccatccctagcgtaacaataagcctagaggagaaagaaaatatcaatggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgcggggcgttcagcctcttcagggcgatgttcctgtccttcggccggagcgacgacagcatgaagaatgacagacgacgacaccacgagccccaagaagagagccatc

SEQ ID NO: 44943 - DNA, 226 bp, Zea mays
  Clone ID: LIB3066-046-Q1-K1-F4
cccacgcgtccgcccacgcgtccggaggcaagggacgtaagaagtgcattacctggggtggtcccttaatgaatccacgctcctagacgcgtacatcgccatgttcgtcactgagtttctccgacagcttggcatgctgagcagttcgctaaatgttcttcgtgctgagaatgtcagctatgatcggcctagattcagcggtactgcgctcttaatcgacagggaa

SEQ ID NO: 44944 - DNA, 317 bp, Zea mays
  Clone ID: LIB3066-046-Q1-K1-F5
ctagatcgcgctcggccaatggactttgttcgagtatattcacttttcattgatgggaaaaaaatgttaggtctttttatgaagcctggttgagcaccatcggctctacccaaaaacttaacctagttatccagcatctttctgatactttggcatttcgcaagctcatgtctataccttggtttcttcccagcccatcgtgttgggatggtttgatacatgttcagaaagcagatgtgagaaaccatactaaaataatacgttgatgctgatccatttttgggtcttgttaaaaaaaaacccttacaatcgaaaga

SEQ ID NO: 44945 - DNA, 231 bp, Zea mays
  Clone ID: LIB3066-046-Q1-K1-F6
gtagttcatatggcggaaggacactgtgtgcatgcatgttccatcgtgcgggctcggttttctttgaacacaacacagatgtagcaggcatgagcgatcgtgcgatggcatggctggctaacctgtctcggatgctaaatgaaacccgggttcctttctcaagtgttaggagcataactattgtcacatcaatggtcttgagccctaaatttcatttgtaggtcgttaatt

SEQ ID NO: 44946 - DNA, 371 bp, Zea mays
  Clone ID: LIB3066-046-Q1-K1-F7
cccacgcgtccgcccacgcgtccgcccacgcgtccgcccacgcgtccgcaagctgctagaacgtggagaaaggtccaaggggatgaggaagtacaatgctatcgacaagtggaatactcagctgaagtccatttaccaaacattgtccaacagagtttgatgagaaggatcgctgctgctgcgtgcattgcacacctagcattgttgatagcctgttttgcggatttgagggcaactgcaaagaactgtctggtgacgcttgcgatagaatcctggatctgggtaaagttaatattgactacgaggtcgtctctgaattaaacaagataatcaagcgactacaagcaaaaagaagtgaacctatgacaaag

SEQ ID NO: 44947 - DNA, 428 bp, Zea mays
  Clone ID: LIB3066-046-Q1-K1-F8
cccgtttcccctcttcctcctcccctgcgatcttctccaccgcatcacctccctcgaaccctagacccacccacgcgcccattgccttcggtcgccatgtccgccgctcagcttctccgtcactcgcgcaagctgcggagtttgcaaaatgctgtaggttgtgagaattttagttttgttcggcatttctccagcggttctgggtcctttatcgccagggaaaatggtattggaaaaagaaccagaggtaccagattttcccagcataaccagcctgcaaaacagctcgagacattctcagcaggagtaaatggaagctgcacttggagaatagcatccaacagccttaccccaagtgctgctagctggctcagtggttcattctcatgtggacaggtagtctcagcgcggccattctcaagtagtgc

SEQ ID NO: 44948 - DNA, 400 bp, Zea mays
  Clone ID: LIB3066-046-Q1-K1-G1
agacactgagctggtctgtttagttggaaagccatctgtacgtttttcgccgatcatggaggatgagaggaacacccagcagcaccagggcggtgagcaggcccaggaccaggagaacgaggtgaaggacaggggactcctggacagcctactcggcaggaacaagcacgacgaccaggagaagaagaaccagcaggcggaggaggagctggcgaccggcatggagaaggtcacggtggccgagcccgaccacaaggaggagggacacgaggccgccgagaagaaggacagccttctcgccaagctgcaccgcaccagctccagttccagctcgtcgagcgacgacgaggaagaggaggtgatcgatgagaacggcgagattgtcaagaggaggaagaag

SEQ ID NO: 44949 - DNA, 114 bp, Zea mays
  Clone ID: LIB3066-046-Q1-K1-G2
atcgacgaagactatgacaagcagttctgttgtccgaacattgattatgtgagcccattgatacgctaaatgtatgaactagtttttatttacaataaattactaattttttct

SEQ ID NO: 44950 - DNA, 130 bp, Zea mays
  Clone ID: LIB3066-046-Q1-K1-G3
atcgaccaagactatgacaagcagttctgttgcacgaacattgattatgtgagccgggtgggacgctaaaagtatgaactagttcttatgtacaataaattactaattatatctaaaagaacggaagaat

SEQ ID NO: 44951 - DNA, 434 bp, Zea mays
  unsure at all n locations
  Clone ID: LIB3066-046-Q1-K1-G4
cccacgcgtccgcccacgcgtccggccggtccgacgacctcgagacatggctcacgggcgtcatgacgttcatggacacctgcatcgacggcttcgtcgacgagaagctcaaggccgacatgcacaccgtgctgcgcaacgccaccgagctcagcagcaacgcgctcgccatcaccaacagcctcggcgggatcctgaagaagctggacctcggcatgttcaagaaggactcgcgtcgccggctcctgtcggagcaggacgaaaaaggctggccagtgtggatgaggtcgccggagagaaagctcctggcggcgggcaaccagcctaaagcgaacgcggtggtggccaaggacggcagcggccagttcaagaccatncagcangccgtggacgccatgcccaagggccagcangggaggtacgtcatctacgtg

SEQ ID NO: 44952 - DNA, 381 bp, Zea mays
  Clone ID: LIB3066-046-Q1-K1-G5
gagaaaagaaaaatgaatacaaatgtttctgtttctgaagatgttggtaagaatgttggagttaagaaaggaggatccatggaaggggagcttgtagaaggagttaggaggagcagcaggttggagtctaatgatgaaatgaagattgcagataaggcagcagcaagagcaatggctaaagatgcattcattaacaaagatcatttctaacggctccttttaccattaaggagattaaaaaagtggttttcgagatgaaacataatagtgctcctggtccggatggttttcctgcggaattctttcaaaacttttgggatttgattcaaatggatgtttggaacttattcaaggatttttatgttggaaatcttgatattg

SEQ ID NO: 44953 - DNA, 423 bp, Zea mays
  Clone ID: LIB3066-046-Q1-K1-G6
cccacgcgtccgtttttttttacatgttttttttaatcaaaactttataaataaaggaatagaatagtacaccataacaacatacaacagctttgcctcgatcgagagcatgcatgaatcacaggcgtcgtcgaatcaaaagaaaggaagaaacaaaatgatgtgtggggtgggggtttggtgcatggccgtcgctgttaaaattcgacacaggacagttgcgtaaatagacctagcgtaatcagctgcacaaacgaatgagagagcgagcgagggaagcaaaatctgggtgaggagatgaatagatgatgacgggagcgcagcgcggcctggcagactgggcctaggcagtaggcacctgctccgatccttgtgctctgctgggcctaggcaccgccgcggagtttggccatgttcctcttc

SEQ ID NO: 44954 - DNA, 403 bp, Zea mays
  Clone ID: LIB3066-046-Q1-K1-G7
cccacgcgtccgcccacgcgtccgcccacgcgtccgggaccacctctcctaatattggagttcgtttaggggatacagtcctcttcgctggcgatttcttctctcacactacaaggaggggaactctacgagctcgcgctcgttgcctgccatcccacttcctctctccacctcgtctttggaagtctccaaagcgattgtgcagtctggcaggacaacctggaggattcttcgccgaacgagttttccgagcgcggagggtgcgcatcgatccacagcgtgacctctcctacccgatctggttctttggatctcaaactactcagtctccgccactgcgccacaccaccgcgtcgcagcaatgccgtcgccgcgacgaaagctgaaggcggcctcgtacgag

SEQ ID NO: 44955 - DNA, 434 bp, Zea mays
  Clone ID: LIB3066-046-Q1-K1-G8
gacgacgccatgtcgcggacgcggacgctgctgggccacaacctggagccgacgccgtggcacccgttcccgcacgacaagggccggccgccggcgcgcgcggcgctgcggtgcgcgccctccatcgcctgcctgccgccgctatcaccgtcgtcgtcgtcgtcgccgccgcaaggtaacaagaagaagaagcagaagcagtgccctgcctacttcgctgccatccaccgggacctggctccgtggcgcgggcagggccggggcgtgacgcgcgcgctcctggacgaggcgcggcggcgcgcgtccatgcgcgtcaccatcacgggcggcgggcggcggctgcacgtggacctctactacgcctgcgtgcagagccgcgccctgttcacggtgtggagcctgctgcagctgatgcggctgttccccgggcgcgt

SEQ ID NO: 44956 - DNA, 428 bp, Zea mays
  unsure at all n locations
  Clone ID: LIB3066-046-Q1-K1-E6
gtgggactgggcttttcaaatcaacagatgaagaatccccactgatatccatggacgacgaaggatggatcacaattccgtgcaaggcacttcctgaaagttggaacgacatatcagaaatggttcagttgcaggctctggaccgttccttcctttttccagttatcaggcgagcaggttcctatactggcgtgcctgtcagcttctaagcaagatgtacaggttatatccccctttagaattgccgcagtaatgtctaagaatggaacttctatgcaaaactttacaaataaatctagccctgtcagtgcaaatggtcatgataatggagcagctggagaaagtggctatgaggatgttgaacccaatggtgaagcatctncttcaggacatgatattttggagactcaatctctccttcagatgga

SEQ ID NO: 44957 - DNA, 136 bp, Zea mays
  Clone ID: LIB3066-046-Q1-K1-H1
aaaaagcatcagctaacgatggctggagcccaggcactgctaatagcacttgcgggtgccgtagatgacctggacgggcggccagcgattgtaggcgatggagacggcgaggtggcggatatctggatgatgactt

SEQ ID NO: 44958 - DNA, 385 bp, Zea mays
  Clone ID: LIB3066-046-Q1-K1-C4
ggcgataagagcaacgcaggcggcttcgccaccttcgcctcagccaccttctctgctgagggcaacgggttcatctgcaagtcgatggggttcgtgaacacggcggggccggaggggcaccaggcggtggcgatgcacgtgcagggcgacaagtcggtgttctacaactgccggttcgaggggtaccaggacacgctgtacgtgcacgccaaccggcagttcttccgcgactgcgaggtgctgggcaccgtggacttcatcttcggcaactcggcggcgctgttccagaactgcctcatgacggtgcgcaagcccggtgacagtcagtccaacatggtgacggcgcaagggcggacagaccccaacatgcccacaggcatcgtgc

SEQ ID NO: 44959 - DNA, 399 bp, Zea mays
  Clone ID: LIB3066-046-Q1-K1-C5
gtcgtggtcgagttccagcacggcggcacgctgaagacgctgctgtacaaccaccgcgacaagaagctttcctacaggaaggtcgtccggctcgcgctcgacctcgccagagggctgagctacctgcactcgaagaaggtgatgcaccgcgacgtgaaggcggagaacatgctgctggaccggaagcggacgctgaagatcgccgacttcggcgtggcgcgcgtggaggcgcagagctgcgaggtgacggggcagacgggcacgctgggctacatggcgccggaggtgctgcaggggaagccgtacgaccacaagtgcgacgtgtacagcttcggcatcctgctctgggagacctactgctgcgccatggcctaccccaactacagcctcgccgacatc

SEQ ID NO: 44960 - DNA, 398 bp, Zea mays
  Clone ID: LIB3066-046-Q1-K1-C6
gtggtgctctctgtgccgccttttgcaggggaagggggtctgggttgcgtacaggggaaaggcacgcgccgccgctgccgcgcgagcctcttcgtgcccatcgtcgcgcagatggatccgtcgttggagcccatgtacgcgcaggtcgagccgtacgactccgggttcctcaaggtctacgatgtgcacaccatctactacgagcagtccgggaacccgcacggccatgcggccgtgtgtctccacggcggtcccagagccggcacgtcgcccgtcaacaggaggttctttgacccgcagttctacaggatcgttctgtttgaccagaggggtgcaggcagaatcactgccaatgcttgcttagagcagaacactacttgcgacttggttgctgacat

SEQ ID NO: 44961 - DNA, 263 bp, Zea mays
  Clone ID: LIB3066-046-Q1-K1-C8
atcacacgtacgctcgcggttctgaaatacaccactgacgcagactgtctgaggtgggcaaccgcttcatgtgccagctgcttgggctagctaacgcaggtcggtcgcagaagcggccgtactctgtgtccatgatggagctcagcgaccccattgtgctgtacaacttgcccttcgacgtctacgagcacacgctgtacgtgcacgccaaccagcacatgatcaagccatgcgaggcgatccatgacgattactacatgatc

SEQ ID NO: 44962 - DNA, 416 bp, Zea mays
  Clone ID: LIB3066-046-Q1-K1-D2
gtgtgcatgatctccaactccaccagtgttgtggaggtcttctcccgcattgaccacaagttcgacctcatgtacgccaagcgcgccttcgtgcactggtacgtcggtgagggtatggaggagggcgagttctccgaggctcgtgaggatctggctgcgctcgagaaggactacgaggaggtcggtgctgagtttgacgagggtgaggacggcgacgagggtgacgagtactagacgctctactggcgcggcgtcgtcgggcttgtgtgccactgctatcctgtgatctgccctgagtggctcctatcgtgttatgtttctgtcggttcttatctatctgtcgttgtgtggtttacaacttacgttgtaagactttattcccccgctttgctactgggttattaagttttggcgtt

SEQ ID NO: 44963 - DNA, 405 bp, Zea mays
  Clone ID: LIB3066-046-Q1-K1-D3
cccacgcgtccgcgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgt

SEQ ID NO: 44964 - DNA, 277 bp, Zea mays
  Clone ID: LIB3066-046-Q1-K1-D4
agcgtttgttgcctagcgatatcagggtgtgaccattcgtttgaaacagtgctccgtctgtttttggactacataattttggcacaaagcaggtgtacaaggttaaaccttttaaaactttcatctatttgtttcgggatagtttggtgtgtgggggggtttgtctcgatcctttgtgctactgcaacatttggtcactggacatcgtgaatgagctaattttaaacatatgaaactgtattacacatgccatgacaattgatgatcaatgctaacc

SEQ ID NO: 44965 - DNA, 378 bp, Zea mays
  Clone ID: LIB3066-046-Q1-K1-D5
cccacgcgtccgcccacgcgtccgcggacgcgtgggcgcgccctgctgcccaagaagcggatccgcgcagggtgaccctggcgcgcaggacgggacgtcgtggatctggtgtccggtccgccattggccgtggcgacgccgtcagtcagtaagtgcgcggtcctggaatggtatagagctatcgtacaaataagttctgttttttttggtggctgtagaattgggaaagaggctgttgtttatgagggaggatgaatggggaattgaaagcttgtaaagagaattcctacagatttgttcgttgtatctgttaaactatacttgctgacagttcaagaataaatgatgagctttcacctgaaaaaaataaccatggtt

SEQ ID NO: 44966 - DNA, 260 bp, Zea mays
  Clone ID: LIB3066-046-Q1-K1-D6
ataagacacatctccccttctcacccaaccctccaagcaacattgaccgcaaagggccatccgctgcggtcagtgtaggtttctgaatcatagcttggcgatgcctgaggctagacaaatactgagctagccttcagaaaaaaagagaaaagaaagagattgagaagcagggagaaaaaatggcactggcccattgaggaagcttgagaaccagttaacaagaattgccaacatattcttggacaatcttgttaacatag

SEQ ID NO: 44967 - DNA, 419 bp, Zea mays
  Clone ID: LIB3066-046-Q1-K1-D7
cccacgcgtccgaactgaacgggcacatcaatagtctctggcctccaagggaaattgggaaattcagattgaacgtggctgcatcatttttcctttcattggtcttttcagcaacagcgatccattctcgtgggagggagagagagagagagagggagagaaatcaaagaggagagtgatcatggagcatgtgattggagggaagtataagcttgggaggaagattgggagcggatccttcggagagctatatctcggtgttaatatacagaatggagaggaagtgggaataaaattggagcctgtgaaaacaaaacatccacagctgcactatgaatctaaagtttatatgctgctgcagggtggaaacggtatcccacacctcaagtggtatggtgttgagggggagtacaatggta

SEQ ID NO: 44968 - DNA, 259 bp, Zea mays
  Clone ID: LIB3066-046-Q1-K1-D8
cccacgcgtccgggttattcattcgtccttctattatctttgcctttgtcttgtttggtaagatttcactacttctgcggggtgtcacagtcttaagatcatggtgtttttatgtctcaaacatggtcgcaattgtgacattaggtagatgggagatttttgactgagttttcgtgttttgtgagcgaagtcaaggtaggaaatgatgtccgagagtgaagagcatggctcgctcctagacaagatcaacggacagatc

SEQ ID NO: 44969 - DNA, 385 bp, Zea mays
  Clone ID: LIB3066-046-Q1-K1-E1
gcgcccacgcgttcgtactgaactgtcacatcaatagtctctggcctccaagggggatggggaaattctgatcgagcgtggctgtatcattagttctttcattggtctattcagcagcagcgatccattctcgtggaaggcagagagagagatagagggagagaaattaatgatgagagtgatcatggagcatgtgattggacggaagtataagcttgggaggaagatcgtgagcggatccttcagagagctatatctatgtgttaatatacagaatggagaggaagtgcgaatcaaatcgtagcctgtgaaaacgaaacatccacagctgcactatgaatctaaagttcatatgctgctgcaggatggaaacggtatcccacac

SEQ ID NO: 44970 - DNA, 355 bp, Zea mays
  Clone ID: LIB3066-046-Q1-K1-E2
cgagggccagctccgccgcgcgcgcaaggcgctcaccgacgtcgccgcgctcctcgtcgacgacaccgccgcgtccggcgccggcggcgtcgcctccttcctgtcctgccaccgcaaccgctccttcggccgcgcgcgcgcctccccgtcgcgcagcgccggcgccagcgccagcgcctcagcctcagcctcccacttccgctccctctcctggagcgtgtcccgcacctggtccgccgcgcgccagctgcaggccattggggccggcctggccgcgccgcgcgcgcacgagccgggcctcgccgtccccgtctactccatgggctgcgtgctgcacctcaccgcgtgggcgctc

SEQ ID NO: 44971 - DNA, 111 bp, Zea mays
  Clone ID: LIB3066-046-Q1-K1-E3
aattgttctctcgtccttgcattgcccattacatgctatccattggtaacgcacaacagtaaaatgacagacatccgacagctatattatgttcgacggtgtaacaccctg

SEQ ID NO: 44972 - DNA, 429 bp, Zea mays
  Clone ID: LIB3066-046-Q1-K1-E4
cggttcggaattctcgaggcaagcctcccgttcgatctctaccatccagggttgttttctgcatgctttccatggatggctcacagggggctaatgccctacatacagacaatctttcatgtccatacggtctacatcactcatctacttagtcatctggcgttcgctctctagcactaatattcttatgcgtgtatagctacttgatgaatctgatatagcgtcatccaaatccacttcagtggccgcattttcacatcttcatggatgtgaaatctctggcgaacctcaacttaatcgacttctacaagatcgcacttactccatctgtggtactacagctcatacttgtactgatcggcgttacttacagtacggcaccttgaatgtcatatagcgagcgcagtatactagctctttagtcactgc

SEQ ID NO: 44973 - DNA, 405 bp, Zea mays
  Clone ID: LIB3066-046-Q1-K1-E5
cccacgcgtccgcggacgcgtgggggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggtggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgagaggcgcagtgggccacggcacagatgacgct

SEQ ID NO: 44974 - DNA, 401 bp, Zea mays
  Clone ID: LIB3066-046-Q1-K1-C3
ctcgtattaacggtcggcggtgggtgtggagcgggacggggcggcgagatcacgacgagatggagactgacatctcttcatgcggaggcggcggcgcccaacagcggggtataggacctgtggaggtgcaagcggcgacggcagcactgcggcggtcagaggtgttccacgtcttgaaggagctcgtaggcttcgtcctctacatgcaccaccagatcccctcggttttgccgagtcttgaaaatgaatttgcaagtttaaaggaggaaatgacagaaatggcattacaaccagctgaactcaaaccatctgatcggagaaagtacaacacacgaaatacggaggttagacgtagaataaagaagcacgagaagttgatgaatggcatctctaccttactc

SEQ ID NO: 44975 - DNA, 464 bp, Zea mays
  Clone ID: LIB3066-045-Q1-K1-H9
cccacgcgtccgcccacgcgtccgggggcttgcccttcactttagcagttcaataaatatagagctcagatgtcaaaacgaagtatacaccacaaagatcaaaaggagaatcatccagtcatccgctactactacttcgtcatgtctactacctttgatataaaattttcacctcctggctactacggatgatctggatttctccgtcgtttcttgctggaaatcttaatttaataatgttctgcttcagattgcggagctgagaacaccgtgaagctagtagacgtcgtccagtgccgtgaatgtggccaccgcatcctctacaagaagcggacccgtcggattgtccaatttgaagcacgctgaagagtgacgacaggggaaaaacactggagatggttgatctattactcgccactcacctatgtaaagagtcttgtgagggaaatgaaagtgtcagacat

SEQ ID NO: 44976 - DNA, 141 bp, Zea mays
  Clone ID: LIB3066-046-Q1-K1-A1
cggacgcgtggggaaaaaattgtgaatctgttatgatgcgtctagaaaagccaaaacagattttgttatgtgcgtagaatttgttagagagacgagggaaatggattttatgcagtcattttgcatgcaaatgatttatag

SEQ ID NO: 44977 - DNA, 404 bp, Zea mays
  Clone ID: LIB3066-046-Q1-K1-A2
cccacgcgtccgcccacgcgtccggttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccggcagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatcctgtcaccgtgttcatcacagacatgaactacg

SEQ ID NO: 44978 - DNA, 329 bp, Zea mays
  Clone ID: LIB3066-046-Q1-K1-A3
atgacgatagccgacgtgctctgcctgctcctcttctctggccgtctcgccgcggcggagaagactttccgcggaggtggaggcggaggctaccgcgggttggaggccggtggcggaggcggcggcagctattccaccccgagcgaggcggcgccatccacgcctgccgctggggagacgactaccccttcgtcaggcggcggttacttcactcctagcgtggcggcgccatccacgcctgccgctgaggagacgacgacgactgcttcgtcaggcggcggcggttacggcggtgcaaccggctaggcttcctgacgcggcggcggact

SEQ ID NO: 44979 - DNA, 377 bp, Zea mays
  Clone ID: LIB3066-046-Q1-K1-A4
gaaccctccctcctcgcccagtcctcgatcccggccggccggcagagatctcgccgtcgtcgcgcgctctacctgcgccccgctgatgagttccgagagcgactccttggcctcacggcggtccaagaaacccaagtattccaagtttacccagcaggagcttccagcatgcaagccaatgttaactcctggaatcgtcatcggtgctttctcgctcatcggtgtcttcttcgtcccgatcggcctcgcttcgctatccgcgtctcataacatcgttgaggtgatagatcgatatgacgccgagtgtgtgtccgccaacgacaaggtcggcttcatccaggacgccaagaccgacaaggcgtgcacaagaaagatta

SEQ ID NO: 44980 - DNA, 360 bp, Zea mays
  Clone ID: LIB3066-046-Q1-K1-A5
cggacgcgtgggctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgctagccgtccccggg

SEQ ID NO: 44981 - DNA, 407 bp, Zea mays
  unsure at all n locations
  Clone ID: LIB3066-046-Q1-K1-A7
cccacgcgtccgagagcatcaaggattctgactgcccaactgagcttgtgccggctgatgagaaatctatagtgaatgtgaatcttgtccggacggaagaagaatttactgagccagtcaagcgtgctgctccttttgaaggggaacgaagaaacctcatggaaccttctgataataatacttccaatgctgctgctgctgctgctgcttccagtagtgcaactgcttctcggacaatcacagtggacgattctttgccatcaacctccctccaaatcaggttcgcagacggcagtcgcttggttgcccgtttcaacacaagccacaggattagtgacgtgcgggcatttatcgacgcgacaaggccaggagccagtgattacacgctgcangccgggttcccccca

SEQ ID NO: 44982 - DNA, 106 bp, Zea mays
  Clone ID: LIB3066-046-Q1-K1-A8
ctatatatagtgtacatgtgacatatgatccacaactagctggtgatggactgggggaacaacagggatgtgtccgggatcaagctgatcagggccaacgttttac

SEQ ID NO: 44983 - DNA, 389 bp, Zea mays
  Clone ID: LIB3066-046-Q1-K1-B1
cccacgcgtccgtcgagacgcatacatgctcaagatatttgaagacaacccggcagggcttccaggttggtgcaacgcatacactgacaagctgactttttgccagattctcggagagtacagaatggagttaccagagtacaacacgattgaaccttatgcgaaaatgaacgagaactgtacagccttgcccgcaacgtacaaacgagccagacgctgctgactacgagattgtctactatgtatctcactgctgctgcttcatatacacagcggcagtagagtgttgtagctatgttctcgaagtaagagacactatatatataggcgcttggtagatggtagctcttaccagtaatgcctatgcgatgtatttaggttcacggctt

SEQ ID NO: 44984 - DNA, 379 bp, Zea mays
  unsure at all n locations
  Clone ID: LIB3066-046-Q1-K1-B2
cggacgcgtgggcggacgcgtgggcggacgcgtgggccgacgacggccgcgggcctgctccgcgtcttcttccacgactgcttcgtcagcgggtgcgacgcgtcggtgctgatcgcgtccacccagttccagaagtcggagcacgacgcggagatcaaccactccctgcccggggacgccttcgacgccgtggtgcgcgccaagctggccctggagctggagtgccccggggtggtgtcctgcgccgacatcctcgcactggcgtcgggcgtgctgattaccatgaccggcgggccccggtacccggttccgctggggcgcagggactcgctgtcgtcgtcgcccacggcgcccgacgtggagctgccgnacgccaact

SEQ ID NO: 44985 - DNA, 338 bp, Zea mays
  Clone ID: LIB3066-046-Q1-K1-B3
gtcctcgaccatccctgcaaattaccgcgatggctcccaagatcctagtcatccttgcgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtacccgacaaacttgccaagcctctggcgtcgctgcccgccgataaggtgcggccggcggtggagaaccacgtccttctcagttacttcgaccccatcaagctggacgagatgaagacacgcacc

SEQ ID NO: 44986 - DNA, 381 bp, Zea mays
  unsure at all n locations
  Clone ID: LIB3066-046-Q1-K1-B4
gcgagctagcgagcgagatccccctctcccgctgccggatccgatctgacctgacctcgtcgccgcctgccgtgggagggagaagaggaagaggaggcggaggcggcggagatggcaccggtgtcagcgctcgccaagtacaagctcgtcttcctgggggaccagtccgtcggcaagacgagcatcatcacccgcttcatgtacgacaagttcgataacacctaccaggctacgattggtattgatttcctgtcaaagacaatgtaccttgaagatagaactgtgagactccaactctgggatactgctggtcaagaaagattcaggagtttaattccaagctatattagagactcttcagntgctgtcattgtattcgat

SEQ ID NO: 44987 - DNA, 413 bp, Zea mays
  Clone ID: LIB3066-046-Q1-K1-B5
caaaagatgtaaaaacgaaagagaaggcagggaaagagtccaaagacctggaagtgaaaggggaggcagggaaagaatccaaacatggcgaagcgaagaagccagagaaggactcaaaagatgtaaaaacgaaagagaatgcggcaggcgaagagtcgaaagacgcggaagtgaaagaaaaggcagtcaaggacccaaaagatgtggaaatggaagggatggcaggaaaggagcccaaagatgtggaaaagctggatggccatactttgagcaacgaggaatcagacaacgatactcttagcgtgtggaaaaaacgtacagcaaaagcaacatagtcttgctttctcagctgaccattcatagtaggatttgcagatttcacaggcaggcaaacgttcggagatgtggatatc

SEQ ID NO: 44988 - DNA, 404 bp, Zea mays
  Clone ID: LIB3066-046-Q1-K1-B6
cgcgccgtggtgtggagcaaggggggattcgccttcaccgtcgatcgccgcgtgcgcctctcggcatatccgccactacactagacgagcaaactactgtggatcatgaggcccagcagatagaagtagctgagcaggagctcattgaaggaaagctagtgaacgactaccttacccgaaaggggcaagggcagtaggagagtggttagtgtagggaggtccttgggttgattttgctgcgatggcggtcaggcgagggatctctgcactggagcttcctataaactgtagcggattatctgaagctagtggaactatgtaaaggcctcgtagcgtgaccctgcctcgcctcctcggtagaggtgtatgggattggtcgtctcttggcacatgggtaacatgac

SEQ ID NO: 44989 - DNA, 371 bp, Zea mays
  Clone ID: LIB3066-046-Q1-K1-B7
cccacgcgtccgcattcactaatccaagacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacatgtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcct

SEQ ID NO: 44990 - DNA, 89 bp, Zea mays
  Clone ID: LIB3066-046-Q1-K1-B8
cggacgcgtgggcggacgcgtgggctgacgcgtgggtgaatttgagggtataaaaggtcttctccaaataccaaccaaatttaggggtt

SEQ ID NO: 44991 - DNA, 342 bp, Zea mays
  Clone ID: LIB3066-046-Q1-K1-C1
gacgatgacgatagccgccgtgctctgcctgctcctcttctctggccgtctcgccggggcggataagactttccgcggacgcagaggcggaggctacggcgggttggaggccggtggccgaggcggcggcggctattccaccccgagcgaggcggcgccatacacgcctgccgctggggagacgactaccccttcctcaggcggcggttactccactgctagcgtggcggcgccatccacgcctgccgctgaggagacgacgacgactccttcgccaggcggccgtggataccgcggtgcaacccgcaaggcttcctcaggcggcggctgactggaccccga

SEQ ID NO: 44992 - DNA, 347 bp, Zea mays
  Clone ID: LIB3066-046-Q1-K1-C2
cggacgcgtgggcggacgcgtgggctttttttttttttttactagaaattgaaacttgatcaatctttcttaatctatatggattggtgtaaccgaacaagcacaaatgtgatctacttttacaaaattcgttcatgggagcacgggaaaaaaaaggaattcccacaccatggagactccaagaagaattgtgcgcatatgcatgttctaagtgctcgttcggatccagcagttgcccctgcgccatcgatccctgccgatcccggcctgggccctgcgcagccgggccttgtagtccttggcccacgcgcggagctgtgccttgagcttcttgaggtcggcggcgg

SEQ ID NO: 44993 - DNA, 458 bp, Zea mays
  Clone ID: LIB3066-045-Q1-K1-H8
aaacaatttccaattccgttcctggaggacgtctgcacggggaccttcccagcgggcgacggccggctgcatccatggcggtggccttcctgctgctgggattgggtttcctccttggcctcctctccctggcgatcgcggaggggctggcgctcctttgggccatccgaagcctcacgcgccgcacatcggcctcacgcagcacgccgccgccatcactccccatccacccgacgccggcgcggtctgtgtctcgccacagcctcaaccgacaggacacctcatttcatccatccactgctgcagtattccacacgttcacgacctgtaccttaacacctttcccattctatctacgagtaaacagggcttcttatggatgctggagcaacccaaggatagcagcatcaatggcgctagcccagggatcagagacaggaagctcctcgtcgaggttt

SEQ ID NO: 44994 - DNA, 409 bp, Zea mays
  Clone ID: LIB3066-036-Q1-K1-C8
tcgagcgtgcccctgcggggggctgctcgtggatctgatctcgtcaattgtcgtgctatgtttttctccagcggcacgaagtgaagaacacgtttttgtgacgccatggctgtggaaagagatatatttggaatttctgggccaacgtatctgaaatcaatcgattggaactgtgagcataatcggagatctgtggctgcaagcttagttcatgctgtatatgtgttggagagagaccggcaactgaatcatcaatcttttgaagccttggcacctgcttggtgggaattcctccattttgagctgattcgcaagctgattgatgatgctgatatgtccatatttggtgcaatatttgaattcaacccttcaaggaggaagcttctggtgcatatgctccaagatttgt

SEQ ID NO: 44995 - DNA, 384 bp, Zea mays
  Clone ID: LIB3066-036-Q1-K1-D1
cccacgcgtccgcatcgtcgtcgtcaacgaatccgcacaaggaaaagatggagaagaagccgaccatcctcatgaacaggtacgagctcgggcgcacgctcgggcagggcaccttcgccaaggtgtaccacggccggaacctcgcgttcggcgagagcgtggccatcaaggtcttcgacaaggagaaggtgatgcgcgtcggcatgatcgaccagatcaagcgcgagatctccgtcatgcgcctcgtccgacatctcaacgtcgtgcatctgcacgaggtgatggccagcaagagcaagatatacttcgccatggagtacgtccggtgcggcgagctcttcgcccgcgtcgcccgtggtcggctcaaggagacgccgcgagaag

SEQ ID NO: 44996 - DNA, 417 bp, Zea mays
  Clone ID: LIB3066-036-Q1-K1-D2
cggacgcgtgggcgccgctttgggttggggtttaagcgcgtgtaagggaggccggaggcgacgacgacggcgccggcgtcggagaagaagaagcagacaactctcgtatatgtcttcttgccccttttccgatctggtggtcgtagcgctcatcatcgccgtcgtcgccgtcatcctccgcgccctcgcttgctctggccgatctatgcgcaaggggctcaacggctggaacaaatcctcgtcgatgctcagggacgggttcggggtgaagtattccggattcctccacataaggccgtgcggcttctgtagaggagattgacggattcggccgatttgcgctcgtctccgtcattttttttttttgcacccagagtttctggtttttctttagaagttttccccccatagttttgg

SEQ ID NO: 44997 - DNA, 365 bp, Zea mays
  Clone ID: LIB3066-036-Q1-K1-D4
ccgactcgtccgcggacgcgtgggggttcttggacctatcagatcttctagagttgcatctattctgtgcataccgatcctttatgtctaccgctacatgacgtacctgtcggaacctggatcgtgaatcgttatgaatattgcgtcagtgataaagaataatctcggtgtcaccatcattacaggcactttcatccttcaaaacaatgccgtgcctcacgaccagcgatgctctgcgaatggactgtccatgactggtatgtgctttttcaaggcacttgctccagcttgagcaagcatcgtgttctcatgggcgcataaacgccagcatgcgttgttcttaccaggtgaccagatggtattct

SEQ ID NO: 44998 - DNA, 337 bp, Zea mays
  unsure at all n locations
  Clone ID: LIB3066-036-Q1-K1-D6
ggagaacggctccgtcgccgccggcggagccggcaacggggcggtcgccgcgtctaacggaggaggtgttgagaggaggctgaggtcctcggctgcgcccgcgtcgtgcgcagcccagcttgccctgcaggtgggcacacgcgtgatgtgccggtggcgcgaccagaagctccaccctgtcaaggtcatcgatcgccgcaagggctccgattcctatatccccgctgactacgagtactacgtccattacaccgagttcaatcgaacacttgacgagtgtgttaagcttgagcagctngatctcgctactgatgagaccgatgctgacgagaaagtc

SEQ ID NO: 44999 - DNA, 378 bp, Zea mays
  Clone ID: LIB3066-036-Q1-K1-D7
gtgtaaatgatgcaccagctttgaagaaggctgatattggtattgcagtagcagattctactgacgcagctcgtagtgcttctgacattgtcctaactgaacctggccttagtgtgattattagtgctgtgctgacgagtcgggcaattttccaaaggatgaagaattacacgatctatgctgtatcgattaccatccgtattgtgcttggttttatgcttcttgcgctgatatggaagtttgacttcccaccatttatggtcctggatcattgccatcctcaatgacggtaccattatgactatctcgaaggacagagtaaaaccatctccacaaccagacagttggaagttagctgagatttttgcaactgggagt

SEQ ID NO: 45000 - DNA, 396 bp, Zea mays
  Clone ID: LIB3066-036-Q1-K1-D8
cggggagcgcggccgacctggcctccgggggcaggaggtcgtccggcgtgccggtgttcgtcatgatgccgctggacaccgtcaaggagtgcggcaccgcgctgcaccgtcgcaaggcggtgcaggccagcctctccgcgctcaagagcgcgggcgtcgagggcgtcatggtggacgtgtggtggggcatcgccgagcgcgacggcccgggccggtacaacttcgcgggctacgcggagctcatggagatggcgcgcaaggccgggctcaaggtccaggccgtcatgtccttccaccagtgcggcggcaacgtcggcgactccgtcagcatcccgcttgccgcgtgggccgccgaggagatggagagggaccaggacctctgctacaccgaccagt

SEQ ID NO: 45001 - DNA, 454 bp, Zea mays
  Clone ID: LIB3066-036-Q1-K1-E1
gaaaccctcgcctccctcttcctttccggccgtcgcctgccgccggaaggagaaaaaatgggtgccggtggggaggaagggccgcggataatcgtgcctatggcggtggagggtaccccgaatcagctggcgtttgtagaggagtcgaagctgcagaagcgcaaggagaacgtggactgggccgtgaggaaccgggagcgcatggcggccaagcgccagcgcattcgcgacgagcacaaggtcgtcgtcaggcggcccgaggagttcgtcaccgcgttccgcaacaaggagcgcgacttcctgcggatgaggagccgcatcaaggtccgcagccagccgtccgtcgaggcgctcggctccaggctcgtcttcgcgattcgcgtccctgggtttccgaacttaaagagtgtgaaagagcttatctacatgaaaggccgcgggttctttgacatgg

SEQ ID NO: 45002 - DNA, 241 bp, Zea mays
  Clone ID: LIB3066-036-Q1-K1-E2
ggcgtccctgtggtccaacgtacgctgtacatggcgcaacacgtaagcttgaacgcgacattctatggcttgatcataaagggcgaatgcatagggcggaacgatactcaagagctagacgacgggcatctaatgcacgatccaggagtgtcgtcgatcaacacgatctatacgaactggaatgattgcatgcatatgaggattatgacgaacgacgttcagtgcctgtctaaagagatac

SEQ ID NO: 45003 - DNA, 288 bp, Zea mays
  Clone ID: LIB3066-036-Q1-K1-E4
cccacgcgtccgcccacgcgttcgcagaaagtcaggaatatagtcatgaaaaggggtcatatggcagctccactcctcctgatttcttacttcccaaagaagaaagaagtaaacaccatggtaatcaaacattccaaaacttcacaactcatgggaaggatgatgattttgcagcactagagcagctcattgaagatttgacaaaagagaaagtttctttgcaacaaaagtctcagaaatctcaagaactagcccgaaacttggcgacagataactctgcattaactg

SEQ ID NO: 45004 - DNA, 468 bp, Zea mays
  unsure at all n locations
  Clone ID: LIB3066-036-Q1-K1-E5
cccacgcgtccgcccacgcgttcgcagaaagtcaggaatatagtcatgaaaaggggtcatatggcagctccactcctcctgatttcttacttcccaaagaagaaagaagtaaacaccatggtaatcaaacattccaaaacttcacaactcatgggaaggatgatgattttgcagcactagagcagctcattgaagatttgacaaaagagaagttttctttgcaacaaagtcttcagaaatctcaagaactagccgaaactttggcgacagataactctgcattaactgataagttcaaccaacaggcacatgtaatcagccagttgacatctgacatggagagattgcaggaagagattcaagctcaactgttatcaaacatccagggagttcttggatcaatatctcgtacatgcaactggtngctatgaggctatanaacaatngtcactagctggcgctggagtc

SEQ ID NO: 45005 - DNA, 404 bp, Zea mays
  Clone ID: LIB3066-036-Q1-K1-E6
cccacgcgtccgctcctctggtccgcatagaggagcagcctgccagccaaggacaccggagcacgggcacgggcgcacggccagcgcgaacctcctcccctcccctcccctcttcttccgtttccaacagcgaggcatggtggagaaggcgaggagcatggcgcgcaaactagagatcccccagtggaagcacgacggccttccgtcgccgacgagcccgctggaccgcgcgtcgccccgtgggtggcgccaccgcgacgccgtctgaggcgtcgggctcgggatcctggcggcgctggaagccgagggtccgctgcccggcgccgtcgccggcgccgcgccgcgggtgtccatcccgcggcgcgcggcgcggctggaggtatcggagctcgcgtgcagcgggc

SEQ ID NO: 45006 - DNA, 347 bp, Zea mays
  Clone ID: LIB3066-036-Q1-K1-E7
ggtgaagcaagcagcacacgagacgatatagagggagggatcatggctctcttccgtgccgccgcgtcaggagggttcgcgctgatccttctcgcgtgctgcagcctcatcatgctggcggcggcgtctggcggcggcggcgtggacgacgacggcgtcggtggtgacaggctgatgatggaccggttcctcagctggcatgcgacgtacaaccggtcgtacccgacggccgatgagaggcagcggcggttccaggtgtaccgccgcaacattgagcacatcgaggccaccaaccgggcgggcaacctgacgtacacgctcggcgagaaccagttcgccgacctcac

SEQ ID NO: 45007 - DNA, 398 bp, Zea mays
  unsure at all n locations
  Clone ID: LIB3066-036-Q1-K1-F1
cccacgcgtccgcggacgcgtgggatttgctcttgatccatctatcactcgtttccgcctttcggagcctctccgccagcctattctcacagcagagccatctatctatacaagggtgcttaacccacaagataaatttattatttttgcatctgatggtcctttgggagcacttgacaaatcaacaggccgttgaaattgtccacagcaatccacgatcaggaattgcaaagaggctggtaagggcagcgttgaaacaagctgcacggaagagggaaatgaggtatgatgacctcaggaaagttgagaagggaattcgccgcttcttccacgatgacattacagtagttgctgtttacatagatcacggattactgcnagagagggatacttccgtg

SEQ ID NO: 45008 - DNA, 307 bp, Zea mays
  Clone ID: LIB3066-036-Q1-K1-F2
attgaaacgaaggcccgcgacgcgaggagcgagggaactaccaccggtgaccggtctcggcgcctgcgcgacgatagcctgtccgacctcgagcgcggtccggttcctccctgcgtcagcacgcgagcccttggagcttcgagtcagatcccggcgggcgcccatggcggctctggtgccgttgagccgcgcgatgtacggttttcgcgcgccgcatagtacgagcgatggggcgccggaagatgtccgcggcggcaccgccgtctcggagctggtccaacgttggcggaagcgtcatcccggaact

SEQ ID NO: 45009 - DNA, 426 bp, Zea mays
  Clone ID: LIB3066-036-Q1-K1-C7
cccacgcgtgcgagcgcaccatccagtttgtggactggtgcccaactggctttaagtgcgggattaacttccagtcctcaagtgaggtggctggttgtctcctggataaagtttatgcccttaaagcatgatcttccaacttcaccatcgttgtggaggtgttgtgccgcatcgaccacaagttagacctcatgtacgccaagcgtgcgtccgtgcactggtatgtcgttcagggtatggaagagggcgagttctctgaggcccgagaggatctggctgctctctagaaggactacgaggaggctgctgctgagtttgatgaaggtgaggaatgttatgatggtgatgagtactagaagtattctgatgcggtcatcgtcaggcttgtgtgctgatcttgtcctcgttgtggtttgcaacacctga

SEQ ID NO: 45010 - DNA, 407 bp, Zea mays
  Clone ID: LIB3066-036-Q1-K1-A1
cggacacggagctcctcgtcgccaacccggtcgagctctgcgggaagggacggccgcgcgtgttctacgacgccaccctcgccctgaaagcgcttggggtctgcatcttctcggctgagattgggagacaggcagcgtccgagcggcagtgggaggtgtacaggttcctcctggacgacagcagggagttcccgttgacgaacagtctcgctaacaggaaccgtgtggtggatagggtgaggaaaacgctgatgggatgctacaactagtagggctcctctcctcggcgtcgacctgtctgtctgtctgaccaagaataatgcaaagcttgaaggcaactaacgactggtgtttctagactccgttgtcgtcgtcgctgcccacagctagctgcctgcttcgtcgtc

SEQ ID NO: 45011 - DNA, 377 bp, Zea mays
  Clone ID: LIB3066-036-Q1-K1-A2
ggtgtaccagtctccgaggtgctagcccgccagatcgacgcccttgccgacggccgctcgtggtctacgacgccaccctcgccctgaaagcgcttggggtctgcatcttctcggctgagattgggagacaggcagcgtccgagcggcagtgggaggtgtacaggttcctcctggacgacagcagggagttcccgttgacgaacagtctcgctaacaggaaccgtgtggtggatagggtgaggaaaacgctgatgggatgctacaactagtagggctcctctcctcggcgtcgacctgtctgtctgtctgaccaagaataatgcaaagcttgaaggcaactaacgactggtgtttctagactccgttgtcgtcgtcgc

SEQ ID NO: 45012 - DNA, 348 bp, Zea mays
  Clone ID: LIB3066-036-Q1-K1-A3
gctgcacatcgcgtcctggtggttgcacctcggcgatcggatcgcgacgagacgccgcgcggtccgacctaggctgacgccaacgaccactctcgccggcggcggtcatggcgtacggcgaccgcgttaccaccttcgaggactcacagaaggagagcgagtacggctatgtccgcaaggtctctggacctgtggttgttgctgatggaatgggtggtgctgccatgcatgaacttgtccgcgtcgggcatgataacctcatcggggaaattatccgccttgagggcgattcaactacaatccaagtttatgaggaaacaggtggactgatggtgaatgaccctggtt

SEQ ID NO: 45013 - DNA, 331 bp, Zea mays
  Clone ID: LIB3066-036-Q1-K1-A5
gttcggtatcgcgttgtcttcggtacacctttcctatccgatcgctacgagaccccaccccgagcggacctattctgaccccaacgaccactctctccgtcacaagtaatggcatacggcgaccgcattaccacctacgaagactgacacaacgatatcgagcaacgctatccgcactatgcctatggacctctagttgtagctgatcaactgggtgctgctcccatgtatgaacttgatcgtcaccaacatgatagcttcatcgaacaaaccatccgtcttgagcacgattcacatacaatccacgttcatcaggaaacacttcaactga

SEQ ID NO: 45014 - DNA, 207 bp, Zea mays
  Clone ID: LIB3066-036-Q1-K1-A6
tcccactcgtccgcccacgcgtccgccctcatttactcccatgccatcccggacgcggggggggattcttcctccttaacctgtatcgcctcggatcacaagcactggcaaaagtttacgctactgctgctgaaatactctgccgcacctatgtctaactacactggccgtactatacccaagttcttctaatgtgacttgaacaac

SEQ ID NO: 45015 - DNA, 203 bp, Zea mays
  Clone ID: LIB3066-036-Q1-K1-A7
ctgactcgtgggaaaaaaaaataaataaactaataataacacgacaaaaaaaacctagacaaggaaaaaaccaaacgaataaaacaaagaaactactgaaccaagaaatacaacgggcggcagccttacaaaatccatgctgacgtactctttcatcaaccgtgatagtctccggtagtcacgctcctaaactcaaagttctt

SEQ ID NO: 45016 - DNA, 349 bp, Zea mays
  unsure at all n locations
  Clone ID: LIB3066-036-Q1-K1-A8
cggcgcgtggggttgatggcagcttcacgcccgaggcagattgaaagttgtgccttggagcaccccccgtggtgttggtgtggcaatggatcggagtcgaatctcattgagaacgtacagatggcttataccccactaatctgtaattcagtcagcgctatttttgtccccacctccgattttcatcttgctggatgtatgcttgacagatgatgatacggccctgttgttgttgttgttgttgaaaaagatgtgttgaggggactgtagtgttcctctcccccctgttgtatggaagattaccaatatgcagcgattttctcgcanagaggaagctcaatgcacatgc

SEQ ID NO: 45017 - DNA, 344 bp, Zea mays
  Clone ID: LIB3066-036-Q1-K1-B1
ggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgcttatcaaagacgttaccgtgacggcgcccggggacagccccaacacggatggcatccacatgggcgactcatccgggatcacgatcaccaacaccgtcattggcgtcggtga

SEQ ID NO: 45018 - DNA, 398 bp, Zea mays
  Clone ID: LIB3066-036-Q1-K1-B2
ctcgcgtgggcccagcggttccggatcgcggcggagatcgcgacggcgctgctgttcctgcaccaaacgaagccggagccgctggtgcaccgggacctgaagccggccaacatcctgctggaccgcaactacgtgagcaagatcagcgacgtcgggctggcacgcctggtgccgccgtcggtggcggacaacgtgacgcagtaccggctgacggcgacggcgggcaccttctgctacatcgacccggagtaccagcagacgggcaagctgggcgtcaagtcggacatctactccctcggcgtgctcctgctgcaggtggtcaccgcgcggtcacccatggggctcacgcatcacgtcgagaaggccatcgacgcgggcacctttgagcagatgctcga

SEQ ID NO: 45019 - DNA, 236 bp, Zea mays
  Clone ID: LIB3066-036-Q1-K1-B3
tcgtcacgcgtgcgtacacgcgtccgcccacgcgtgcggccatcgctaacaatatttggaaatgactacgcaacaaaggatgggacaggggttcgtgattatattcatgtggctgaccttgctgaaggacatcttttcgcattaaagaagctatttgaaagctcatctaacataggatgtgaagcatacaaccttggaaccggaaaatgaacatcagtgttggagatagccaatgc

SEQ ID NO: 45020 - DNA, 301 bp, Zea mays
  Clone ID: LIB3066-036-Q1-K1-B4
ccgaccggagcgacgccgagtcacgcgccggccatgtccgccgttgcgactgctgcgagcgtgaggacacgcccgaggtactgacagaatggcgcgtggcctcagagttacaggcagtcgatcgacgtgctgagcgcggatgccataccgacgatgaactctatcatggcatcgagcccgaaccataccagattcggaagctacttggtacatgactgtagctgattgttactgaataaaggaaaggtcttggagctaccgttcatcaggtcattgctgacgggctagctgctgaagctga

SEQ ID NO: 45021 - DNA, 229 bp, Zea mays
  Clone ID: LIB3066-036-Q1-K1-B5
cccactcgtccgcccacgcgtccgattacttgaaagcactctctggtgaacggatggttgatggagtccctgccctgtttgccaagccccagacttatatgaatctcagtggagaatctgtcggcccacttgctgcctattataaactgccacttaatcgtgtcctagtggctatcgatgacatggactagccatgtgcaggtctacgtctacaggcaaaatgctgttc

SEQ ID NO: 45022 - DNA, 213 bp, Zea mays
  Clone ID: LIB3066-036-Q1-K1-B6
cccacgcgttcgagccagccagccagccgggtcctgccgcgtagctagcgtatgcgtacgcgtagccgtagcagcgtgtgctagaggggaagaaatgctggaggggaggtctcgtgtggaggacacggacatgccggctcggatgcatgacgctgagacgtctgctgcctcgcgcgcgctcgacctatttgacgtcgtcgactgctgcgccat

SEQ ID NO: 45023 - DNA, 410 bp, Zea mays
  unsure at all n locations
  Clone ID: LIB3066-036-Q1-K1-B8
ggcaattctgtccacgcaggccgtcaggatcgccaccaaggccgagcagcatgagcgcttcatctttaaggtcacacacttgctgggtgttcttggatttgggggattttgctatctcttgggtgccagaccacaggatgtgccatatgtgtactgcctgttctatgtcatatttgttccgctccgctggatttactaccgctacaagaaatggcattactaccttctggacttctgctactatgccaacacctttctccttgtaatgattctcttctacccagaggatgaaaaactttttatggtttgcttctcgtttgcagagggtccgcttgctttggcattaattgtgtggcgttgcaacttggttttcagttcatttgacaaactnngtaatgtcctgatacatc

SEQ ID NO: 45024 - DNA, 414 bp, Zea mays
  Clone ID: LIB3066-036-Q1-K1-C1
cgaattgaggagacgagcgtacgtcgtgtacaccgttgccgagagaatccaggagggagggagagaagaccacgtcgcagggagaagcgtgcgtcgtcgttgtcgaggagtgccgctgcggaccactcgccgttactctaaataccaagcactggatcgctgggtgggcgttacaccggcaaggaggccaccgtgggctggagcgccgtcgggctcgctcgacgtcgaaggttgacgaatcacggtggccgaccgatccgagcgaacgacaccgattggaggagccgggtcatcaccgcggttcgcacctccatcgtgggacggaacgtctacgctgcgattgctggtgagacgagcaagtgactgaggaacccgaagcaccgtatgttgaagattctgagcaggagctcgcag

SEQ ID NO: 45025 - DNA, 143 bp, Zea mays
  Clone ID: LIB3066-036-Q1-K1-C3
cattcgtcacgcatgcgtgacgcgcacgcgtcaacttgagccccgacttccaaaagctgctaagcgtagcactcaatatcatcatcgaagcgttctgcaccatgttcacatgcataacgctgacagcgctgaacgcatgatct

SEQ ID NO: 45026 - DNA, 285 bp, Zea mays
  Clone ID: LIB3066-036-Q1-K1-C4
cccacgcgtccggcggccgcttttcgttaacttcagcctcgacttttataaaaatagaaaagcgtacgctcgaacctaatacacgaagcaaaccacaccatgtgcgcaggcatcgccctgccaccctccaacgccggagcgccctactacggcgcggcggcgccttccgggggctccgccgatgcccccgccggcgcctccgaaggccctgcgagcgccagcggcccgtctggtgacgactcgccggcgtccggtgctggtgccagcgcgtcagctgctgatgct

SEQ ID NO: 45027 - DNA, 444 bp, Zea mays
  Clone ID: LIB3066-035-Q1-K1-H8
cggacgcgtgggcggacgcgtgggcggacgcgtgggagacgttcaacgacggtggggacacgccgctgcaggtgtgcgcccgccatctacgacgaggccatgtttcttcaatagatccgtcgtcgtgggctactacaagaaccgcgtcaaggtagagtatcccgcttgttgctttatgctaccgctgcatgcagtctaggtgttcagtgaaatgtcaatgcaattttgctattgttttgcgattgattgctatgtgctagcgtctgttgtatggtggtgagttacgaggccattgagttccttctgtcgcggaaggttacagtcaaagttttgtgattgactgctatgtgctagcttctgttgggtctgatcaaaatgaacaataactgattttgtcagtagcggaaggtcgcagtcaaagtttttggttttgccggcattcaa

SEQ ID NO: 45028 - DNA, 179 bp, Zea mays
  Clone ID: LIB3066-036-Q1-K1-C5
ggaggacgtccgagctcaccatccagtttgttgactggtgctcaaatggctttaagtgcggagttaactaccagagtacaaacgttctgcctgattctcacctaatgcaactgcacctcactaactgcatgacctcctactacaccattgatctgtcagtggtcttcccaatcgatcac

SEQ ID NO: 45029 - DNA, 459 bp, Zea mays
  unsure at all n locations
  Clone ID: LIB3066-036-Q1-K1-C6
cggacgcgtgggcggacgcgtgggcggacgcgtgggcgtgatcgttgtctgctttgtccccgacctcgccgggggctcggctacgccctcggagcaggtgccggctggaaggatcaggtgccgcaagagcttgtcgccagaggcactctgcaagctgaggagatggctcgagtctgaccagtagacgcttctatctgtagaggccagcgccagcctgtgtttctgtgctgtggctgtgtaaatattggcgctgatggtgttccgtctagtacggctgtgcttacacggccagcaattttgtagctgagagagagttccccccaccggcgctgccgcttttgtttcacaccgtttngtacctttgtgggatgtacataccattatccattgtgctcggttcggctcaggttggcagagagaataactactctagttcgctaccaccgttgccttgcctga

SEQ ID NO: 45030 - DNA, 439 bp, Zea mays
  unsure at all n locations
  Clone ID: LIB3066-035-Q1-K1-G3
cccacgcgtccgcccacgcgtccggttctagatcgcgatctagctctgtgtcacagntaaagattattgctcttactcatgcaaaagatatagtcgtattcatcgatggcaattactattgtatttgaggaggcatccaaaggaggtgctcctttgtctntaccaattgctagtattgaggttgggcatggtcacagcttgccaaacctagcactcaggaggggcgaggaacactcttttattctcaaaccagcaactatgtcctcaagggaacggaagaccaacagtcatgcacctctggccttatcactcccaacgatgaccggtgctactntaaatactcatacaccagaggctggtgagccgtatgctgatctaagcgaccaatatgctgtactggtatcttatcgctgtaattacacagaatcgaaactttttt

SEQ ID NO: 45031 - DNA, 443 bp, Zea mays
  Clone ID: LIB3066-035-Q1-K1-G4
cccacgcgtccgctctactgcatgggtcatcctcacaggtgccatggtcctcctcgccgttcctttcatcatccctgcctgctccagttgctcatatgtggatacagatggccctgaccctgcatcgccactaaaccatgatgacccacataagccactcctaataagtaacaatcatcagatggagtccaatgccatgatgcaaaatccaaaggagaaccagatgcagggcaattgttgtggaacagtgatgggcaagggccgcctggcgacactcggtgaagaacacagtgcaaaaaagctcattcggtgtgtggacttttggctctactacacagcctacttctgtggagccactgttggcctggtatacagcaacaacttggggcagattgcgcagtcattgaaccagcagtcacagctcaccatgctccttgctgtct

SEQ ID NO: 45032 - DNA, 408 bp, Zea mays
  Clone ID: LIB3066-035-Q1-K1-G5
cttcaagggatctctgggccacaaaggtttcagatacataaggcctacggcagcacgaaccatctgccttcagctcatacttgctttaaccaactagacttgcctgagtacacatccaaagagcagctccaggagcggttactgttggcaatccacgaagcaaatgaaggtttcggatttggctaatcagttatactcgtttgtccgtgccctgagaactgcaaataggcgagcagcacgtgtgtggctgatctcattctgaactccacgtgtgtgatgagagatggccggagagaacatgtccaggatagacgaatgcccgtgggagaggtactactgttaagagagagagcgacgattttgtgtttataatctttgtccgtttgtagtttttgccttacattggtc

SEQ ID NO: 45033 - DNA, 433 bp, Zea mays
  Clone ID: LIB3066-035-Q1-K1-G7
ctctatgcagaatcactcgcacgctttcaaggagggtccccttacatctaccctctatacggtctgggagagctccctcaggcctttgcccgcctgagcgctgtttacggtggcacgtacatgctgaacaagccagaatgcaaggtcgagtttgatgagagtggaaaagcgtatggagtcacttctgaaggggagaccgccaagtgcaagaagatcgtctgcgatccttcgtatttgccagacaaggtgaagaaggttggaagggtggcccgcgcgatatgcatcatgaagcatcctatcccggacaccaaggactcgcactccgtgcagatcatcctccccaagaagcagctaaagcgcaaatccgacatgtacgtgttctgctgctcctacgcccacaacgtcgcgcccaaaggcaagttcatcgccttcg

SEQ ID NO: 45034 - DNA, 367 bp, Zea mays
  Clone ID: LIB3066-035-Q1-K1-G8
cccacgcgtcacacgaccgcgatatcgtcggacatgccgagatatgacgataggagagcaccttacgggctgccacgattgaataatccttgatcgagtagctctcgaacggaatcgagagatcatgatctggatgctgactgttcgcaacgcaggtatgatcatagtgatgctgggtagcacgcttctaggcctgacgcctgtgcctttggactttgtcactcgtacacaggccacaattgaccctgaccatatactggctccagctaaccaagctgaccatgaccagatgcggctgaagacttaacaggctttgcaagacgctgaaagcgctgaagatgaacaacctttaggcgtagaagctcac

SEQ ID NO: 45035 - DNA, 352 bp, Zea mays
  Clone ID: LIB3066-035-Q1-K1-H1
ggagcggttcggacgagcggaggaggatgacaggatggctaccggacgagcggttgcggtggccatggtggcggcggcggtggcggcggcggcgctgccgctgctcgtgggtggcgcgtacgcagactgctacaactacggtttcaccgactgcttgaccaaggacaggtccttgaaggactactgcagttacgcctgcgacaggacttgcgcgcccgacgcggcgccccggcgccccgtcgccggtctccccataaactgccagctggcctgcgtcagggactcctgcagccgtcgccgtgcagatgctaacgacatgaaggcctgttacgggcagtgctacgaccgttgc

SEQ ID NO: 45036 - DNA, 438 bp, Zea mays
  Clone ID: LIB3066-035-Q1-K1-H10
gcaacaatcctcgcccaaattgtataatttcactcacccccaagagcgagcgaatcaacctgtgccggaacatacagagcaatcctcttgcactgccacgtacggtgcacgcaccatggctgtgtcccgcgccgtcctgctcctcgtcatcctcacgggggctgccgcgtcctcgcccacggattccactcctgaggatgccgataccaagccgagcatcctgacccccatcgcgcacagcccgctgggatctttcgaaggcgccgatgggcccgtcgccgacaacgccatcgacgacgatgacgcggcgcccgtgggctcacccatcggcaccaccatgacggagccggagccgcagctcgcgccccccgggctccccgatagcagcgccaccgctgcttccgtaggccacccagtcgctgctgctgctgttgccgc

SEQ ID NO: 45037 - DNA, 145 bp, Zea mays
  Clone ID: LIB3066-035-Q1-K1-H11
gccacgcgtccggagaaatttatcggtgattttactttgtgctacgggatgtgctgctgcagtctatcctagtgtcagttgatttttctggtaaaactgtgaccaaataagttaattcgccaagcatcattactatcggaatttc

SEQ ID NO: 45038 - DNA, 289 bp, Zea mays
  Clone ID: LIB3066-035-Q1-K1-H12
gactagttctagatcgcgatctagaactaggtgtcctacgtggcgcggcgggccccgcctagtaaaggagcgtaggagcgtcgttttgtgttgtggtcgaataaataatgtgtctgtgtgccgatcccgtgtcgggttagtgggcccactgtcggtgctgatgtggcctgcctttacagcacatcggtggggctgggccgtagagctcctgtgtcgtttaaatatatgtgtactctgtactgtaccaactagtatgtgtttcgagtgtgtagtaagcatatttgtgtcc

SEQ ID NO: 45039 - DNA, 431 bp, Zea mays
  unsure at all n locations
  Clone ID: LIB3066-035-Q1-K1-H3
gaggagggagtgtacgaggagtacgtgaccatcaccaagactatgaagaacgtgaccttcttaggtgacggctccaagaagtccatcgtcaccggcaagaagagcttcgccgacgggatcacgactttcaagactgcaaccttcactgcgcaaggcgacggattcatggcgatcgggatggggttccaaaacacggccggcgcggagaagcaccaggcggttgcgctgctggtgcagtcggacaagtccatcttcctcaactgcaagatggacgggttccaggacacgctgtacgcgcactccaaggcgcagttctaccgcaactgcatcatctccggcaccgtggacttcatcttcggcgacgcggcggcggtgttccagaactgcatcctggtgctgcgccgnccgatggacaaccagcagaacatcgc

SEQ ID NO: 45040 - DNA, 392 bp, Zea mays
  Clone ID: LIB3066-035-Q1-K1-H5
accacgcgttcgatgactggaggccgctcctacttgcactgctatctcgataagctgattaccaacgcgcctgactgcccggcttcttacgacatagctacggttcgatccacgccttactgattgcaagcagggtgatagtcatgaagactatagctgaactttcaagctgtcaaagtagagaacttctgctgtaacgatactaaaagacccaatcgatctcgtatttagcacatatgagtactcagatgacgttgccgatcgatcttttgcgcatgcaaacttaacttatggcatgtttatgactacccatatgttcacaaagtgtcgtgcttgcaatgctttgaacatctgatcttggaagtacttggatccatagattaggtaagatc

SEQ ID NO: 45041 - DNA, 444 bp, Zea mays
  Clone ID: LIB3066-035-Q1-K1-H6
tttcttcctggcggcggcgcccaaggccatgacggtgcggcctctcgtcggtgcgcttcggccaggcgtggcgtgtgggcgtcctctcctggcggacagggctcgaacccaaactccggctcaccgacgggcggcccggccaagcgggcgcggctcctgccccgacctcggcccgacgcgcgcgggtgcgggtcctccggcagcggccaggcggtcggcctcgaccccggtggtgcgcggtgcaggccccggcgcgcggccccccggtggcagcgcgggcagacggcccaagcgcgcggacgcgcggtctcccggcggtggcgcgggcagacccggcgctcgggggcgcgggcgtgcggccccccgtggcggcgcgggctaggcagggcgtgggcgcagccccacggcgggaccgcggcatggcagcgcgcgacacgcgggcac

SEQ ID NO: 45042 - DNA, 446 bp, Zea mays
  Clone ID: LIB3066-035-Q1-K1-G2
gccgagcgatctcctctccctctccctctgcgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaagcgagcctggtgccgtcatccgtggcaagaagggatcaggaggcatcaccgtgaagaagacagggcaggcactcgtcgttggcatctacgacgagccgatgacgcctgtgcagtgcaacatggtggtggaaaggctggc

SEQ ID NO: 45043 - DNA, 423 bp, Zea mays
  Clone ID: LIB3066-051-Q1-K1-C2
cgaaattgttcgatattattgactgctttgttgtgctgtaccacaggcatctggagtatgttgatggttcataaaaatatgaatttgttccatattattgcctactttgttgtgcagtatcgcaggcagctggatcttgagcgaccttacacaaaaaagaaagaggttagtatatattgatgatataatctaaacaagagctactcgacttaacttaagtttcggcggatgggtagcttgattcttcgtgtggtctaatagaaagaaaatagttgcatcaaaattaattagggctctaatgacagctatttctaattgtttcagttacgttattacttagttctctgtatttcctatttgtttcactgagatcaaaattttgatatgtaattccatttttttctattagatccttacttacta

SEQ ID NO: 45044 - DNA, 414 bp, Zea mays
  Clone ID: LIB3066-051-Q1-K1-C3
gccacgaggaggacatctgccaggtggtgctggtggccagcccgcgcaaggactgcgacgaggtccaggcgctcagggaccgcgccggcgtcctgctcaccaggaacgttggcatctccgacagcctgcgccccgccaacccgctaggctacttcaaggacgtgccgctccccgtctgcgccgcgctgctcaagcagctggactcggacgacgacgacgaccagtaaactataccacggcggcgtcgcggacatgctgcacaaaactacaacgatacagagcgaacgcatggcatggatagcagtatctacggaaagaaaaggaagaaaaggaaaataaaaaatgtatcagagtgcttgattcacttgctgctgtcacccattccccgttcttaacataacatgtgggccggct

SEQ ID NO: 45045 - DNA, 419 bp, Zea mays
  Clone ID: LIB3066-051-Q1-K1-C4
cccacgcgtccgcccacgcgtccgcccacgcgtccgtcgccgcgccatgacgatggcgatagccgccgtgctctgcctgctcctcttctctggccgtctcgccgcggcggagaagactttccgcggaggtggaggcggaggctacggcgggttggaggcctgtggcggaggcggcggcggctattccaccccgagcgaggcggcgccatccacgcctgccgctggggagacgactaccccttcgtcaggcggcggttactccactcctagcgtggcggcgccatccacgcctgccgctgaggagacgacgacgactccttcgtcaggcggcgggggttacggcggtgcaaccggcaaggcttcctcaggcggcggcggactggaccccgacggcgacccagaggttgggctgaacggga

SEQ ID NO: 45046 - DNA, 415 bp, Zea mays
  unsure at all n locations
  Clone ID: LIB3066-051-Q1-K1-C5
agaccagcagcagggaacatcgtccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgaccacgccgncagcaccg

SEQ ID NO: 45047 - DNA, 416 bp, Zea mays
  Clone ID: LIB3066-051-Q1-K1-C6
cggacgcgtgggccatggcctcctcatagaataagctctatctcaccgcaggaacgcctcattacaatccttcaagagagcagcactacactacactacattagagagaggtcgagcgcccctcctccgatccgccggcccgccgagagctagctgctgatcggtcgaggagagtcatggcgacgtcgacgatgcgcgttgccgccggcgtgctgctggtcgtgtcggcgctggcgaccttggcccgggccgaggacccctacctgttcttcgagtggaaggtgacgtacgggaccaggtccctgctgggagtgccccagaaggtcatcctcatcaacggcgagttccctggccccaggatcaactgctcctccaacaacaacatcgtcgtcaacgtcttcaaccagctcgaccat

SEQ ID NO: 45048 - DNA, 416 bp, Zea mays
  Clone ID: LIB3066-051-Q1-K1-C7
gagctgcaatggaaagtgcatctatctgagggaccacatgtgggtgaaaatgagaaccggttatctggcggtggtctaggctatcctttctatgtcactgtccttcaaggtgtctaagtaattatcaggattcaagaagtaccttcttgagcgtcaatatagaccagtgcaaaactcaggaactacacccaattgcaacgggccgatgataataggtgccagccagtccagtttgtgcaaagatctgccccggtagttccctgactgaatatacttggatacgctcatggttctgcttcggtaccgatatatttacacgtcattttgaaggatgacttctggtgagtacatgtatacaattgtcgctgggaacaaaaactaacggtaattgctggtggatttttggcagacagaat

SEQ ID NO: 45049 - DNA, 160 bp, Zea mays
  Clone ID: LIB3066-051-Q1-K1-C9
tggagacttagatctccaaacactcgtaactatcctactaggtggtgacatcgggccggaaaaacatttatggtcatagagtctgcccttcgtttgtcagtcgggcaatttttcttgcatacaatgccttcgtttaagtatcggatgagttgctgcgact

SEQ ID NO: 45050 - DNA, 417 bp, Zea mays
  Clone ID: LIB3066-051-Q1-K1-D1
ctgccaccctacagcggcatgacggcgtgtggcaacgtccccatcttcaaggacgggaagggttgcggctcatgctatgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagcttcgccactgcggcatcatggacgtcgagttcagaagggtgcggtgcaagtaccccgccgggcagaagattgtgttccacatcgagaagggctgcaaccccaactacctggccgtgcttgtgaagtttgtggcggacgacggtgacatcgtgctgatggaaatccaggacaagttgtcggctgagtgg

SEQ ID NO: 45051 - DNA, 363 bp, Zea mays
  Clone ID: LIB3066-051-Q1-K1-D10
cggacgcgtgggctaaaaaaaatttatggctgctactgtgctacatatttccaagggcaacaggatctcatcaaatttccaagcaacgacatgaactggtgacaggagcaggaagcgtggatcgcgaccggctgcgacgtcgacgcgcgccgggcggaggtggaggagacgcgcgagcaggctgctccggcgccggtcgagccgtgcctgtcctcgttcgtggacatgtcggagatcttccccgccagcgtcacgctcagcagcggcggcgacgtggacaatagcggcaacaagccagacgaggaaacggtcccgcgaccgcagctgttggccacgacggcgctctggtcccggacacagaaa

SEQ ID NO: 45052 - DNA, 418 bp, Zea mays
  Clone ID: LIB3066-051-Q1-K1-D12
cccacgcgtccgggtggctgccgccgccggtgacagcggacggcgagctacccttcggccacgacgccgtcacgttttccttcttggtggcgtgcgtggccgccaccgtcgcgcttgcgtcgtccatgtgctcggcgtgtggccgcaagccaaaggcggccaccaacgcggacccggccgggacgggctcctccgtctccgatggtagcgacagccaggaggctggcgcggaggaggcggcggtagaggaggaggtggtgaggctgtcgccggagctggcgatgcacggcgccatcgagccggtggcgctgccgtcgtcgacgtcgaggcggcggctgtccatcagcgtgagcaagaagctgagcctgaatatcccggacaagctgcggctgagccggcgggagcacaaggaccacca

SEQ ID NO: 45053 - DNA, 424 bp, Zea mays
  Clone ID: LIB3066-051-Q1-K1-D2
cggacgcgtggggccagaaaacagttaaatggcccaatgtaagaccatcgtcgcagcagggctcgtggttgctctcgtggtttcgacgatcccagccagcgccgatacgaacctggaacctgcaggaggctctacggagggcagtgcccgcacctccggcatgcagaaggaagagacccgaggcaacaagaagccagcgaccctcgctggatctcttggttcaggcaagaatgccatctacgggtaaatgattagaaggaatcctgcttcggaaggtatgaaaacaatggggatgtgctcaacaatcaatctcaaccccaggtgacggcaatgagtcacccacaggaatgtaaccggatatagatggacattgctcgttccatatttctttttcatattttctcttcaaattcaattgaaatac

SEQ ID NO: 45054 - DNA, 422 bp, Zea mays
  Clone ID: LIB3066-051-Q1-K1-D4
gctatctttgacaagatgaaaaaggacaagaactcagaaaattcacaaggagaaaggaaggacaatagtatgcatagcgttggtgaagggaccggacaatcaaagagtcaaaaccttcacgtgtctcaaagccgccgtagcatgaaagctccgaatttttccatgaaaagaggtccttcaatggccatgagagctccttcagtagcgatcagagcgccctcaatatctctgagaggtccttcaatgtctttgagagcatcttctatgtctgtaaaggaagaccaaagttcctcaaacaagtcagatgaggaaacggaatctgtgttggtgaagctgagcgcacgtcagatcacacttttgctgtcatccatttgggctcaatcaacatcccctgaaaatactcctgtgagcaatggcttcat

SEQ ID NO: 45055 - DNA, 413 bp, Zea mays
  Clone ID: LIB3066-051-Q1-K1-D5
gggaacactgaagataataataggactgagaaaataaatgcatctgaagcaggggggtctaaacgctggagcagggtaccttctttgccttcatatgtgccatttggtgagctttacctattgggagattcatcagtcaatacactttcagattcagaatactccaagatgacgtcggtgcagtctgttatatcggagttaagagagcgtttgcagtcgcactcaatgaagtcctatagggctagatttcaaaaaatatatgattcatgcatgtgtgcaaatgctcccatttttactggcattgagcaattgccacaattttcacatctacaagaattaattggtctaacagctactgattctgttgaacttggagatatcgtggaccctcctgttatccgaactgctacttc

SEQ ID NO: 45056 - DNA, 415 bp, Zea mays
  Clone ID: LIB3066-051-Q1-K1-D6
cccacgcgtccgcccacgcgtccgcccacaccttgagacctgcgttgtcacgcacgcatcaaggttggggccgccagcagagttcagccgttcctgttcctgataaaacgagagaaggatggcagtgtctcagggagctgtcctattcttgtttctcctcctcgtcgcagcagaggtgggaaccatcgatgccaaaatgggagtagccatgcccatgcatgccttgataatggagaaagcgaaacagcaggagaaggagaagaaggaggagaaaagcacggagaaggaagagagtcaatgcttatcgccgagtctccagttcgagggcttctgcttcaacagcgacagatgcgccgaggtgtgcatgaaggagagctttcccggtggcgagtgcaagcgggacgtggccatgcgc

SEQ ID NO: 45057 - DNA, 411 bp, Zea mays
  Clone ID: LIB3066-051-Q1-K1-D7
cccacgcgtccgcccacgcgtccgcccacgcgtccgcccacgcgtccgattaccaggcgcagcagtattaccaggcgcagctgtatttccagccacagcagcagcagtattttcagcagcatcaacagacgttggcaatgccaatgccaaacatgtatcaccaccagtatcagtactctgtgcctacatctggagcttcgaacccatttggtgatcctttcagtgaccttgccccaatgggtgctcctgcaaaacagagcaactcagtttttctctgaactggttgctacttctgagtctgatcattcaattggtagagcagcaaacctgtacagcacttgttccttcgctaagtggaggtgttgtatattgtctttcttttgcaatatccaaatcttgaaatataacatt

SEQ ID NO: 45058 - DNA, 417 bp, Zea mays
  Clone ID: LIB3066-051-Q1-K1-C12
cccacgcgtccgcccacgcgtccgcccacgcgtccgcggacgcgtgggttcggagagagcgagaaagaggagagagagagggacgggggcggggccggcggaagcggagcctgcgcccgccggaccgaatcctcgccggatcgcccggcctgccggggcggcgctgcggacggcctgatccggctggaatggcggcgggccgacgagggatctagcggaggtgggtgtcgcgcggcaatggctgcggcggaggcgcggcgccggtcagcggtctgggctctgctgccgctgctgctgcggctgctccacccggccgcgctcgtgctggccaacaccgaaggtgatgccttgcatagcttgaggactaacttaaatgatcctaataatgttctacaaagttgggatcccactctggtc

SEQ ID NO: 45059 - DNA, 409 bp, Zea mays
  Clone ID: LIB3066-051-Q1-K1-A8
gtccatgaaggatgatgcgtctgtggtattcgcctattacaaggatggtgccgactaatccgacattcctctatttctctcatggtcttaaggagatcaagtgctaggcgtgcggcgaaattagttacccatgttgggtactatctatgtactattattatatccaaaactatagttgtcctggctgaattgaactcaaaagggtttgtttgagaaaaaattgtcccaaaaaaaaaaaaaaaaaaaaaaaaaaaaaaacaaacaaaaaaaaaataaaaaaaaaagaaaacacaaaaaaaacaaactcacaaataaccaaaaagacaaaaaaaaaacacacaaaaaaaaaaacacacaaaaaaaaaaggggggggcctttttaagggccccagtttatcatcccgggctt

SEQ ID NO: 45060 - DNA, 429 bp, Zea mays
  unsure at all n locations
  Clone ID: LIB3066-051-Q1-K1-A9
cttttctttgcggcgacacgtcagggagagcggcgccgcccgtggctaggtctttgtcggggcgcttcgccggcgacgagcatccgccaggtgcccagccatgtcgtccaatgctggggcctccgtcgctcccatcggcggcggcgctgctcgtgcccgcagtcgcagcttcgggagcagcagcagcaacggccgggccgccgacggcaatggcgctggggtgttcgtgagggcggnggccgacaacgagatgtacgtgcgggcggataagatcgacctcaagaacctggacgtgcagctggagaagtcgcggtcccaggtgtggctggagcaccagcggtcgcagcggacggcgtcgccgcggccggagacgccgctgctcgagtgggagatcgacctcgccaagctcgacatccagaaccagatcgc

SEQ ID NO: 45061 - DNA, 414 bp, Zea mays
  unsure at all n locations
  Clone ID: LIB3066-051-Q1-K1-B1
ctcaggtttggggggaaaaggcctcgcgggtcgcaaaccgctctctgttgatttgggatttgggaggcgctcgagttttcaggtaaaccatagtttagtgaccaatggctcgtactaagcaaactgctcgcaagtccactggagggaaggctcctaggaagcaacttgccaccaaggctgctcgtaagtctgcacccacaactgggggagtaaagaagcctcatcgttaccgccctggaactgttgctcttcgtgaaatccgcaagtatcagaagagcactgacctgctcataaggaagcttccgttccaaaggcttgtcaaggagattgcccaggatttcaagactgatcttcgtttccagagccatgcggtgcttgcgctgcangaggctgcggangcgtacctggtgggtc

SEQ ID NO: 45062 - DNA, 375 bp, Zea mays
  Clone ID: LIB3066-051-Q1-K1-B10
ggcaaggaccgggccgtcacgtacaattacggggagcacgacgagcgacatacgagaccgagcaagcgtcgccgacgccctaccgcttctatgcgatgggagccccgtacgacccatacgtggacgccaccaggctcattccgaggaccatgatgacctggaggtcggtctggttctggtcccagctggagtcgtacaatcacgatatcgcctgccacatgcacgtcagccacctcgagctcggcaacaggctgtacagcacgctgtccatgcactgtgacaagctcagtggccaggaacgacgcgatcggaaacaccctagcgaggaacagaccggaagcgcgcacgtgcacgagaaagccagctgactgcaac

SEQ ID NO: 45063 - DNA, 279 bp, Zea mays
  Clone ID: LIB3066-051-Q1-K1-B11
cccacgcgtccgcccacgcgtccgcccacgcgtccgcacacgcgttcaaccacgggtggggtacattgacggacgtggtaccccatgtctccgatcagagctccgtacaattcttagatggatatgacaatgctaatccgtagaaagatgatcaactgtagctaggtctctttctagttgcaatgaacctcttgcaatcactacatagcattctacatagtgatcatcgacatcttgttcttctacaggatgtacaacaacatttccgtgaactagatc

SEQ ID NO: 45064 - DNA, 419 bp, Zea mays
  Clone ID: LIB3066-051-Q1-K1-B12
ggagggtccgtcgtgagtacaaggcaaagaagatctccgaggaggaatacatcagtgccatcaaggaagaaatcagcaaggttgtcaagatccaagaggagcttgacattgatgtgcttgtgcatggagagccagagagaaatgacatggttgagtacttcggtgagcaattatctggttttgcattcactgccaacggatgggtgcaatcttatggatcacgttgtgtgaagccacccattatctatggcgatgtcagccggccgaaccccatgactgttttctggtccaagacggcacagagcatgaccgctcgtcccatgaagggaatgttgactggtccagtcacaatcctcaactggtcatttgtcaggaacgatcagcctagatttgagacatgctaccaaatagctcttgca

SEQ ID NO: 45065 - DNA, 291 bp, Zea mays
  Clone ID: LIB3066-051-Q1-K1-B2
cccactcgtccgcccacgcgtccgtttggaactaaaaaaaaaaaaaaaaaaaaaggaaaaaaaaaaaataaaaaaaaaaaaaaaaaaaaaaaaaaaaaatataggactaacccatctcaatgtatcctaacttacatacacatcattgcggatccctttttatcgtttcaattttccttacatctaatctactactccgtagtttttcttcgtcgtgactgtaaaaaccttaactttccccatcttaataaccttttaactgatacaactttggctaatctgaacttattc

SEQ ID NO: 45066 - DNA, 414 bp, Zea mays
  Clone ID: LIB3066-051-Q1-K1-B3
cgaactgctcgcggagaggcagaagcttggcccgttcgtcccagtgatcccgcatggtgtacgcttgctgaatcaagaaattttacgtgtttccacactattggagaacgcatcccttttaaatcaaagtggccttgaacatggtagtccactaacaacaggaggattatattcaaatggagcagctactgacatgaatgtgtggacatcagcatttcaaccagaaagttcaccagcttatagctggcttggaggatcccagggcagctcctctggacttattgtcaaaacaatgaaggtcgatatcccagtagacaaatatccaacattcaatttcgttggccgcatccttggtccaagaggaaattccttgaagcgggtggaggcaaatacggactgccgtgtgctaataag

SEQ ID NO: 45067 - DNA, 425 bp, Zea mays
  unsure at all n locations
  Clone ID: LIB3066-051-Q1-K1-B4
cctttagttgccaatttaaaggaacagtagaaggaataccgatttgatggcccaaagataagcagatcattgttgtggtggctctcctttttcttgtggtggcaacatcatcatcagtgtgggttgcagaaggagccgatgacttaaaagtttcttgcgttaaagagtgcacccaaaattttaacactcccgagggcaagaagatctgtgaaacgatgtgtgccaaccctaaaggaaggcctatcgacagagttagagctgattgatcaatgctcatctttatttgtagctagctatcatgcatgcgatgatggccttcttgattattattatttcattcctcatgttgtttgttcttgcatgttttttccaccactaatattgtcctaattgatgcatacaagttgtcactcanagcattttct

SEQ ID NO: 45068 - DNA, 419 bp, Zea mays
  Clone ID: LIB3066-051-Q1-K1-B5
cggacgcgtgggcggacgcgtgggcatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgat

SEQ ID NO: 45069 - DNA, 230 bp, Zea mays
  Clone ID: LIB3066-051-Q1-K1-B6
cccacgcgtccgcccacgcgtccgggtgtagcaacccttaaaattcagatgtgtctgttgaatataagactgagggcacttgaagaggatcaggagttcctcaatcaggtattgagttcgctccaatgtggtagtgatgggctgcagtgtatacaggagataagcaggcacttagcagagttgcgaagagttgtggctcactaaaatgaaaatggttttgccccgagttc

SEQ ID NO: 45070 - DNA, 415 bp, Zea mays
  Clone ID: LIB3066-051-Q1-K1-B7
gacaaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacacggtgccggtcccgacaacaaccgtggcggctgtgggtacacagacacgaacacgcccccctttaatatcacgtgcgcatgcgcgaacatatccatatttaaggataggctctgttgtgggtcctggttttagatcaagtgcgataagcctgtggagtgctccggcaagcccgtggtggtgcacatcacggacatgaactatgagcctatcgcggcgtacc

SEQ ID NO: 45071 - DNA, 418 bp, Zea mays
  unsure at all n locations
  Clone ID: LIB3066-051-Q1-K1-B8
acgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggngtcacgctgctcaactccaagttcttccacatgaacatgtaccggtgcaaggacatgc

SEQ ID NO: 45072 - DNA, 425 bp, Zea mays
  Clone ID: LIB3066-051-Q1-K1-B9
tgcaggaaaaggagcgaagagagagagagagagagagacgcaggcccgccggcgacgatcgaggagggaggaaccagagacccggcggcggcgacgatggctccgcgcagctcatcggcggcgacgtgcctgtgcctcgctctcgccgcggccacgctggcgctggcccacggtgcgcaaggaggaggaccatcggcatctgcggcggacctggacaaggtcacgggcgagaccttcttcgacatcgagatcgacggcaagcctgcaggccggatcgtgctgggactgtttggggacaccgttcctaaaactgcagagaactttcgagcactttgcacaggggagaaaggaattgccaagtccggcaagcctctgtggtacaaggggtcgacgttccacaggatcatcccggggttcatgatcca

SEQ ID NO: 45073 - DNA, 417 bp, Zea mays
  Clone ID: LIB3066-051-Q1-K1-C10
ccttcacctaccttcacctggcaactggcattggtcccgtatagtgccttgctgtcaggtgcatggacgggctgacggacgagcagaggctcgcgttccaggaggccttctcgctcttcgacaagaacggcgacggatgcatcaccatggaagagctggccgcagtcacccgctccctcggtctcgacccgagcgatcaggagctcaatgatatgatgagcgaggtcgatacggacggcaatgggatcatcgatttccaggagttcttaagcctcattgcccggaagatgaaggatggcgacggcgacgaagagctcaaggaagcctttgaggtcctggacaaagaccagaacggcttcatctccccggttgagctgaggacggtgatgaccagtctcggggagaagatgaccgacg

SEQ ID NO: 45074 - DNA, 423 bp, Zea mays
  Clone ID: LIB3066-051-Q1-K1-C11
cccacgcgtccgcccacgcgtccgcccacgcgtccgcccacgcgtccgcccacgcgtgcgcccacgcgtccgcccacgcgtccgcccacgcgtccgtaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacg

SEQ ID NO: 45075 - DNA, 367 bp, Zea mays
  Clone ID: LIB3066-051-Q1-K1-A7
cccacgcgtccgcccacgatttcggcgacgcgtgggcggacacgtaagcgggagcgggttaacaccatcaaggaagcggtcgtcgctccaaatactatgaataatctacagccgaacaaggtaaggcgactttatacatgagctacatcttagatatcgacctcaaggcgaacaccaagtccgacgataactaccatctatatgagtacaccgacttgtacactgacgtgcatgggctcaattactatagagagaacaacgacatagacaaagatgtccatatgatagattacaaacgtaagacgcatgacatggactggattgtagacatgactttcgaatgatgatatactcatacactgtatta

SEQ ID NO: 45076 - DNA, 423 bp, Zea mays
  Clone ID: LIB3066-050-Q1-K1-H2
gtcctccaggtcaaggtcgacggccgcgtgcggtggaaggtcggcagctggatctgcgggcactaccacctcttcgtcacctgccccgcgttcctcgtcaccgccggcggcaacggcgcccccggcgcttccgggttcaggttccagaccaccacgtactgccacgtcgaggtttaattaggagcgagaggaagcagagaccatggctacctctctagctgctgctcctgccgttgcctggtgtggtaataactctctctatctctctctctctctctgtccgctgctggcgttactactgcagtagtgcagtgatgcgggatgtaaaggaggggtaaaaaaaattcctttcgttctagccccttgtttttttgcatcttctccttcacctttccatatactactagtatgctctgtcgactg

SEQ ID NO: 45077 - DNA, 366 bp, Zea mays
  unsure at all n locations
  Clone ID: LIB3066-050-Q1-K1-H3
cccacgcgtccgcgagaatatcaagatggaggactcagccaaccccatcttcatcggcatgaagtactgccccaacaagttgtgtactgccaacggcgcctccaaggtcaccgtcaaggacgtcaccttcaagaacatcaccggcacctcctccaccccggaggtcgttagcctgctctgcactgccaaggtcccatgcaccggcgtcaccatggatgacgtcaacgtcgagtatagcggcaccaacaacaagaccatggctatatgcacgaacgccaagggcagcaccaaaggttgcctcaaggagcttgcatgcttctagacccttcgtcgactgacccatctctctagntataatttttctct

SEQ ID NO: 45078 - DNA, 404 bp, Zea mays
  Clone ID: LIB3066-050-Q1-K1-H4
aacctgcagtcatctcctccatcaccaccaaactcaacaacagccagctcgcgaaggtgaggaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtg

SEQ ID NO: 45079 - DNA, 351 bp, Zea mays
  Clone ID: LIB3066-050-Q1-K1-H5
caaggaccttcggcgcccgttcaggatccacatcttcccgagcgagttcttggggggcctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggt

SEQ ID NO: 45080 - DNA, 421 bp, Zea mays
  Clone ID: LIB3066-050-Q1-K1-H6
gttccccgagggaccttttctgaaggttcttggataggggagatgcaacaagcatgtgataaatctgtcataatcagtgaaattttggaccccaggacaaaaaatttgttgtcagtgtcaaaaattagtgactacgttctttcaaatgaattagtgagcatggcattggcaatggtcgccgaagatcggcagataaataatgtcttggaggagctcttcgctgaacaaggaaatgaaatgcaaatacgaccttctgatatgtaccttagagaagaagaggaattaaatttctttgaggtcattctgcgagctaggcagaggaaagagattgtcattgggtaccgtcttgaggcagctgagcgtgccataatcaatccaatagacaaagtttcaaggcgaaagtggtcacccaaagatgttt

SEQ ID NO: 45081 - DNA, 361 bp, Zea mays
  Clone ID: LIB3066-050-Q1-K1-H7
cccacgcgtccgcccacacgtacgcccacgcgtccgtcttgacgatgatgatggctgcaccagaagcgaaggatcgaccaaggtggcatctgaggcagcagatgtaggaagatcagccttgattacagcttctgctttatcaaacactgttgggttcaagattcacgacaagcaagggagaatgcacagatttaactgtgaaaccagcagcttgacagatctgataactagcattcttcacatggtttgcgatgacattgacagaaaacacctgccacaaattttgtatgaagatgatgaccatgataaggtcatattgtcgtccgacagtgaccttatagcttgcgtataccacgcaaga

SEQ ID NO: 45082 - DNA, 425 bp, Zea mays
  Clone ID: LIB3066-050-Q1-K1-H9
cccttccgttccgtccgtccacttgccgttgccgaccacaacccgctcccggaggacggcgggatgagggggcaagccaacggagtggaggaccgccggcagcggggcgacgaccacgaggcggacaacgacggcgaggaggcggaggaagaggagggcgacgacgagggccgccaccggggccagggcccgccgcagcagcggcgccaccaggcccagaggccgaactccggcccgcagcagcagcagcagccgcgcccgccgccgccgctcgccaggaacgtcggctacgtcggcaagcatcgcctctccgccgccatcgcccgcctcgaccaggagctccagtccctccaggaggagctggacgagcttgagaccatggaatctgcgtccgcggcgtgccaggagtaagcagattttgagtg

SEQ ID NO: 45083 - DNA, 424 bp, Zea mays
  Clone ID: LIB3066-051-Q1-K1-A1
cagatcgcaacacacggaaccagaaagcaaacgcaaacaagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgccgccgacgctcccgctcctgctcctggccccgactcctcctcgaccccgtcgccggcaccctccagcagcagctcttccgactagccgcccggcagagatatctacggcgtccgatcagtctttggcgccacctataacctatcggatcctgcaaagctatatatgattctatggtataatgtgtggttgcggcaaacgcgcggaaataatgtgcttgcgtgattgtttttctctctct

SEQ ID NO: 45084 - DNA, 419 bp, Zea mays
  Clone ID: LIB3066-051-Q1-K1-A10
cggacgcgtgggcggacgcgtgggcgattccatttctaccccgagacctccagcgcggcgcccctgaaccctcagccttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcg

SEQ ID NO: 45085 - DNA, 410 bp, Zea mays
  Clone ID: LIB3066-051-Q1-K1-A11
cccacgcgtccgcccacgcgtccgcccacgcgtccgcccacgcgtccgcccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcggttttaaaaaaaaaaaccaactttactctgcctgacaaccaaataaatcttttttaaggggggcaaaaaaaaataaattggcgggcctttaaaaaaaaaggactgggaaaaaaaaaccggggacaaaccaaattaaattggctgaaaaaaaactttttttaagcagggggaaaaaaaaaaaaaagggcccgaatggattttcctaaaa

SEQ ID NO: 45086 - DNA, 419 bp, Zea mays
  Clone ID: LIB3066-051-Q1-K1-A12
cccacgcgtccggctagctctctgtctcctgctcagagtcgcagttcgctttgttgtgctagagcgctgagcagatctttccttgtttcttcattccggtacgaaggggaggggtccaagtgaagagaagagaaggcctgcgagcgatgggcatcgtcgacgtcgtctccgagttctgctccttgccgaggactcgccggcatctcaagaagaggaagcagttccagacggtggagatgaaggtgcgcatcgactgcgaagggtgcgagcgcaaggtgaagaaggcggtggagggcatgaagggcgtgagctccgtggaggtggcggccaagcagaacaaggtgacggtcacgggctacgtggacgccaccaaggtcatgcgccgcgtcgcctacaagacaggcaagcgggtggagccc

SEQ ID NO: 45087 - DNA, 403 bp, Zea mays
  Clone ID: LIB3066-051-Q1-K1-A2
cccacgcgtccgcacacgctcgccttctgctcccgtgcccatccagatgatgcttaggggtgtctcgtctccggccgccgtggtggccaaccatatctctggtggggccgcggcgaccacggctcctgccacggtgacggcgcatcgcaacggcgtctcggtgtccgccgtcggcgtcatcggcaaggggaaggaggtgctcatcatggtggagtaccagcccttcgaggagatcaagggggagctcgccctcgagccccagtacctcgacaggtcgctcgagcgccacaagttcatcgacgactgcgaggcagccatcaacgagcagatcaatgtggagtacaacgcctcgtatgcgtaccactccctcttctgctacttcgaccgcgacaacgtggccctc

SEQ ID NO: 45088 - DNA, 350 bp, Zea mays
  Clone ID: LIB3066-051-Q1-K1-A3
gatcccacccacatccatccacgagcgtgccgacgccgcggcggagagggaggacagctcgccgcggcagatcaatctgccggcgcgcggcgaccggggcttcttcagcctgtgaatgatcccacccacatccatccacgagcgtgcgcgtagactgatgcctaggtaaagagaccgagtttgctgagtgctagtattaagttcagccttcatgttgcggtattgtattggttgctccgtttccatctgatcagatgatcatagttgtttccttgatcagatgatgtgtactagacgttttgtccaggttgagctgaagctgtgatataaaatttcattacgttggtatt

SEQ ID NO: 45089 - DNA, 422 bp, Zea mays
  Clone ID: LIB3066-051-Q1-K1-A4
gtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgcttcaacgacggcgtgcac

SEQ ID NO: 45090 - DNA, 120 bp, Zea mays
  Clone ID: LIB3066-051-Q1-K1-A5
cccacgcgtccgcccacgcgtatgcttacgcgtgggcggacacgtaggcagggctcggtcctaaaaaatcattaacgctccacaaactatcgacgtttttttaaactatgaatgatacta

SEQ ID NO: 45091 - DNA, 420 bp, Zea mays
  Clone ID: LIB3066-051-Q1-K1-A6
tggccatccacagaagagatagccgaggttgtcaagtcaagtgtgctccctgacatgttcaagagcacatatgagtcaatcaccaaaggaaatcctatgtggaatgagctgccagtctcaacaagcactctctacccctgggatccatcatctacatacatccatgagccaccttacttcaaggatatgaaaatgagtcctcctggcccgcggcctgtgaaggatgcatattgccttttgaattttggtgacagcatcacaaccgatcacatctcacctgccggaaacattcacccagacagcccagctgcaaaatatctgaaggagcgtggcgttgaaaggaaggacttcaactcatatggtagccgaagaggaaatgatgagatcatggctaggggaacctttgccaacattcgtctt

SEQ ID NO: 45092 - DNA, 428 bp, Zea mays
  Clone ID: LIB3066-050-Q1-K1-H12
ggccgccgtgccggttcttcccagctgcagcaaccggccagtgcgcgcggttgcgttggatgtgcatggctgcgcgctgcgctctgggagcttgcactagcgggtcggcggcctaggcgcggggcatctttcgagtgcgtgcgtgtctgttcaagctctgatcgtctctccggcccattcgccggaggaaactgaccgccgccttctcgctctcgctctctaccctattcccggggctgagaggggaggagagaaggccacgtccacaccataaagcaggacgtacagacacgtgtacgagggggatcacggtcgggtgaggtgactaagctggcggacggaacgacgacgatggcgaggagcggccgcgggatggaaggcagcggcgggctgaagaaggggccgtggacgcaagcggaagacaagct

SEQ ID NO: 45093 - DNA, 421 bp, Zea mays
  Clone ID: LIB3066-030-Q1-K1-C12
cccacgcgtccgctaaggaacgaccaagtgctgctgaggccctggcagatccatactgtaatggattagcaaataatgaacgtgaacccatagcacaacctatctcaaaacttgaatttgagtttgagaagcggaaactggccaaagatgatgtccgagaattgatttaccgagagattttggagtaccatcctcaaatgctacaagaatacctacaaggagcagaccacaatcagatgaccttcatgtatccaagtggggtggatcgcttcaggcgccaatttgctcatttggaagaaggtactgcaaagggtgaaaaacacagtccacagctgcgacagaatgtttctttgccaagggaaagagtaattggcaataaacatggagatggcaatacaggtgataagctagcgcatgcctc

SEQ ID NO: 45094 - DNA, 425 bp, Zea mays
  Clone ID: LIB3066-030-Q1-K1-C2
atcaaggttcctcatgatcagttgccttccttgctcaagagttagggccaaataaaatgaatgcaagacagaaggagtggtatgaaatggggccgggacacaggtgctcatcatatatatggatcagcgtaacacagagaaatcaatggtgggaaggtgagagaggcagacagacacagcagagagaagcatgcatggtgtgctgcagctgcagtgcaggacgacgacgacgacggcagcagctagcagcgagtggtgatgtgagatagagaaacaaaatgcatgcagcaaatagctttcttcactttttttgcaggcggatcggagggggagcggcaggcatgaattgatgaaggaattaacacaccaatgcaacttggaggagcgctcagctaaacatgtatcttcgttcacttgtgcattta

SEQ ID NO: 45095 - DNA, 418 bp, Zea mays
  Clone ID: LIB3066-030-Q1-K1-C3
ggattttgtgacgaacgtccagatccgtggcatcacgctgctcaacagcaagttcttgcacctcaacatcttcgagtgcaagaacgtgctgatcgacaaagtgacggtcaaggcccccgtcgacagccccaacacggacggcatccacatcggcgactccagcaacgtgaccatcagcagcaccaccatcggcgtcggcgacgactgcatctccatcggccccgggagcaagatgatccgcattcatggcgtcaagtgcggcccatgccacggcatcagcgtctgcagcctgtggcgctacaaggacgagaaggacgtggaagacgtgcaggtgacggggtgcacgatcgccggcaccacgaacggcctgcgcatcaagtcgtacgaggactccaagtcgtcgctcaaggccagcaag

SEQ ID NO: 45096 - DNA, 431 bp, Zea mays
  unsure at all n locations
  Clone ID: LIB3066-030-Q1-K1-C4
ctcgtcaaggagccgcacctcgacgagcttgagcagcggcggcacgccgtcctcctctatgatgagccgcacctcgaggggcaggagaactgcgcgctcgccatcggcctgctgggccgcgacccggagtgcgtcgagcagatggtccaggccggggtgtgcctcgccttcgccaaggtgctcaaggagggacccatgaaggtgcaggccatgctggcctgggccgtctcggagctcgccgccaaccaccccaagtgccaggacgccttcgcgcagcacaacgtcatccggctgctcgtcggccacctcgctttcgagacggtgcaggagcactccaagtacgccgtcacgtccaagatgtcgatacactccgtgctgatggacagaaagaacaacgccgnctctgcggttcagccggacttgctggatgc

SEQ ID NO: 45097 - DNA, 430 bp, Zea mays
  Clone ID: LIB3066-030-Q1-K1-C5
cggacgcgtgggggcggaagttggcgacgactgggcgaccgccgccgccgtacgccaggtgctcaggtctccgtcagacccttcgccaggtcttcttccgcggcgagcaccgccaggtgtgcatccaatcttcttcactgggtcctccgctgcttctagtcacgcatctaaatccggagttgccagcattcgcttgaggtgcctgacaaagcacaccatcatgcaggctagcgataggttcaacataaactctcagcttgagcatcttcaagccaaatatgttggtacagggcatgctgatttgtctagatttgaatgggctgtaaacatccagagagacagctatgcctcttatattgggcactatccaatgctagcatattttgccattgctgagaacgaatcgatcggaagagaacgttacaatttc

SEQ ID NO: 45098 - DNA, 427 bp, Zea mays
  Clone ID: LIB3066-030-Q1-K1-C6
cccacgcgtccgcaagcctcagccgccacctgagggccgtcttcctgatgccaccaagggttctgaccacctgaggcaagtctttggcaagcagatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggccttcttcagctcccaagtgacaaagccctgctgagcgaccctgtcttccgccctcttgtggagaaatatgctgcagatgagaaggcattctttgatgactacaaagaggcccacctcaagctctccgaactggggtatgctgatgcttaaatggtccatatcctggagcgggac

SEQ ID NO: 45099 - DNA, 427 bp, Zea mays
  Clone ID: LIB3066-030-Q1-K1-C7
cccacgcgtccgcccacgcgtccgaaggaacttggagtgaactgtatagagctaatgccctgccatgagttcaatgagctagagtacttcagctcctcttcgaagatgaacttctggggatattccacaataaattttttctcaccaatggcaagatattcttcaagtggcataagagactctggatgtggtgccataaatgaatttaaagcttttgtaagggaggcccacaaacggggaattgaggtgatcatggatgttgtcttcaatcatacagctgaaggtaatgagaaaggcccaatattatcctttagggggatagataatagtacatactacatgcttgcacctaagggagagttttataattattctggttgtggaaataccttcaattgtaatcatcctgtagtccgtgaatttatag

SEQ ID NO: 45100 - DNA, 429 bp, Zea mays
  Clone ID: LIB3066-030-Q1-K1-C8
gaggactcagccaaccccatcttcatcgacatgaagtactgccccaacaagttgtgtaccgccaacggcgcctccaaggtcaccgtcaaggacgtcaccttcaagaacatcactggcacctcctccaccccggaggccattagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcatattagttgctatccattggtaacgcacaacagtaaaacgacaaacatccaacagctatattatgttcgacggtgt

SEQ ID NO: 45101 - DNA, 297 bp, Zea mays
  Clone ID: LIB3066-030-Q1-K1-C9
acacgtgcacgaaaactttattcccgactcttgaaaaatgaggaccatgacgctgaacctggtagggatagaaagcgcactcatctatgcacgcatggtcctggcaccgctaaactccgaaccgaccttctacccatacataccgaccttcagagacgccgcctacgcacccgtctgtaccttctacggtccttctagcgtctgaggctcatctgctggcaacgctcactggtctggcgcctagcgtctggggacacggatgactgcctgatctccatgcaccgcaacaggagcaca

SEQ ID NO: 45102 - DNA, 414 bp, Zea mays
  Clone ID: LIB3066-030-Q1-K1-D1
cggacgcgtggggccgcaccctcaaattccgcgggcgttaaactctttctcggtcaccgtcaatggaaggtcccagatctcttctcgccattaccgcgcccgccccgtcaattcccatatctcttcaataaggccgcccgcggctggcgcgacgtcgccggccatggtgcgggtgcaggagaccgggccatggcggcaccggcgccgagccccatccctggcgacgacgcggcatcaagccccggtgacggcggcccctgcgcagacgcggtcaccggcctcagccccggtggcggcgcgctgcctcaccggccccccagcacaggaggacgcgtcggtggctcggtgctatggacgcgtcggtggctcggtgctatcgacctcgctgtcgggtccctgttcccgctgtcgctc

SEQ ID NO: 45103 - DNA, 422 bp, Zea mays
  unsure at all n locations
  Clone ID: LIB3066-030-Q1-K1-D10
cggacgcgtgggtctcgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctgnagaggtcgtcgccgtctacttccaggggcgtcgtgtccaaggagagggagcgcctcgctgccgggaagctgccgtcatcgcttggcaaggcggaggtgtctgatggtgaggaatttgaaactgacagtgaagattctgatgtgagtggttccgagggagaggacacgtnctggatttcatg

SEQ ID NO: 45104 - DNA, 426 bp, Zea mays
  Clone ID: LIB3066-030-Q1-K1-D11
cccacgcgtccgcccacgcgtccgcccacgcgtccgcccacgcgtccgcccacgcgtgcggcataaccccaaccggagaggacggccgacggctacgagctacgtagccgtggtccggcgagtcggggattccaggtccttgacaatgacccactggaaaaggcaaatgcatccattaggagcagaactctcatgaacaagcttgttctgcctttacttttggttgaacttgtgataaccaacccaaactgccaaaaaatctggtgttgctacatttgtatcaatctttacctgagcttgtgtttttgtaagcttatgcatgtacctccacatgtatagatatgctacctacattttctttctgtggtcatatgatatgttgacaaggtcacagatatactctcagtatatgatgacgcttctatg

SEQ ID NO: 45105 - DNA, 421 bp, Zea mays
  Clone ID: LIB3066-030-Q1-K1-D2
aagacgcgtacgaccacgcgttcggacttgcaaatccataaattgccttgccgtcacggatctgcatagctcctacctatctttaggattatgatttggatttggattcggatttggatcgggtgtgtttactgcgtaaccatgagcgagatcatgaagctaaagcgtgggatcagcagcaaaccaggagaccacctcgtccaaaatggccaacaacatccatgtcacgaatgggaggagcaacatcactactggccctgcacacaggcgccgacggagagcacgaccgagtcgcccaggatcccaggcgggagccagaagaaggcggttctgggcaaggtgaagagcattgccaagaaatggatgcacatgctgtatcacatgaagaaaccctgcgccaccggaggagatgatgtggacc

SEQ ID NO: 45106 - DNA, 431 bp, Zea mays
  Clone ID: LIB3066-030-Q1-K1-D3
cccacgcgtccgcccacgcgttcgggaacatccatcgatctccccccagcggcgaggagagccggcggccacaggaaggagaaatggcttccgcacacaacgctctccgggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaaggggagcaacatcgccatccagctggatggcaacctgctggga

SEQ ID NO: 45107 - DNA, 354 bp, Zea mays
  unsure at all n locations
  Clone ID: LIB3066-030-Q1-K1-D4
gcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgctctcgcggcggcggnctcatgcggagcctctagcgcaccagcgccatcgacgccgaatgagtactacgt

SEQ ID NO: 45108 - DNA, 429 bp, Zea mays
  unsure at all n locations
  Clone ID: LIB3066-030-Q1-K1-D5
ggcggccagacagggctcccacaggccatcaccacaacacacaaagacagctcagagcaggtcacacacaggctcctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaccgccggagggagtgccgcgggacggtggccgagtgcctcgccgaggagtcggatgaggagggccttgacctggccggatcccaccgncgcgcgctctacggcggcgggtacatcagctacggcgcgctgcggcgggacaacgtgccctgctcccgccgcggcgccagctactacanactgccgcccggcggc

SEQ ID NO: 45109 - DNA, 423 bp, Zea mays
  Clone ID: LIB3066-030-Q1-K1-A4
ctcagtcacctgcgccgccgcttcgttcgtgtggaggggagaagagaggaaatggcggcgacccgaggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgt

SEQ ID NO: 45110 - DNA, 267 bp, Zea mays
  Clone ID: LIB3066-030-Q1-K1-A5
cccacgcgtccggatgtttctttcatttaaggcttgtttaggtgaaaggggttgttctaggagcactaccaagtgtttagttcaaatttgaactaaatgttgaggaatttgttccaaatccccagcatccgaacatgcctttatatatatatatatttttttttctttgcccggttttgctgatagcatggtgagaagctgtatattggagccattcaatgtaaccattatttatttttgacagaagataatgtaatttcctggagt

SEQ ID NO: 45111 - DNA, 306 bp, Zea mays
  Clone ID: LIB3066-030-Q1-K1-A6
accacgcgtccgaaaaaaaaaaaaaaataaaaaaaaaaaaaaaaaaaaaaaaaaggaaggagaaaaaaaaaaaaaaaaaaaaaaaaaaaaaaaaaaaaaaaaaaaaaaatatataatataaaatagaaatatattaaaaaataaaaaaatatataatgttttttaatgtttatttgtgaaaaatatttttgacttgtattgtttttaatttgtttatttgaataaatttatttgttctgttgttgatttttgagatatgattatgccgtttgctgtttaaaatatttgttaagattgattggccaa

SEQ ID NO: 45112 - DNA, 428 bp, Zea mays
  Clone ID: LIB3066-030-Q1-K1-A8
cccacgcgtccgccgatcgatcgccacagccaacaccacccgccgaggcgacgcgacagccgccaggaggaaggaataaactcactgccagccagtgaagggggagaagtgtactgctccgtcgaccagtgcgcgcaccgcccggcagggctgctcatctcgtcgacgaccagtggattaatcggcatggcggctctggccacgtcgcagctcgtcgcaacgcccgccggcctgggcgtcccggacgcgtccacgttccgccgcggcgccgcgcagggcctgaggggggcccgggcgtcggcggcggcggacacgctcagcatgcggaccagcgcgcgcgcggcgcccaggcaccagcagcaggcgcgccgcgggggcaggttcccgtcgctcgtcgtgtgcgccagcgccggcatgaacgtcgtctt

SEQ ID NO: 45113 - DNA, 300 bp, Zea mays
  Clone ID: LIB3066-030-Q1-K1-A9
gcttcttcggttttcaggagcgtcggccattgctgctggaaaagcagaccattgggactccctcgtgcgttttccaaatcagtcaggttgatggcgatggagggaccagttttatgccgccctgcaatgcaagccaaatcgcctgctgctgcgctggtcaacaactacctgactcagattcggcagctggggaccatttcaaaatacaggaacgtttcaagattcatttctcccatctctcagccatctacgaagaacataggtccatgctgtagcttcagctcgtcttctgatggcatg

SEQ ID NO: 45114 - DNA, 174 bp, Zea mays
  Clone ID: LIB3066-030-Q1-K1-B1
caactgcctccgagtcgtccgccgaggctcccgctggcgctggcgctggcgctgccggtggcgccgccgcctcggggccctccgccagcagcggcgcgcccgccctcgccgccgcgcccgccgcgctcctcttctccctcctcgcctactacctccactaagcgtgtgcgtgcg

SEQ ID NO: 45115 - DNA, 191 bp, Zea mays
  Clone ID: LIB3066-030-Q1-K1-B10
aaaaaaaaaaaaaaaaaaaaaaaaaaattataaaaaaaaaaaaaatataaatatagagaagggaaaatatgcaatatagtaaagtgaaatagaatttaatgggatagatttaacttatggaaagtgacaagtgattatgagtttgggggatggtttaattgcaattttgtttacatttttaattctgatta

SEQ ID NO: 45116 - DNA, 290 bp, Zea mays
  Clone ID: LIB3066-030-Q1-K1-B11
aaaaaacaaaagaaaacaaattataaaaaaaaacaaaaaaaaaaaactaaacaaagagaaggggaaaaatacaaatacatgatacgcaggcatctctctgggacccattctcgccttagcgccctcctacggggcggcggcgccgttcggaggcgccgagtacgcaccctgcgggaccttctacggccctgtcagtgccagcgggccatcggctgccgactccctggcgtatggcgccagcgcctttgccagaggtccgactgctgatgctccggcgactgcgacagcgg

SEQ ID NO: 45117 - DNA, 424 bp, Zea mays
  Clone ID: LIB3066-030-Q1-K1-B12
ccaccacctccatccgtgcgcctctcgctctcgctggtggtgctcctcctcctcctcctgctcccggggcgggcggcctccttttccacctcctgctggtgccagggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttcatcactgataccaaggctgctatcgccgaaacttaca

SEQ ID NO: 45118 - DNA, 239 bp, Zea mays
  Clone ID: LIB3066-030-Q1-K1-B2
ttcacgcgttcgaactgttccttcaacttcatcatcgtcgtcaacgtcttcaaccagggcgacctttctgttggttatcacctggcaccctatgcatttcttgaagaactaggggatcgacgggatgcctggcacgcaatgcgcgattctgcctaacaccgacttaacgtcccgtggcagtccaaggtccacatcctcagctttttctacttcctatccatcggtgtgcaaaaggcatt

SEQ ID NO: 45119 - DNA, 432 bp, Zea mays
  unsure at all n locations
  Clone ID: LIB3066-030-Q1-K1-B4
ctaagggtaactacaaatccagaaccttccaaaaccgcaattcccactaaaaggaaaagggccagaaacctttttaggcccaataataacaatggaggtggcagcaaaagagacaagaagcattcttaccgcagtagtgccagcagcagcagcagagctattaccagtggttctcaatattgtgacgcatacagtggtggtggcatcaacaacagaactgttcctgaatctgccaagatatctccattggtggtagctgaaaatgttacaccgcaagagatggttcctgtactgaagacactggaaccaatcaaatgtactaccagctgcggcaaagagaagccatttgccttgctgtcgcgccagttttcccctgcaaggtacaaggngatgttcaccttttggaaccaaaaccaactggctttttgacaa

SEQ ID NO: 45120 - DNA, 143 bp, Zea mays
  Clone ID: LIB3066-030-Q1-K1-B6
cggacgcgtgggtgaaaacaatgtatttgtattaatgtgttggaacacgtatatgtagttgcaacttcttttctgtgagccgtgggcgtgtatgcacgttttaggtggagaaaatggtataaatcagatgaaagggtgaatgc

SEQ ID NO: 45121 - DNA, 429 bp, Zea mays
  Clone ID: LIB3066-030-Q1-K1-B7
cggactcctgggctctaccgacacgcgaggtcgctgtgctgatggtggcatcaccgacggtcctctaacgtggaggccgccaagatggacctgctgtaggacgatgacgagtttgaaaagttcgagatcaaccaaaaattggatgacctgtactacggcttcgaagccctgcaaccgtgcgtggatgattggaatgtccactacctgaaccatgatctctaggtgaacttcatggacgacttcgacagggccctcgagcagattagctctaacgtcatcaatgtactctatatcaatgatgttcatatggcaggtactatcggaaccagcgatgtgcttcatgatatccatgtaatgtacatcaagaacctcaagcccattagcgaaggtggcggtgagccgcctcatgggaaacttggctgggccatc

SEQ ID NO: 45122 - DNA, 430 bp, Zea mays
  Clone ID: LIB3066-030-Q1-K1-B8
cccacgcgtccgcccacgcgtccgcccacgcgtccgcccacgcgtccgactttcaagatccatagcttcatgcaaagtagaagcaagtactgtcagtgcatggatcaactttttgaaagatacgtggaaattgcagtccttgtttgaagagctaagagaaaaacaggccaacgaagaattggatagatgtggactctgctttgcgaaattgatgaagtatcatgtttctgcatccatggaagagctaagcacttctattgaccgtatcaaaacctttgttgataacttgaaaatatttggtaacagatccgtgtcagcagaggatggagctaatggtccgtctaagcaatcaaaccctcgtagatatcttgaggaagaatatctccaaactgagaaaaaggtcgtagctgcattcagtttggttgatagt

SEQ ID NO: 45123 - DNA, 425 bp, Zea mays
  Clone ID: LIB3066-030-Q1-K1-B9
cccacgcgtccgcccacgcgtccggatatgccagcaggttgctgtcaatatcgcccctgcagaaacgcaatcaagtacaagttattgggtttggagggttgattcgacttatggaaggggacgaggaggacgagaaaggggatggttcagcccactttgggttgcatttgcaattctgattggtggtctcttattggatgtgctgatatctgtttttcttggtgtttccgcacttcctgtcaatataataattggtgttcttatagttctcggattggggcaccgccttcatctagctcttgagtgctgtcacgaatggggctcaaggaggaacgttggcaatattccgaggctggagaacatagcgccgactgggtaccaccctgcagtagtataatcgttatgggacttgtaaatagcgtaag

SEQ ID NO: 45124 - DNA, 432 bp, Zea mays
  Clone ID: LIB3066-030-Q1-K1-C1
gaaaccctagttcgaacgcgccgccgtcaccgtcgtcgctcgcgctctccgcccggatcggagcgagagtaggggcgtgtcggcggtgaaagcgactgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagaggaacaaggggaaggcattgtgctgggaagtgtccctacatacccttggga

SEQ ID NO: 45125 - DNA, 425 bp, Zea mays
  Clone ID: LIB3066-030-Q1-K1-C10
aaaaaaaaaaaaaaaaaaaaaagggcgccgctgcgatcaacctcgatgatatcaaatggcatcagtgtgtacgtttggctagatttgagaatgatagaactatatcgttcatacctcctgatggatcttttgatctaatgacatacaggcttagcactcaggtaaaacctcttatctgggtcgaagcacagattgagaaacattctagaagccgtatagaactcatggtgaaggcaaggagtcagtttaaagaaagaagcacagcaacgaatgttgaaattgaagtgcctgttccttcagatgccacaaacccaaatataagaacttcaatggggtctgctgcatatgctcctgagagagatgcaatggtttggaaaataaaatcattccctggtggcaaggaatacatgtgcagagcagaattt

SEQ ID NO: 45126 - DNA, 354 bp, Zea mays
  Clone ID: LIB3066-030-Q1-K1-A3
aagtggtacggccgattgaaaaaaaaattaaataaaaaaaaaataaaaaaaaataaaatagaaatgatacaactacacaacattactaaaaccataaatttaatcaactccactataatccaactacctctacaatcattaatctaaatatttcttattcacatttatttatgcctattcacaaaaaatcgtactcttactgactttacatcttttcataatagctctacatttctctaatttttacaattgagaatcttaacctctctgtaacgctcatcataaataacttaatattccaaaatactctttacacctctatattcactctttacgacaatttcaacatacact

SEQ ID NO: 45127 - DNA, 230 bp, Zea mays
  Clone ID: LIB3066-030-Q1-K1-C11
ggtgggctggcttctgctccccctccggttcgggatcaggttcgtgaggatctacggggttcagtttggtggtgtgagctgatcgagatggcgatgtaggtatgatgagtaccgctgcttgttccgcggtctcgactgagccactgacgacgactctctccacaactccttcatcacctactgcaaggtcctctagtacaatatcatactcgatcggttgactcagaggt

SEQ ID NO: 45128 - DNA, 397 bp, Zea mays
  Clone ID: LIB3066-030-Q1-E1-G9
ctaagggtaactacaaatacaagacctccaagagcagcagtaccactagaaggaaaaaggacaagaagcattctaggcacagtagtagcaatggaggtggcagcaaaagagacaagaagcattcttaccgcagtagtgccagcagcagcagcagagctattaccagtggttctcaatattgtgacgcatacagtggtggtggcatcaacaacagaactgttcctgaatctgccaagatatctccattggtggtagctgaaaatgttacaccgcaagagatggttcctgtactgaagacactggaaccaatcaaatgtactaccagctgcggcaaagagaagccatttgccttgctgtcgcgccagttttcccctgcaaggtacaaagggatgttcac

SEQ ID NO: 45129 - DNA, 333 bp, Zea mays
  Clone ID: LIB3066-030-Q1-E1-H1
ggattgcaaaaaaattccttccccaacccgccgccgcggctcgtctccctgaaaggtgccgggaccgaggatttggccgagttctaggtagagaatcggttttacttgtctcaacccggggtctgctgcgtctggtggtggtgaaggggagaaattcgtgagatctgttccggattaagcgtgcgagctcgggaatcaagggtttcacacatagcttcgtcgatttgaatttgatgtactaatggagtctaagggtggcaaaaagtctagcagtagtcgttctatgatgtatgaagctccccttggctacagcattgaggacgttcgacctgc

SEQ ID NO: 45130 - DNA, 268 bp, Zea mays
  Clone ID: LIB3066-030-Q1-E1-H10
atgtggtacggccgattgaaaaaaaaaaaaaaaaaaaaaaaaaaaaaaaaaaaaaaaaaaaaaagaaagacaaacaaaaaaaaaaaaagaatagctaaccgggagagccccgccatggtccatcttaacttcctcgcaaaattaagttaacaggccgctccttttttattctcacggtctgattcgggggtggccctttaaaaaaaattggcttggagagaacacagccgtttccctagctaggcgaatctcccaaaactcccctttc

SEQ ID NO: 45131 - DNA, 412 bp, Zea mays
  Clone ID: LIB3066-030-Q1-E1-H11
cccacgcgtccgcccacgcgtccggtctgccatggtcaaaggctcagcggactacgtcgccatcaaccactacaccacgtactacgccagcaacttcgtcaacgccacagagaccaactaccgcaacgattggaatgcaaagatttcgtatgagcgagatggtgtgcccattggcaaaagggcgtactcggactggctttacgtcgttccatgggggctctacaaggctctgatttggaccaaggagaagttcaacagccctgtgatgctcatcggagagaacggaattgaccagcctggaaatgagaccttgccgttcgctctgtacgacaagttcaggatagactacttcgagaagtacctgtacgagctccagtgcgccatacgcgacggtgcaaacgtcttcggctac

SEQ ID NO: 45132 - DNA, 395 bp, Zea mays
  Clone ID: LIB3066-030-Q1-E1-H12
cgacgcgtgggttgttaaataaagtgcagtatcttcagattaatatctagtatgtgagacatatatttaatttaattttaaattattttttatggagagggtccactttaattttaaatttatttggggatggtctatcacactggcttgtcactgggtcctcgtctgccttaccgtcgttgtactataccatcaaatataattagtgtatgtcgtaacacacgagtattgtactagttgtttttattgttttggtgtcaccacttaagtgttggcttacattacactagtacaatgttcatgcattgcagcggcacataagaacaaatattatattttatcttaaccaaaaagtctagaaagggatgagttaaaaaagaattccaccctctttt

SEQ ID NO: 45133 - DNA, 413 bp, Zea mays
  Clone ID: LIB3066-030-Q1-E1-H2
caaccctgcgactgcgagcaagaggccgtatctcgagaggaactactccgtgctggaaccttcagaagggagccagctcgccgacgacgtggaaggggaaagctctctcgagaacgtgaagaaacagcttgagatcaacaagaaggcgatggccgctctttacaaggagcttgaggaagaacggagcgcttcggcggtcgcggctagccagacgatggccatgatcaataggctgcaggaggagaaggctgcaatgcagatggaggctctgcaatacctgaggatgatggaacagcaggctgaccacgaccacctggcgattcaggacctgcacgatttgcttacggagaaggagaaagagttgcttgacttggacgctgagctcgcgcactgcaggaggctcctgcagaacg

SEQ ID NO: 45134 - DNA, 407 bp, Zea mays
  Clone ID: LIB3066-030-Q1-E1-H3
atggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgccggcctcactggccggaagatcatcatcgacacctacggtggctggggagcccacggcgggggcgccttctccggcaaggacccgaccaaggtggaccgcagcggggcctacgtcgcgaggcaggctgccaagagcatc

SEQ ID NO: 45135 - DNA, 420 bp, Zea mays
  Clone ID: LIB3066-030-Q1-E1-H4
gcttctacggttttcaggagcgtcggccattgctgctggaaaagcagaccattgggactccctcgtgcgttttccaaatcagtcaggttgatggcgatggagggaccagttttatgccgccctgcaatgcaagccaaatcgcctgctgctgcgctggtcaacaactccctgaccagattcgggcagcttgggaccatttcaaaatacaggaacgtttcaagattcatttctcccatctctcagccatctacgaagaacataggtccatgctgtagcttcagctcgtcttctgatggcaatggatacatggctggaaactttagcgacagtgatgaagattatgttaattctactgtgctagaagcagttgaggtgagaagtggatcggaacgatatgtgataaagatgcgagatgggaaa

SEQ ID NO: 45136 - DNA, 431 bp, Zea mays
  Clone ID: LIB3066-030-Q1-E1-H5
cgggacgcactcagaccacgcatcacgcgtatggatagccacagccaacaccacccgccgaggcgacgcgacagccgccaggaggaaggaataaactcactgccagccagtgaagggggagaagtgtactgctccgtcgaccagtgcgcgcaccgcccggcagggctgctcatctcgtcgacgaccagtggattaatcggcatggcggctctggccacgtcgcagctcgtcgcaacgcccgccggcctgggcgtctcggacgcgtccacgttccgccgcggcgccgcccatggcctgaggggggcccgggcgtccgcggcggcggacacgctcagcatgcggaccagcgcgcgcgcggcgcccaatcaccatcaacaagcgcgccgcgggggcaagttcccctcgctcttcgtgtgccccagcgccgggat

SEQ ID NO: 45137 - DNA, 59 bp, Zea mays
  Clone ID: LIB3066-030-Q1-E1-H7
accacgcgtccgaaaaaacatgaagttttgtaaaagggactcaaatatgataatgtagg

SEQ ID NO: 45138 - DNA, 267 bp, Zea mays
  unsure at all n locations
  Clone ID: LIB3066-030-Q1-E1-H8
cccacgcgtccggatgtttctttcatttaaggcttgtttaggtgaaaggggttgttctaggagcactaccaagtgtttagttcaaatttgaactaaatgttgaggaatttgttccaaatccccagcatccgaacatgcctttatatatatatatatttttttttctttgcccggttttgctgatagcatggtgagaagctgtatattggagccattcaatgtaaccattatttatttttgacagaagataatgtaatttcctggngt

SEQ ID NO: 45139 - DNA, 434 bp, Zea mays
  Clone ID: LIB3066-030-Q1-E1-H9
ctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtgg

SEQ ID NO: 45140 - DNA, 365 bp, Zea mays
  Clone ID: LIB3066-030-Q1-K1-A1
cccacgcgtccgcggacgcgtgggttgttaaataaagtgcagtatcttcagattaatatctagtatgtgagacatatatttaatttaattttaaattattttttatggagagggtccactttaattttaaatttatttggggatggtctatcacactggcttgtcactgggtcctcgtctgccttaccgtcgttgtactatacccatcaatattaataagggattgtggaacccaacaattttggacctagtggttttaatggtttgggggtaacaacttaagggtgggttaacattacactattccattgttaatgcattgaaccggaccttagaaccaattttattatttaatcttacccaaa

SEQ ID NO: 45141 - DNA, 383 bp, Zea mays
  Clone ID: LIB3066-030-Q1-K1-A10
ccttcttcggctctcaggagcgtcggccattgctgctggaaaagcagaccatggggagtccctagtgcgttctccaaatcagtcatgtcgatggcgatggacggaccacttttatgccgccctgcaatgcaggccaaatcgactgctgatgcgctgatcaacaactccctgaccagattctggcagcttgggaccatttgaaaatacacgaacgtatcaagattcatttgtcccatctatgatccatctactaagaacatacttacatgctgtagctacagctcgtcttctgacagcaatggatacatagctaaaaactttagcgacagtgatcaagattatagttaattctactgtgctcgcaccagctgaagtgaaaagag

SEQ ID NO: 45142 - DNA, 429 bp, Zea mays
  Clone ID: LIB3066-030-Q1-K1-A11
caaccctgcgactgcgagcaagaggccgtatctcgagaggaactactccgtgctggaaccttcagaagggagccagctcgccgacgacgtggaaggggaaagctctctcgagaacgtgaagaaacagcttgagatcaacaagaaggcgatggccgctctttacaaggagcttgaggaagaacggagcgcttcggcggtcgcggctagccagacgatggccatgatcaataggctgcaggaggagaaggctgcaatgcagatggaggctctgcaatacctgaggatgatggaacagcaagctgaccacgaccacctggcgattcaggacctgcacgatttgcttacggagagggagaaagagttgcttgactaggacgctgagctcgcgcactgcaggaggctcctgcagaacgatccgttcaacggcga

SEQ ID NO: 45143 - DNA, 419 bp, Zea mays
  Clone ID: LIB3066-030-Q1-K1-A12
gttgccaaagaattccctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttctcattctagta

SEQ ID NO: 45144 - DNA, 430 bp, Zea mays
  unsure at all n locations
  Clone ID: LIB3066-030-Q1-K1-A2
cccacgcgtccgcccacgcgtncggtctgccatggtcaaaggctcagcggactacgtcgccatcaaccactacaccacgtactacgccagcaacttcgtcaacgccacagagaccaactaccgcaacgattggaatgcanagatttcgtatgagcgagatggtgtgcccattggcaaaagggcgtactcggactggctttacgtcgttccatgggggctctacaaggctctgatttggaccaaggagaagttcaacagccctgtgatgctcatcggagagaacggaattgaccagcctggaaatgagaccttgccgttcgctctgtacgacaagttcaggatagactacttcgagaagtacctgtacgagctccagtgcgccatacgcgacggtgcaaacgtcttcggctacttcgcgtggtcgctgctg

SEQ ID NO: 45145 - DNA, 144 bp, Zea mays
  Clone ID: LIB3066-030-Q1-E1-G7
acggacgcgtgggtgaaaacaatgtatttgtattaatgtgttggaacacgtatatgtagttgcaacttcttttctgtgagccgtgggcgtgtatgcacgttttaggtggagaaaatggtataaatcagatgaaagggtgaatgc

SEQ ID NO: 45146 - DNA, 417 bp, Zea mays
  Clone ID: LIB3066-011-Q1-K1-D10
ctagaaaacggaacaccgggggtccgccattgtcgggatgcgccacgatgccatctgccgcctcgggtgctcgcctcttatcgcatccgcgtcctcccccaccctgtcgccgcggacaacgatgacgtgggacccctgcgcggcctcttcgtgctatcccgcgaccccggagcgcaagaatcagtcgtcgccccgggtgcgtgttggggggttccatggggagccaccgctgtcgccgttcctcgcctctgtcgacggccggaatccatggaattgatgcggagcttcgactggacacggggaagctatcccgaccgccaatttgatgaacggccagtcggaactcgggcaatggctcaccggaggagtggcgtccgtcgcgggccgcgttccatcgtgggcgttcgtctccgtgcc

SEQ ID NO: 45147 - DNA, 86 bp, Zea mays
  Clone ID: LIB3066-011-Q1-K1-D11
tctccaaccttcaataccctcttctccttattactcacatgctctacaatcctatctgagcacatattatactcgccctattatca

SEQ ID NO: 45148 - DNA, 416 bp, Zea mays
  Clone ID: LIB3066-011-Q1-K1-D12
aagatcccaccggctcccgccggccgtcgccgacgagcaccgcatcctgacacagaggggctgacgagccatcgcgtgcggcctcacccgggatggcgaccatggagagcctgatcgggctggtgaaccggatccagcgcgcgtgcaccgtcctcggcgaccacggcggcggcggcggtgagggctccctctgggaggcgctcccctgcgtagctgtcgttggcgggcagagttccgggaagtcgtctgtgcttgagagcatagtacggagggacttcctgccccgtggatctggtatcgtcacgaggcggcctttagtgctgcagctccacaagacagatggtgggcactagtatgctgagtttctacacgccccgcggaagcggttcaccgactctgctgctgtgaggaaagag

SEQ ID NO: 45149 - DNA, 424 bp, Zea mays
  Clone ID: LIB3066-011-Q1-K1-D5
gttacagcactagcagtaaccattggctttctaagatggctttaactgctccctcttggcggcagcaactatatttgcaggtgtggtaatgtacgatgcttctggtatcagattgcatgctggaaagcaagcagcggtactgaaccaaatagtttgtgaacttccttctgaacatcccttgtctgaaacaagaccactgctagaacttttaggccatacaccaacccaggttgttgctggcgcatagcttgggtgtacgatagccacagcaggacaattattcgtttgaactccgaaggtgcaggataaatgttgtatcatttgcatcgcggagacttgagaagaagtttctctagtgttctgctactctaagtatcggtaagattttcaacttggtgctgtaatgtttgtgaatgttgtaagc

SEQ ID NO: 45150 - DNA, 446 bp, Zea mays
  Clone ID: LIB3066-011-Q1-K1-D7
acgcccccgccaccggccggatcgacagcaccgatcaccctgaccgtctgcgcgcggcgggtctcactccggtgacacgcagggcgcgcataggcgagggcctccccccccggcgagggatggtgtggtcggctgggatggcaacaatgcgaggcgcctccgccgccgcgctactggtgctggcgctcgccgccgccgtggcgcgcgcggaggacccctaccacttcttcgagtggaaggtgacgtacgggacgaggaccatcatggggacggcgcagaaggtgatcctcatcaacgacatgttcccgggccctaccatcaactgctcatccaacaacaacatcctcgtcaacgtgttcaacatgctcgaccagccgctcctcttcacctggcacgggatccagcagaagaagaactcgtggcaggacggcatgccgggcaccatg

SEQ ID NO: 45151 - DNA, 310 bp, Zea mays
  Clone ID: LIB3066-011-Q1-K1-D8
cccacgcgtccgggcaccaacacggcggcgctgagctagccagtcactcaatctaagggggctacattcacataagaggctaataccttctacaccgttatctgctcatccttctacttcactgataacctcatggcctacatacactactcatcgtaacactatgaactctcctcgttctatctcaacactaaccttctacaccctatctactacatcttccagctacttctacattcccagaaccatatacgagccacactccacgactctaaacacagatcacttcacaaactgtttcacatggcat

SEQ ID NO: 45152 - DNA, 408 bp, Zea mays
  Clone ID: LIB3066-011-Q1-K1-D9
cccacgcgtccgctaccctcgtcgtcgtctcactcaccccgccttcacgcctccctcgccaaataaggtcccggcgcttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggaca

SEQ ID NO: 45153 - DNA, 439 bp, Zea mays
  Clone ID: LIB3066-011-Q1-K1-E1
ctcaccttctcatcctcatccctccacaccaaccatcgactgagcaccagtcgtctcactccattccgtgggcgtgctctcatattcaacctactcccccccctcagtgccatcgcctttcccactggaattaccccactccgctgctcactcatttccccctttctcctcacttcaccacattatccactctatccatacctttacccctctcaactgttcgatttgcatcccactcacaacatttattatacagagcgccacactcccattgctcttcaaccaatttaatgccacgacgaagctaatatcactaaatacacatattcaactcattaaagaccatatgaataatattgatccaaaatcacttcattacctacaacctaatatttcaactctatttcaaaaacatggacttaatccacttactccaatt

SEQ ID NO: 45154 - DNA, 413 bp, Zea mays
  Clone ID: LIB3066-011-Q1-K1-E10
tctaaatagaagcaatactgatggcccaaaacaagatgattgtggtggttctcctgggggccacctttcttgtggtggcaagatcgttgtgggttccagaagaaccctcaaatgcggatgacataagaggtgcttgcatcgaggagtgcaccaaagaaaataaggctcctggcgacaagaagacatgcgaagtgttgtgcaccaagctcacaaaaaagcctagcgaagaaggcaaacatgattgatgaagtagcactccgataatatataccctagtggatcagtggtcatctttgtagccatgtctgccacacgatggccttgactatattgtcttattgttttgtttatggtttccactagtatcctaattccttgttcatataacctaatttcactcaaagcattttata

SEQ ID NO: 45155 - DNA, 389 bp, Zea mays
  unsure at all n locations
  Clone ID: LIB3066-011-Q1-K1-E11
cgcctcaacacgctccactacgtgctgacccacctggaggccctcgacagctcgctcgcggcctcgacctctcagctggaccgtgcacgcgccgcggcgcagtcgtcgatctcggccgtcgccgaggtcgccgcgcaccggctgatcttactggactcgcgccacttcttgtaccagggcctgtacgcccgcagtgtggcggacgcccgcatccgccccgcgctccgcctgctgaagcagaacctgtcgttcctggtgtgcgtgctcgcggaccgcgcgcagcccgtggcggtgcgggaggtgatgcgcgcctncttcgaggcgttcctgatggtgctcctggcgggcggcaacgagcggagcttcgtgcgcgccgaccacgccacggt

SEQ ID NO: 45156 - DNA, 339 bp, Zea mays
  Clone ID: LIB3066-011-Q1-K1-E12
tcgcccacgcgttcggagaactgtccgctgtcgtgactgacgttggggaggtcgtccgtgttcttgattgtgcgcagacctgatcttgtcgcagtctccttttccacgttgctactttactgtagcattgcggtagacgacatgatgagtgctgaaggttgatggcaatcaaccactgcatagaactatatagctgtcatcctgttctgtctgtcatctactgactgagaccaattatatgacagacggttgctattggctgtgctctagatcttagtctgactgacgtacttaacgcagcggtcttctacatacttattgacattgctggtaatagta

SEQ ID NO: 45157 - DNA, 454 bp, Zea mays
  Clone ID: LIB3066-011-Q1-K1-E2
caagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgctccgtcgcgtcggggctctcgttcggccacaccccggcgtccgtcatggcgacgctgtgcttct

SEQ ID NO: 45158 - DNA, 394 bp, Zea mays
  Clone ID: LIB3066-011-Q1-K1-E3
tcctcacgcatctaacacccgtactcgcctcgccaccatactacacagcatgacgtcggactctcaacggccggccctctaccaagaggaggtaaccctccttgacaccgccaagactcactcttaccacttcaacaagctcatgagcaaacccatcaaactaacacacctacacctaccaccatttattcctcattctaaaaactcatcttctttgtctgatctacctcaccttgcatatatcctcaaaacccacaatgataacgccaaacatgctcttgaccatgaaccacatggacatgaaatgcactctttaccatgcagactcttctaagcatatctaatctacatgctctttagcaaaaaagcttatgcccttacactcatgctcata

SEQ ID NO: 45159 - DNA, 443 bp, Zea mays
  unsure at all n locations
  Clone ID: LIB3066-011-Q1-K1-E4
cccacgcgtccggaccaaggcgaccgtggactacgagaagatcgtgcgcgacacctgccgcgagatcgggttcacctgcgaggacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcgggtacgccaccgacgagacccccgagctgatgccgctcagccacgtgctggccaccaagctgggcgcgcgcctcaccgaggtgcgcaagaacggcacctgcgcctggctgaagcccgacggcaagacccaggtgacggtggagtacgtgaacgagggctgcgccatggtgcccgtccgcgtgcacaccgtgctcatctncacccagcacgacgagaccgtca

SEQ ID NO: 45160 - DNA, 385 bp, Zea mays
  Clone ID: LIB3066-011-Q1-K1-E5
cgataagcctgtggagtgctccggcaagcccgtggtggtgcacatcacggacatgagctaggagcctatcgcggcgtagcacttcgatttagcaggcacggcgttcggcgccatggccaagaagggcgaggaggagaagctgcgcaaggcgggcatcatcgacatgcagttccgaagggttaagtgcaagtacgactccaaggtcaccttccaccttgaaaaggggtgcggccccaactacctggcgctgctggtcaagtacgtcgatggcgacggtgacattgtggcagtggacgtcaaggagaagggctctgacacgtacgagcccctgaagcacttctggggcgccatctggaggaaggacaggctcaaaccgcttaaggga

SEQ ID NO: 45161 - DNA, 451 bp, Zea mays
  Clone ID: LIB3066-011-Q1-K1-E6
ggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctaccgcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccatgcccagtcccgtggcggtggctgtggccgcggtggctactgcggcggtcgcggcggcggcggctatggtggcgggcgccgtgacggcggttatggcggccgtggcggctaccgcggtcggcgcgagggtggtggc

SEQ ID NO: 45162 - DNA, 425 bp, Zea mays
  Clone ID: LIB3066-011-Q1-K1-D1
cccacgcgtccgcgtcgcaaccacggctgatagtttgtacgttgccgtcacgtttgctccaggggcgccatttattttcttatcatataaaaaaagagaacagatgattcccatggagaatatgctctccaaagttacaaccctattttttaaaggatttctatattactgaagaaaattagtttatttatttatggaaaaaatagaaattattaagcaaaatgggtcccaaactatacctggtcactagtgtagctggtaatccgccattccgcgcgagatcagtagggtgcgcgtgctggtgctggctacggccatggcgacgcccaccagcaccgtcacccgcggcggcaacaggcattggcattgtacccaagtgcttccactgctgttgctagtaccactatgcttcgcgcttctggttg

SEQ ID NO: 45163 - DNA, 305 bp, Zea mays
  Clone ID: LIB3066-011-Q1-K1-B3
gcgaagccccttgaaatgaatgaaccatgcatgcatgcatgtatgcatgcgccggggtgaggtggcgttcagctcaggcgctgagcgagtctatacgtacgtcgtcaccggctggccacgcatgcgataaccatctgatatggacggaactatatattgtattcctattaatctggcattttctaagctaattgttttttttccaaatataccgtcgatggaactccaaatgtaatgtcacgcaaatgtgtgtttttcatcgattgaatggataataataaaaaggcatgctggcagttactact

SEQ ID NO: 45164 - DNA, 342 bp, Zea mays
  Clone ID: LIB3066-011-Q1-K1-B4
tccacacatcctataatactaataaaatgcttgcatgcatatattcatgcaattcccttacgtgtcctaaaaatgaagcaccaatctattctatacgtacaacataaccaaataacaaacacactgaacacaataatataatcacacaaaatactatatctgtatttctattaatatcgatattttctaagctaattgccagacaccaaaatataccaaaactataacttcaaacctaatctaacgcacaactgtcttcttgatcaatttaatgcataatactaataacgcttgttcgtacgtactactatacttctccacaaggaaaccagtaaacagcaa

SEQ ID NO: 45165 - DNA, 457 bp, Zea mays
  Clone ID: LIB3066-011-Q1-K1-B6
cccacgcgtccgggcggttcgcgatccaggtgacggggttcctgatgatgacggtgtgcgtgctggggctggccgtgccgtacgagcactggacgacgccggggcaccacatcggcttcatcgtcatgtacggcctcaccttcttcttcgccaacttcgggcccaacgcgaccacgttcatcgtgcccgcggagatcttcccggccaggctgcggtcgacgtgccacggcatctcggcggcgtcggggaagctgggcgccatcatcggctccttcgggttcctgtacctggcgcagaaccgggacccggccaagacggaccacgggtaccccgcgggcatcggcgtgcgcaactcgctgttcctactcgccggctgcaacctgctgggcctggcattcacgttcctggtgccggagtccaagggcaagtccctggaggagatgtccggcgagaacga

SEQ ID NO: 45166 - DNA, 334 bp, Zea mays
  Clone ID: LIB3066-011-Q1-K1-B7
cccacgcgtccgcacgctgttattgccaccttacgagcatcttgctgaagactgtgggcgggctggaactgcgggtggggtactagcactggactactccggggcaccacatcggcttcatcgatatgtaccgcctcaccttcttcttcgacaacttcggacccaacgcgactaccttcattgtgccctcagtgatcttcccggacagattgcctgttacgtgccacggtatctcaactgactcacgaaagctggagcgctatcatcgtgatgcttcaagttcctgtacctggcgcaaaaccgtttaccgggccaagacagaccactgataccc

SEQ ID NO: 45167 - DNA, 409 bp, Zea mays
  Clone ID: LIB3066-011-Q1-K1-B9
gtgcagaagagaagcagaaggtcacaccgcgcactgtcatgataggagggaaagcgtgggcaacatacactaatgccaaaagaatagtgaaattggtgaatgatgttggtgctgttgtgaacaatgatcccgaagttaacaaatatctgaaggttgtctttatcccaaattacaatgtatcagtggctgaagtgcttattcctggtagcgaattgtcacagcatattagtactgctggtatggaagcaagtggaacaagcaacatgaaattctctctgaatggttgtgttatcattggcacccttgatggagctaatgttgaaataagagaggaggttggagaagataatttcttccttttcggtgccaaagccgatgaagttgctgggctgaggaaagacagagaaaa

SEQ ID NO: 45168 - DNA, 449 bp, Zea mays
  Clone ID: LIB3066-011-Q1-K1-C1
cggacgcatgggcacatggcgtacagcgtcatcggactgcaggtggtgcagacaggaaagggggtgaggaaggccaagctgatcggcgccacggagatcgcggtggccagcctcgacgagctcgccatgatggccgtcgccctcgtcgctggggacgccgagcacttctgctgcctggcggcgctctcgggcgcatcggtcgccgacgacgattgcctgttctgcgcgtggctgaccaaccccaccgacgacctcatgaggctcttcccatgatgatacaggaataggactaggagacgcaattttttggataatagtcaattcgtgtacctagctccaaatatttagcaggtataagctccaatcatttacgcgtactgcatccactttgatttttgaaatcaatattataggaaagacataaacttgcaataactttatccaaaata

SEQ ID NO: 45169 - DNA, 417 bp, Zea mays
  Clone ID: LIB3066-011-Q1-K1-C10
tcgaaaaagtatcaatcgggtttgttaagtgatggtgttcttttatcgaactgggtaggagaagatggcagcagcggagttctaggacttgtgcgtgagaggctcctatcattgtatacttgtgctggttgtggcttggaagctgagcaccaactttgggaaatgaagcttcttggccgagaacctgatacacagctctatgatgttgtattggcaatttgtgcttctcaaggggaagctgctgctgttcgacgcttgcttgcaggagtcgagtcaaccagcgccggaagaaggaagaagtctatgtcatggctactgcgaggctatgtcaaaggtggcttcattctagacgcctcagaaacactcatacagatgctggacatgggcttgcttcctgattacctggatagagctgct

SEQ ID NO: 45170 - DNA, 265 bp, Zea mays
  Clone ID: LIB3066-011-Q1-K1-C11
cataggaacaaattaaatccacatgccattggtcgaattcacatgcagggcagagtccttcagttagaaaaggaaaccaatctattaatcgagcatagcaggccgtatcacgagagggacttggctacgggggcggttgaaaggaggcctgatagcaagccgacgacaagcgctctgttgtacgtggtcggctcgttctgctgcacattctccctgtcgtcgacaaacgagtcgttcttgaacggcccgccgaccagctcgccca

SEQ ID NO: 45171 - DNA, 365 bp, Zea mays
  Clone ID: LIB3066-011-Q1-K1-C12
cggacgcgtgggctgtaaagaggaaaatggtggaaaaaaaaaaaaaaaaacaaaaaaggaaaaaattaacagaaaggtgtggaatctcgaacatcttatctgatcccacctacgttatctttcatccgatgtgctacctcatttatactgtccacctgacaatgtctactggccggattgttacaacgacgccattcctaaaacccttaatttacctaaattaatcgctttggacaccatgcatatttcaactgatgccataataactaatattcccctaccgcacgtacgcttaaactagtactacactctgaatgtcatatggcacactctttctagcgtcacattaaactcggcctattttg

SEQ ID NO: 45172 - DNA, 461 bp, Zea mays
  Clone ID: LIB3066-011-Q1-K1-C2
cggacgcgtgggcaagaagtccgtgaatcgcagagaaagaatgaagaagctatacaactggaggagcggtatcgggcaacggtcggaaaggagctggaagatatagaaaggagacattgtgatatgacttcaatactgcatgcgctaggcatctcagttgaaggtggtgaggttaaagccttcaagcaagctcttctgaaattccatcccgacagggtatcaaggaatgatatttatcaacaagtaaaagcagaggagacatttaagttcatttcgcggctgaaggagaagctacctcggctatcctaatagccatcccactcttttttccacatgccttggcgcatcctccattcacctgtaaggtcaaggtacagaattcagaggatgtttattggcgttatttacaagtaactagggctttaacttgttaaatgtgtttttgtgtgtgtgtgtgtgtg

SEQ ID NO: 45173 - DNA, 424 bp, Zea mays
  Clone ID: LIB3066-011-Q1-K1-C3
ccaagatctggaagggccaggtgggaggaccaagcttcgtcgacgtcgactcctcgtcctggcgcgcctcgctcgctgctctgcaattctccgcagccctcctctttcggtctttcccgctggcttcctcttttcaaaaccctcgctaatctcgtgccccgtcccacccacctctagcttcgaatcctagcgcctcgcctccgcattctagggtttccccgcctacggcgccggccatggaggcggtggtcgtcgacgcgggctctaagctgctcaaggccggcatcgcggcgcccgaccaggcacccccactggtaatgccgtcgaagatgaagctggatgttgaggaccaggagctggctgacggcgcggtggtagaggaggtggtgcaccctgtggtgcgcggcttcgtcaaggactggga

SEQ ID NO: 45174 - DNA, 303 bp, Zea mays
  Clone ID: LIB3066-011-Q1-K1-C4
tccgacacctggattttccacttttttaatactactcttcctacactcttactatcaatccttcctctctttaatctctggtctgcaattcttatcatccctcctttttcaatctatcccactgtattactcttatcaaaaaccacactaatctaccaccctatcccacccacctctatctccgaattctagctcctctcatacacattctaccatttccccgactactaaaccactcataaaagcaaccatcatagacaccaactctaacaatatcaagatctctaattcccctccttacca

SEQ ID NO: 45175 - DNA, 443 bp, Zea mays
  Clone ID: LIB3066-011-Q1-K1-C5
gggactcaggcggtagggatgaccaggatgatggggagagggagatccaggagctctgggataccattgctggtggtgagtcagaggatgaccaagaaggtgttagaaccgtagatgatgataatttcattgatgacactggagttgatccagctgatcgttatggcagcgataatgagcgacattcacctggacgttatgcacaggctgaggagggtgaggaggacgatgaaatcgaacaactcttcaagggtggtaagaagaagaagaagaagaatgatcgccctcgtgcagatattggccttatagtggaacaattcattgctgagtttgaagtagcagccgaagaagatgcaaacttgaataggcaatcaaaaccagccattaacaaacttatgaagcttcctctgctcatagatgttctcttcaagagaatcttcagc

SEQ ID NO: 45176 - DNA, 455 bp, Zea mays
  Clone ID: LIB3066-011-Q1-K1-C6
actcactcacgcgctatgcatgaccaggattatctgaacagggagatccaggagctgggcgataccattcctggtggggagtcagaggatcaccaagaacgtgttagaaccctacatgatgataatttcattcatcacactctagttaatccagctgatcgttatgccacccataatgagctacattcacctgtacattatccacacgctgaggaatttgaggatgactatgaaatctaacaactctctcaggatcattagaagaacatgaacaacaatgatcgacctcacgcatatattgcccatatagcggaacaatccattgctcaattccaagtatcatcctaagaacatgcaaacttgaataggccatcaataccagccattaacaaactcatgaagcttactctgctcatacattttctcttcaataataatcttcagcaggaatttct

SEQ ID NO: 45177 - DNA, 233 bp, Zea mays
  Clone ID: LIB3066-011-Q1-K1-C7
cctcctatttctatcattcccaatatcctcctctaattaacaaccttactaatctcatgccccataccacccacctctaacttcaaatactaacacctcgactccatattctatattatccccaactactgcaccactcattcaaaccactatcgtacacgcaaactctaatctgctcaaaacctacatcgcatctccctaccattcacccctactggtaatgccacttaaaa

SEQ ID NO: 45178 - DNA, 175 bp, Zea mays
  Clone ID: LIB3066-011-Q1-K1-C8
ctctcgtcgtgcccaccctttccatctggctgctggcccttttttgcaatcaatcggtgggctcttggttcttccgtctgctggggtgaatctctctctttctcttccgggagaaaccagaagagagagaaggaagaagaaaaatcgggaccagcctggtctttttgcccggaat

SEQ ID NO: 45179 - DNA, 361 bp, Zea mays
  Clone ID: LIB3066-011-Q1-K1-C9
aattcggcgtcatcctcgtcggacaaaagcaagagaaaaaggtgatgggaacccatagaccagcctgtaaggccttggtcggggaacgaagtttatgtaaataatgcttctactgtgaagagttccatcatatttgttgctccagaaaagaccctcagaccggtgtttcctgaacccatattcatacaaagacatcagacgatgaataatgttgcgagtagtcaaataaaataaataacttgtatagtgaataactagaaactagcattcatcgttttggtattgtatagcgctagagtgtaattgtttggtcggactgtcttgtataatggtgtagggctcaaacgcattgtgacctagc

SEQ ID NO: 45180 - DNA, 414 bp, Zea mays
  Clone ID: LIB3066-011-Q1-K1-B12
tgacatgcctatggtcagaagagcagctgcatcaaatcttggaaagtttgcagctgcgcgtgaacagaatcatgtgaagacagaaataatgtcaatatttgatgatttaacccaagatgatcaagattcagtgcgtctgatggctgttgaaggctgtgctgcccttggtaaattgttggaaccacaagattgcgtagcacacattctttcagtcattgtcaatttctcccaggataaatcatggcgtgtttgttatatggtcgccaatcaattatatgagctctgtgaggctgttggccctgagcctacaagagctgattcggtgcctgcctatgttcgactacttcgtgataatgaagctgaagtgcggatagcagctgctggaaaagtaactaagttttgccgcatattaaa

SEQ ID NO: 45181 - DNA, 265 bp, Zea mays
  Clone ID: LIB3066-010-Q1-K1-H3
gccgtcacgccgatcaagaaccagggcccgtcgtgctctagctgctgggcattcgtgacggcggcgacgatcgagagcatcaccaagatcacgacagggaggctggtgtcgctgtcggagcaagagctgatcgactgcgacccctacgacggcggctgcaacctgggctacttcgtgaacggctacaggtgggtgatccagaacggcgggctcaccaacgaagccaactacccgtaccaagcgcggcgggacgcgtgcaaccggt

SEQ ID NO: 45182 - DNA, 193 bp, Zea mays
  Clone ID: LIB3066-010-Q1-K1-H4
cccacgcgtccgcatcaaataaacaagcgcacacgaacaaatacctcgccgccaatagtgggctccagatcctgcattgtgctcgccacggcgatgctagctacactattcgcggttggtttgtgcaccaccccgctcaccttccaggtcggtaagggatccaagcctggccacctgatcctcacccgaaacg

SEQ ID NO: 45183 - DNA, 74 bp, Zea mays
  Clone ID: LIB3066-010-Q1-K1-H5
accacgcgtccggccacgcgtccgtccacgcgtccgcccacgcgtacgcccacgcgggcggttctagatcgcga

SEQ ID NO: 45184 - DNA, 367 bp, Zea mays
  Clone ID: LIB3066-010-Q1-K1-H6
cccacgcgtccgaccacgcgtccgtctcaactctcctttcctctcgtgggcgatcggctctctcctgcggcggcggcggcgatcaacgtcgacgactacggtccacgattctccttcgaagcgcgaatcatgatacattttgtgctccttatcagcaggcaggggaaggtgaggctgaccaaatggcacactccatacccacagaagcagagatccatgatcatcacagagattagtacgctcgtcctgacaagaagccccaagctgtgcaattttggctactggcaaggctacagaattgtgtacaatagggatgctagcctttacttctgcatgggcattggccactttgacaatgaactggaaa

SEQ ID NO: 45185 - DNA, 230 bp, Zea mays
  Clone ID: LIB3066-010-Q1-K1-H7
ctacgcaccaccattatattgatcgatctatgctgctgctggtcgcaaacgcgccggggcttcacgggcggccctctcccgaaaatcgagcaccagagtgttccaatcccttctccatataattattggtgttagtttcctgctttccctagtccctcgcaatcaacagatacctcatggacgatcaggagaacgagaatgagcacgagaagcatgcctatgctgggact

SEQ ID NO: 45186 - DNA, 412 bp, Zea mays
  unsure at all n locations
  Clone ID: LIB3066-010-Q1-K1-H8
accacatacgaangatcttgagttgacgtcgtcatcaactgaaactactgatgatcgttttgaagtgaatgacattgaaccaccagctaaggaagtggtggtcgttgatgatacccacgttgtggatcctgtatatgattcaagtccttcgggaagcgagaggcctgcacctactggattagtaattgacggacctgtcctaaaagatggtcatgcttgtactcttgttgttgaagcaatcatcgaagaagggggttcatcgtcaagaatggaggtttcttccagagaggtagctggacctagtttgagttctgtggagcaaagcgaatccccagagaaagaagcctctgagataagagagcaggccatggttggccatgtcgaagcacatggaggttctgtcagccatgct

SEQ ID NO: 45187 - DNA, 98 bp, Zea mays
  Clone ID: LIB3066-010-Q1-K1-H9
tttctatcactaggagctgcgagaatttatacccgtgcaatgatggaacggccacaaccttgcatctcgatgcttctagcataagggtcgccagtgca

SEQ ID NO: 45188 - DNA, 423 bp, Zea mays
  Clone ID: LIB3066-011-Q1-K1-A1
cccacgcgtccgcccacgcgtccgcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggtgtgaccgacgcgaacggcacgtacacgatcgagctcaaggacagccacgaggaggacatctgctaggtggtcttggtgga

SEQ ID NO: 45189 - DNA, 76 bp, Zea mays
  Clone ID: LIB3066-011-Q1-K1-A10
acggacgctttagcagacgcgttagcctacacctgcgccagccaaggaagcccatgcggagcacacggaattcggg

SEQ ID NO: 45190 - DNA, 362 bp, Zea mays
  Clone ID: LIB3066-011-Q1-K1-A11
cggtccagattcccgtcgagacacacgtacgcaaaatcaactacttaaactccatatattataccctgataacaaaatacgaacccattgagcatcataactagatctatgcacgccaaaacatatacttcatccaaatactactacatcaccatctcactcaaccaatactcatattactaaaccaacccctccaatatgataccgacctgtaccctacacaactactacctctcactccctcaatcctaaatcgtacttacactagcagctacacctaacattcctccaacttatacataatcttttcctgttgtacaatcttctacaaataaactttttcgccagcatctctgatcaat

SEQ ID NO: 45191 - DNA, 411 bp, Zea mays
  Clone ID: LIB3066-011-Q1-K1-A12
gagctcctcgggaatccggtgccaggcctcgccttctcgcggcggtgctccctccctgttcgtcccccagcgacgcaggcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcagggagcagcagatcgaggtggacagggcgaagcaccggcggaagaagcgcgcggcggcgcacgcgctgtccgcacgcagcatggagcaccggcaccagcagcagctgcagcagcaccaccaccagcagcagcaaccgcagccgcggaat

SEQ ID NO: 45192 - DNA, 85 bp, Zea mays
  Clone ID: LIB3066-011-Q1-K1-A2
gcgctacacagtgtattgtgcattacattggtgtgctgctattccatatagaatagtacggtggatgaacaaaaaggataggact

SEQ ID NO: 45193 - DNA, 436 bp, Zea mays
  Clone ID: LIB3066-011-Q1-K1-A3
gtctcccctacggcttcacatccccatcaccgtcatcctctccggggggacggacgccggggcgcctccgccgccccgtcgccatgggcaactgctgcccgggctccggggatgcggagcccgcccccgctgcctccgccgatccctcctcccacctccactccggcagcttgtccctcaaggccggcgcctcggcaggctcggcgcccacgcccacaaagccgcccgcgcctatcggcccggtcctgggacggcctatggaggacgtgcgcagcatctacactgtcggcaaggagctcgggcgtggccagttcggcgtcaccagcctgtgcacgcacaaggctaccggggagcgcttcgcgtgcaagaccattgccaagcggaagctctccaccaaggaggacgtggaggacgtgcggcgcgaggtgcagatcat

SEQ ID NO: 45194 - DNA, 434 bp, Zea mays
  Clone ID: LIB3066-011-Q1-K1-A5
cccacgcgtccggcgacttcaccgtgacaacaaaggaaggcaaagtgtatgacatcggcaagggccacatcgtcgcgacatcaccatccttcgccaacaggctgccccacatctacaagaaccctgactcatatgaccctgaccggttcggtcccggaagggaggaggacaaggctgcaggtgccttctcgtacatctccttcggtggtggcaggcatgggtgcctcggtgagcccttcgcctaccttcagatcaaggcgatctggacgcacctactgaggaactttgagttcgagctggtatcgccgttcccagagaacgactggaacgccatggtggttggcatcaagggcgaggtgatggttaactacaagaggcggaagcttgtcgtggacaactaagattgtggtcgccagtctctatctcttagatgc

SEQ ID NO: 45195 - DNA, 460 bp, Zea mays
  Clone ID: LIB3066-011-Q1-K1-A6
gttagcacaaacagatcgatcgattacagcaatggcggccaaggtgttcctcctcctgcggctcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgtctacgagaaggccgcgggcgccgtcatcgcggcgacgccggacaacaagctccgcgctatggcgttcgcgttcgacggcgcggtggcgccggacccgggccggtgccccgccgtc

SEQ ID NO: 45196 - DNA, 430 bp, Zea mays
  Clone ID: LIB3066-011-Q1-K1-A7
gtcaggggtacgcatgctggttccagttcgggaccagagacagaagactgcatggagatggctagaacctttaacagctgatctatggtttggaactggatccttcgttgtcttcacaggttttatagtttggtttatcgagcacagaacgaatcaggaattcagaggaccgccagccagtcaaattggaacagtcttctacttctccttctcaacacttgtatttgctcatagggagagaattgtgaacaatttatcaagaattgcagtagttgtttggctttttgtggttctaatattgcagcagagttataccgcaagcttaagctcaattctcacggtagaacaacttcaaccaacagtcaccaatttagatgaagttatcagacgaggggattatgttggctacctcaatgattctttcatgcct

SEQ ID NO: 45197 - DNA, 184 bp, Zea mays
  Clone ID: LIB3066-011-Q1-K1-A8
taacaagacaaaaaataatttgcccaaaaaattactagaataacagctcctatcctacgatgtcttcatcagcattcggcgacttctgtccgctcaccgagctccgtctctcccaaaaggcacggcatcagctcactcacatcatgatcgccgactcgactatctccatcatcatcatactcat

SEQ ID NO: 45198 - DNA, 431 bp, Zea mays
  Clone ID: LIB3066-010-Q1-K1-H2
tgcttccgcaccctcaagctcaccaacccttcatttggcgacctgaaccatctgatctcggcgaccatgagcggcgtgacgtgctgcctgcggttcccgggccagctgaactcggacctccgcaagctggcggtgaacctgatcccgttcccgcggctgcacttcttcatggtggggttcgcgccgctgacgtcgcgcgggtcgcagcagtaccgcgcgctgacggtgccggagctgacgcagcagatgtgggacgccaagaacatgatgtgcgcggcggacccgcggcacgggcggtatctgacggcgtccgccatgttccggggccagatgagcaccaatgaggtggacgagcagatgatcaacgtgcaaaacaagaacttcttctacttcgtggagtggatcccaacaacgtcaaatccagcgtgtgc

SEQ ID NO: 45199 - DNA, 363 bp, Zea mays
  Clone ID: LIB3066-011-Q1-K1-A9
cccacgcgtccggtatatatgtggataacatagtagtcgagctgagcacggttgcgtagcctctgctgatgagggtgcacagggcgaatgagtcgttcgaacacggatgctctgactgggtgcctgtgaccatagagttcggcatccctttgtttagcccacagctctgcgagaggatctgcgagagggtcgtctagtcacagatgcttcagaaagacgacatcactgagcactactagacgatgcagaacgtgaggaggaggctgagagagctgtgcaccgagtaccaagcgaccggcccaacggcgaggctgttcaatcagcggggaggcttcaagaacaccttcccgcgcaaactggtgc

SEQ ID NO: 45200 - DNA, 417 bp, Zea mays
  Clone ID: LIB3066-011-Q1-K1-B10
cggccgagcaccatgcgaggaaataacatgccgcggcacacgtcgccgttcctttgggccttgttggcgtcggcggcgaccctgctcagcgtcggcgacgcgttggtcgtcgacggcctgcaggtggggttctatggcaagacgtgcccggcggccgaaggcgtcatcagcgacatcgtcaacaacgaaatcgctatggaccggggcatctcccctggcctcattcgcctcttctttcacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggtctcgtgcgcagacatc

SEQ ID NO: 45201 - DNA, 346 bp, Zea mays
  Clone ID: LIB3066-011-Q1-K1-B11
cgtcgccaccgtcggaacatttcactctccaggataacccgccccaacccaagagtgttcaaggcggggtgctaccaccaccttaccaaggccagtttgaccaccacctttggcttaaccttaagattaaccatcttaagattaaccaagccggcgcttccggcctcattaagcttccctttcgcggcgttccctacaacgtcaaccccatgttccccaaggggagcaacccccatttcaacacgttcaaaataaatgtttgggttaaccaagacttcaacaacgccaacgggaaagacaccggcgggaaaagcagttgccgcggcagcaacaacaacatcggcag

SEQ ID NO: 45202 - DNA, 415 bp, Zea mays
  Clone ID: LIB3066-012-Q1-K1-A2
acgtggtgcagctggcggtgaaggagaagaaggtgagcctccgggaaggcgacttcacgatcaccgacaccaacggcgccgtcgtggtcacggtcaagggtgccttgatcagcatccacaaccgccgccgcctcctcgacgccgtcggcaaccccctcctctgcctgcgcgagaaggtaatcagcatgcacaacacgtgggaagcgtacagaggggacagcacgagatcgagcgacctgctcttcaccgccaagaaatcctccatcatccagccgttcaagaccgagatgctcatctacctggcctgcaacacctcgcacgaggcctgcgacttcatcatgaagggcagcttcaaggagaggtcctgctctttctacctcggcggcaacaactccaacgccttgatcgctaaaat

SEQ ID NO: 45203 - DNA, 299 bp, Zea mays
  Clone ID: LIB3066-012-Q1-K1-A3
atggaaacggagccaccatggcgtggttgcggcggtgaagccgacgctggccaaggggacgccgtcagcgtcgatccggctccgcaacgggagcctaaacgcggtgcgcctacgccgcgtgttcgacctgttcgaccgcaacggggactgccagatcacggttgacgagctggctcatgcgcttgacgcgctgggcctcgacgcggaccgcggcgggctggccgccaccgctggcacctacgtgcccgacggcgccgcgggcctacgctttgaggacttcgaccggctgcaccgagcgc

SEQ ID NO: 45204 - DNA, 408 bp, Zea mays
  Clone ID: LIB3066-012-Q1-K1-A4
ccacgcgtccgcgcgaaaataaggaagagccgcaccatggcatcatcggccgcgcggggggtgctagccctcgcgctagtggcggccaccggcccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaagctctgccaggaggagtgcgacaaggcgtacgtggtgaaggcggccgaggtcaccaaggcctgcagcgtcacctgcgcc

SEQ ID NO: 45205 - DNA, 413 bp, Zea mays
  Clone ID: LIB3066-012-Q1-K1-A5
gtgacgacttctcctttacgctcaaggagggtccgactggcacttggacgcttgaggccaagaccccgctcaagtatcccctctgcatccgcttcgctgtcaagtctggtggctaccgcatcgccgacgacgtcatcccctccaatttcaaggccggcaccacctacaagaccaccctcagcatctgattagcctcttatgacgaataatattttgagagagctcatctggaccatgtgccagcgagctaatatttaatttttttctttggttatattgaggcaccacatgagccaagaaaaaagttatgctacatgtcccttctcgcgccttattgcgttaggttgatatgcatgattacatagattaaaatacacttttatttaagattttttggggagaaatatattgat

SEQ ID NO: 45206 - DNA, 408 bp, Zea mays
  Clone ID: LIB3066-012-Q1-K1-A6
cccacgcgtccgcccacgcgtccgagagagcagggtgtgggcgaagagaccccagggggtcgatcgttcaagaaaaataccagcttaccaacaacagcagcagcaagcccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacat

SEQ ID NO: 45207 - DNA, 411 bp, Zea mays
  Clone ID: LIB3066-012-Q1-K1-A7
cttccacctccagcctcataagcctgcggttaggggggcataaccccaaccggagaggacggccgacggctacgagctacgtagccgtggtccggcgagtcggggattccaggtccttgacaatgacccactggaaaaggcaaatgcatccattaggagcagaactctcatgaacaagcttgttctgcctttacttttggttgaacttgtgataaccaacccaaactgccaaaaaatctggtgttgctacatttgtatcaatctttacctgagcttgtgtttttgtaagcttatgcatgtacctccacatgtatagatatgctacctacattttctttctgtggtcatatgatatgttgacaaggtcacagatatactctcagtatatgatgacgcttctatgaatctata

SEQ ID NO: 45208 - DNA, 406 bp, Zea mays
  Clone ID: LIB3066-012-Q1-K1-A8
cccacgcgtccgcccacgcgtccgcccacgcgtccggctcattacaatccttcatgggagcatcactacactacactacattagagagaggtcgagcgcccctcctgcgatccgccggcccgccgagagctagctgctgatcggtcgaggagagtcatggcgacgtcaacgatgcgcgttgccgccggcgtgctgctggtcgtgtcggctctggcgaccttggccctggccgacgacctctacctgttctatcagtggaaggtgacgtacgggaccatgtccctgctgggagtgccccagaaggtcatactcatcaacggcgagttccctggccccaggatcaactgatcctccaacaacaacatagtcgtcaacgtcttcaaccagctcgaccatccgctccttt

SEQ ID NO: 45209 - DNA, 408 bp, Zea mays
  unsure at all n locations
  Clone ID: LIB3066-012-Q1-K1-A9
cggacgcgtgggttagaggacctgtccaatagagtcgagctgagcacggttgggtgggttcggctgctaaggcttcacagggcgaatgagtcgtccgaacacggaagctttgagtgggtgcctctgaccatagagttcggcatccctttgtttagcccacagctctgcgagaggatctgcgagagggtcgtcgagtcacagatgcttcagaaagacgacatcgctgagcactacgagacgatgcagaacgtgaggaggaggctgagagagctgtgcaccgagtaccaagcgaccggcccaacggcgaggctgttcaatcagcggggaggctccaagaacacctncccgcgcaaactggtgcagatggtcagcggtagatggagcccgttccatgatccgtctacgccc

SEQ ID NO: 45210 - DNA, 407 bp, Zea mays
  Clone ID: LIB3066-012-Q1-K1-B1
ccgacgcgtccgcccacgcgtccgcccacgcgtccggccacgcgtgcgcccacgcgtgcggccacgcgtccggaaattcgccgcttgatgtgtggatccgtcgcggctgccgtcaagcatagacaccaagaaccagacctcggggtggatcatcggggtcgcggaggtctactggatggggtcaagaagtatccgggcaagtcgtctctgggaaccctgcttattgctcgccggatgctagcgccgccgtggactgcgcggctccgagaagtcgacgtcgtcgcgacatatcccaggaaccttcggacttggaacgaaactgtccataatatggaaagcatgattgggacgaaggtcgaatcaattctgaagctatgcgcaaggaagcttcggctcagtagcagaaa

SEQ ID NO: 45211 - DNA, 411 bp, Zea mays
  Clone ID: LIB3066-012-Q1-K1-B10
cccacgcgtccggattatccatagagacttgaagtgtgataatatttttgttaatggggaccatggagaagttgagagtggagatcttggactagctacagtaatgcaaacacctagggtgaggagtgttattggtaccccagaattcatggcacctgaactttatgatgaaaattatgatgagcgtgttgatatttactcatttggaatgtgtttgttggagatctttactcttgaatatccatacagtgaatgtacgaatccagctcagatttttaagaaagtatccacaggtgttaaacctgctgcattggctagaatttctgatcttcaagtaaagcagtttattgagaaatgtttagttcctgcttctgagaggtcgtctgccaaagaacttgtgcaagacacatt

SEQ ID NO: 45212 - DNA, 125 bp, Zea mays
  Clone ID: LIB3066-012-Q1-K1-B11
gtccttccaaattccgggtgcgacccacgctccggctatcaccggtaccttccttttccgctgctcgctatgtcgtcctgtctcttactactcgcggactgaccaactcctagttcactgcctac

SEQ ID NO: 45213 - DNA, 415 bp, Zea mays
  Clone ID: LIB3066-012-Q1-K1-B12
cccacgcgtccggtattctctgactgttgctatacaaaggacctgacaattctggggatcgacttgacaaaaggtggaatagttgacaatactccacaggttttccagttgcaagtggataacggcataccgattaagagctggtttgatgacccctcatatcaggaactgatcgagttgctcccgttcttggagagcctcgtggattcagaggacgtgaggccaataatttcaaagacctttcatgacaaacttgagcagaattagtttgaggcgacagatgtatcatccagtgaacctgtcgctgaagttagcttcgctccacatggtgcaggccatcattcttgggaagttagatataggatgaaaaatcacaatttctgttatgttagctgttacaaatagcaagcataaa

SEQ ID NO: 45214 - DNA, 410 bp, Zea mays
  Clone ID: LIB3066-012-Q1-K1-B2
gactcgagctcggaagttcgcatcgaagactgctacatcgaaagcggagacaacctggtggccatcaagagtggctgggaccagtactggatctcatttggcaagccgagcacgaacatcgtcatccagagggtttcgggcacgactacgacttgctcgggcgtaggctacggcagcgagatgtcaggaggcatatctaacgtgctcgtccgtgacctccacgtgtggaattcggcgcaggccgtgaggctcatgaccgacgtacggaggggtggctacatcaccaacatcaccatagccagtgtggccatggacaaagttaaggtgcctatgaagttcatgcgaggcacagatgaccattctgacgacaggtatgacccggccgagctgccgatgatcagcaacgtgct

SEQ ID NO: 45215 - DNA, 410 bp, Zea mays
  Clone ID: LIB3066-012-Q1-K1-B5
ggttgtagccatcatcgcgtgctcgtcggatagtagagagaaaattgagatcgcgggcagttgattgaggtcgcaatcgcaccttcgcctaagccaactcaatgcttctgaagatcgtaggcgcgcgccgcacctggctgtatcctcgtgtggcgaagactgtggctgggcgctgagaacagagatgtcgcgctggatgctcatcggggcttggtgacggaccgtcgtggtcgccctgggggtggaccctagctgcgcgtggaggccggtgccaaactctccccctctgtgactactagaaggccatctccttccgcgccgccgttttgcatacaccgatgaagaacctcgtggtgtcatcgtggggtggcgcggcgacttctgggaattgcctcggcgaagattgggcg

SEQ ID NO: 45216 - DNA, 361 bp, Zea mays
  Clone ID: LIB3066-012-Q1-K1-B7
tcccactcctcctaatacaataaatattaaaacaacaccaaacaaaaacataaaaaattggcaaattaaaaaaataagactgaaatctaaaatattaaaacctctaactaactactccacaaatccatttcgagaactacatcactatctccctcactgacaaccactgcccctccatgcacacaccaccacatctcgccctcgccatctactccacactttctgacatcaccatcaccataatcatgctcaccaacgctcgttccacctttagctcaatttctctcacttcgcgtccactacttccttgacgacaactccttcgttcttcaatccctagttccaccagatcctaaccttc

SEQ ID NO: 45217 - DNA, 409 bp, Zea mays
  Clone ID: LIB3066-012-Q1-K1-B8
cccacgcgtccggccgaccaaacatatggccaaaggatcatcttcctgagcttgaggtagcattcaaaggtcttggaaaactgatgttggaagttggcttgatgttggctcgtcattgtgatcgctatgtaatacagcgaggggtgggacaatacattggtgaaagccttgagaagacacttgctagctcaaggtgtcccaagggtcgtctgctgtactacttccccaaatcgtttagcaaacaggacgaagtttcgtcatggtgtggatggcatactgactatggatttttgacaggacttacatgtggtttgttcacgagaaaatcagaggaggtcccctgtcctgatattggaactgggctgtatgttcggactcgtgataatcaagtcgtcaaggtcacacttgt

SEQ ID NO: 45218 - DNA, 418 bp, Zea mays
  Clone ID: LIB3066-012-Q1-K1-A12
cggacgcgtgggcggacgcgtgggtctcaccatctggttcatctggtccaatgcttgatcatttgtcaacaggtgagctccaaagttcccagaggtcattctatctgaagtccagtgcatgaaggtagctcatgttgcaaggaaagaaatcaacgaggctttctatacattgcgcaatgttgcttctggaaaagatttgaaaacatatctgatgacagttacagtgctgtggttcatttccataattggaagctgcttcagtttcttgactctgtcttacactattttcctgatggcatacactctgcccatgttgtatgagaaatacgaagatcaagttgatgtcgtaggcgagaaggccctcattgagataaaaaagcagtacaaagtgattgatgcaaagtttatctctaagatc

SEQ ID NO: 45219 - DNA, 395 bp, Zea mays
  Clone ID: LIB3066-011-Q1-K1-G8
atggattaacagtaaaacaaacaagcccttaatgagtctagttgatataaaatggattaagtgacatggaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaactcaaaaaaaaaaaaaggggatctattttaaaattaccaaaattaaagttcactaattttaaagaataaatctatttaaaatattcacaaaatctaaattatatggccgctaataaaaacgtataatttggaaaaaccatcatttatcaagattaaatcctcagtgaataaattcattctatggcattagatacatttactaaaagacctat

SEQ ID NO: 45220 - DNA, 376 bp, Zea mays
  Clone ID: LIB3066-011-Q1-K1-H1
cggacgcgtggggtttacctgaagcacaagaataaacgcagccgggcatgggcgaagctgagctgaacaacgtgaccgtcctgctggtggccctcctcctcctgagcagtggcgttcaggacgctgccgccatgccaggcacgttgaactacgacgcgattgtcgccgacgagccaaacggaaagaacaaggacctgtaccgtcccgtcgccaacgccaataaatacacccgcgggtgcgagcccatagaacgctgcaggggcgcgcgctgatcaccaagcatatacatatagcacatcgatttcttattattgcatgcacgtttatataaaaaaaaaaactaaatacataaaaaaatactatgaaaacaaataca

SEQ ID NO: 45221 - DNA, 273 bp, Zea mays
  Clone ID: LIB3066-011-Q1-K1-H10
cacacgcgtacgcactcctattctctcatcactaagctcaaactgattaccctcagtgccattactggctcaagctcaaacccttctttaacaataccaacttctatgtctcatacgttgacctagcttaattctaaatatattatacttaccccatctacatacaagaattctcaacaccacgacaagccagtattagacctcatatcatcctataacttcctcatatacaatgaactttactggcttcccatctgatacactaaacatgaa

SEQ ID NO: 45222 - DNA, 326 bp, Zea mays
  Clone ID: LIB3066-011-Q1-K1-H12
ctcactccttctctctcttcaattacctgctcaataaactgcaacgatgtcgaaccgtgtctcagaccgtttctacgagctttcatacattgatacatacattgctataccctatttaggacaacaacgtattcttatgcatatctccatgctgatcttactactccttatccatgaacggaccattacatagactcttgcccataatccttcacataatcctccaaaaaatcagaagcatcacctttagcatcaaatttatcttcaaaatcatcctcaaaatcaaactgtgcatcaaattcataatccaattcatcatccaaatc

SEQ ID NO: 45223 - DNA, 429 bp, Zea mays
  Clone ID: LIB3066-011-Q1-K1-H2
gtgaagggagagatagtcctcgcacaatttagcgttgacaactcctggaacagagctatgattggtaatggacctcgttctggtgaatctccggacgacaagtttgaagtattctatattgactatggcaaccaagaggtggttacctacagtcgtttacgacctgtagacccatctgtttcctcgtctcctgctcttgctcagctatgcagccttgctttcataaaagtgcccagtcttgaggatgactttggtcaggaagcagcagagtatctaagtgaatgtttgctcagtagctcaaagcaataccgggcaatgatcgaagaacatgatacttctggggggaaatcaaaaggacaaggaaccggaaatgttctcattgttactcttgttgatgcggagacagaaagtagcataaacactaccatg

SEQ ID NO: 45224 - DNA, 385 bp, Zea mays
  Clone ID: LIB3066-011-Q1-K1-H3
ataccttcactcgtgagatagacctcgcacactttatcgttcacaactcctcatacatacctatgggcggaattcaccaccatctggtgaatctccttactactattctgaactattctatattgactatcccaaccaccaagctcttacctacattcagctactaaccttatacccatctacattctaatctcctgctctttctcacctatgcaccacttgctttcataatcatgccctatctagactatgactctcatcactactcacctcaatatctaaatcactgtcttatcagtaactcatatcattaccgggcaatcatctaagaacatgatacttacgattggaaatcataacgtcaatgaaccgtaaatgttctcat

SEQ ID NO: 45225 - DNA, 399 bp, Zea mays
  Clone ID: LIB3066-011-Q1-K1-H4
tccactcgtgcgataaccctttcacagactctttttcacaacccttgctacacacctatcgttggtaacttaccttgctctgtccaatcttcttaccactaactatcaatattctatatttactattgcaaccaacacgtggttacctacacatcttctactacctatcaacccatttgtttcctattctcctgctcttgctcacctatgcagccctactttcatacaacttaccattctttatgattactttgttcaagaaccattacactatctaaatcaatgtttgctcaatcacttaaatcaataccatgcaatgatcgaacaacatcatacttgtagatcgaaattaaaacgacatggaacctgaaatcttcataatcgatctctattttatac

SEQ ID NO: 45226 - DNA, 252 bp, Zea mays
  Clone ID: LIB3066-011-Q1-K1-H5
gcgattcgaaattattcgaaataaatcgctcatgaatccctgaagcctgcatatatgtgtggctcccaagattcaggcggatgagtcgccacccacgattcagccacgcggtaatcttcttttccttctcactgtgctcacctatatggaacacgcaaggcaatgcgacaagtacagtgaacaatttcctggctcattcattatcccataccactgggaccatttttaccccggcaaagacttttttgccca

SEQ ID NO: 45227 - DNA, 456 bp, Zea mays
  Clone ID: LIB3066-011-Q1-K1-H7
gttctagatcgcgagctgcatcggtcggcgccctgtgagggagaaggatgcatatgatgcggcggctcaagagcatcgcctccggccgctcgtccgtctccgatccgggtggtgactctggctccaaaaggccaaaatttgagcaggatggagcaggggatattgttattgagccacacttaactgaggccaagcctgtccggatagaccaagaatcatcatcatcatctaatagggaggctgaggcaagcacatctactagcatgaagcctgttaaaactgaagaaccagtagcagatcttcttcccaaagaattgaatgatatgacaattagtgacgataaagctgatgaccataatgataaggaaggtgaaggtgttactcttgatgggaatggagccgagacaggacagataattgtgacaacaataggaggtcataatgggaagccaaagc

SEQ ID NO: 45228 - DNA, 446 bp, Zea mays
  unsure at all n locations
  Clone ID: LIB3066-011-Q1-K1-H8
acgcgagaaacggacaagggagttccgtgctggctgacgggacgcccttggacgctgcggctggatgatccagagctctgttcccggtcgatcgagtcgagtgcgttcagttttggacgggacgcgggggttggtggcatgtgcggctcctgatcagagatctcggcaggcatgcagcagcagctgaaggccgcaggtgcaccacgtccccccggctcagcatccgcggtggcgcctccgccggaggcccgctccccaggtccaaatcttgtcgggtccgagcagctgcctgttggccatgcacagcgcgacccggcgcatggcagcagatcgtgcctgccgcgacctgcgatgtgcacgcgccatgatcgatctggattctcgagtggaagccgtnccacgtgagcgggcggctcccttacgaaaaagatgaactatgggggtct

SEQ ID NO: 45229 - DNA, 411 bp, Zea mays
  Clone ID: LIB3066-011-Q1-K1-H9
ctgatgggaatggcagcgaaggagcactttgtgcttgttcatggtgaagggcatggagcctggtgctggttcaagctccgctggctccttgagggtgctggctaccatgttacatgcattgacctagccggaggcggcgtcgatcctactgaccccaacacaatccggtcgttccagcagtacgacaagccactcatagacctcatttcaaccttgccggagggggagaaggtgattctaatcggacatggtgctggagggctgagtgtgattcatgcaatgcacgaatttgttgacagaatcagccaagcattttttgtggcagctacaatgctaccatttggatttcaagctgatgaagataagaaagatgggttaccaactttgcctgagaacgagattgagttgaca

SEQ ID NO: 45230 - DNA, 276 bp, Zea mays
  Clone ID: LIB3066-012-Q1-K1-A1
cacaaaatattgggagcatatggttcggatgcatgatattaataagaggtgtccacatatgagccactgaaaatgcggtccaagcaaacaactcaagttgagacgcgaggacacacacacactcatctacgatcaagataatattatgaccggaggtagtcattttttggactcctgaaaaaattcgaggatccaagtccgcagaactaatgacatcaataggtgaggtaaattcatgagtgccgacactaacaaagtctccgggcatcaactact

SEQ ID NO: 45231 - DNA, 418 bp, Zea mays
  Clone ID: LIB3066-012-Q1-K1-A10
ccttcaccttcaccttccgaaaagagagaccgaggaggatcacaggaggacatccgggtaagcaggaatagaacaaccccataaaccatatcggaccatacatttgcaaaagcttgtcggttttctagcctccaatcgtccctcaactcaagcctgatgaaagaagaggaggtgaatccttaagagcaagcagactttgctgactgaacaagacatgtgacttggcaagaaagcatggtccttaaccatctgcagcttctggctgcgcctcacatcaagtaactcagctgcaagcggcaccttctggacatacctgacatcattaggaaaaatattggcattagcacgactccaaccaggttgtctgccatagttttgctggagggacaaaaacagaagcgttcctgactctacctca

SEQ ID NO: 45232 - DNA, 412 bp, Zea mays
  Clone ID: LIB3066-012-Q1-K1-A11
gatgatctgatccgcctccagttggaaacactactagctgagaaagcacggctggggcatgagaactcagtatatgcacgagaaaacagattcctgcgggaaatagttgagtatcaccagctcactatgcaggatgtcatatatgtagacgaaggcatcgaagaggtcaccgaggtgtaccctacacaagtactacctcgcactgggtcgagcgtcagtcgtgcagccactgcagctacaccgaaatctgctccgacgtcaacataatcttgccctgtcgtacaagcttctacaaatacactttttcgcggtcatctctgagcaatagatcaaagcgcccacctccaaccttcacggaagagtaaggtggttgtttggttgtgacgggaccacataggttatgctgctactg

SEQ ID NO: 45233 - DNA, 461 bp, Zea mays
  Clone ID: LIB3066-011-Q1-K1-G7
agaagatttgcttgagcatatccaattaccaccctgagcactggcagccttcatggagtggggagtaggggtggtaatggatcaagatccaaatgttttttcacaatacgttagggcccttaattaattttagttcaaaaatgaatagtaatagagctccaccctaatccgatttgatccttaaaatttatagtgtaaaatctagagcccattaccacccctattggtgagtaatctttagtcatttgtttataaggctattctcaatggggagtttatgttgtttctaagactgccgcatcatgtaaaaaataaaacatggataaagcatccatcctcactgcatagtttcattctatggtttcaaatacatttacttcacgacttataagagttgtaattgtgcccagagagttctctcttaaaaatgttgccacatcattaaaaacgcttatgtggca

SEQ ID NO: 45234 - DNA, 460 bp, Zea mays
  unsure at all n locations
  Clone ID: LIB3066-011-Q1-K1-F1
aattgcgccactgctcgttatcctcctcttgcattgcattgcaggtcgtagttgagcaggggggaccactgcacaggatgtggtggcagacgtacgtcgatgagcacctcatgtgcgagatcgagggccaccacctgagctctgccgccatagtcggccacgacggcgccgtttgggcccagagcaccgcattcccacaggtgataccaatttgcatgatccttgttcgttctagctcttgcatgccgatcagatcaatcacgcggtttccttgtgcgcatatgcatccagttcaagccagaggagatgaccaacatcattaaggacttcgacgagcctgtgtttctggccccgatcgggctcttccttggccccaccaagtacatggtcatncaaggcgagcccggcgctgtcatgcgcgggaagaaagtactgatgatcccgcgtcgtctatgctcat

SEQ ID NO: 45235 - DNA, 410 bp, Zea mays
  Clone ID: LIB3066-011-Q1-K1-F11
cccacgcgtccgcggacgcgtgggctcgtgcgggcagtgccacgagaccggcctccggcgggagggcgccggctcgtgctccttctccacgccgttggcgtcgcggagcagggacgtgagctttgacacgcgtggccccatcgcgtggaggggtgggggcgaggacgaggcgacctgctgctcgcccacgttcgccgccgtctgcaggtcgtcgttctcggcgttcatcaccgacccggccccgccgccctgctcggcctcctccgccttgggtggctctggcttctcgttcggtgagccctgcgaaccacttgacggaggaggaggaggagggttcccgatgcccatggcttccatgccgagcttctcgttcttctgcgcgcgggacagcagcgagccagctgagccac

SEQ ID NO: 45236 - DNA, 413 bp, Zea mays
  Clone ID: LIB3066-011-Q1-K1-F12
cttttggagatgaaggataaccattatgatgctagaacatttgccgttaggttgaaggctacgatggaaaccatggataaggaggtaaagaggtcaaggttggcagaacagctgtataaacattatgctgcaacagctattcccaaaggaatccattgtttgtctctgcgccttacggatgaatactcctcaaatgctcatgcacggaaacagttaccgccaccagaactgttacctttgctttctgataattccctccaacattatattctagccagtgataatattcttgctgcttcagttgttgtcagctcaactgtacgatcttcctcactgcctgagaaagtagtctttcatgttattaccgataagaaaacatatcctgggatgcattcatggtttgctcttaattc

SEQ ID NO: 45237 - DNA, 360 bp, Zea mays
  Clone ID: LIB3066-011-Q1-K1-F2
cccacgcgtcctaacacctgcaatgggagagataccatgtttgttttgccgcctctgtctgctgactagtacattcaaagggcttatgaactcttatgtctcatcttgaggattcaactttctaagtatcccccatcaactctcttatcttctgtgtacggcacctcctgtttattcaagttattcatgaatggttatctcggcctttgggtatgttcatacaatagccacctttgaaatggctgcaggttttcacgcattgatccagtacactgatgcagatactgcctcagctgctagagaagcctgagattgatagagcatcctaagttacttgcttgcataacacgtttcatcctg

SEQ ID NO: 45238 - DNA, 429 bp, Zea mays
  Clone ID: LIB3066-011-Q1-K1-F3
cagcggctggaggctgctgccggggtcgccctccaaggcgaccagctgacccctttcggccggagcctcttcatgggcgcagctggcggccgcgagcatggcagtggcgctgggcgactacttcctcggccccagcctcgacgctctggtgcagcagctcgctgagaacgacgcgggacggcacgggacgccgccggccaagaaggaggccgtggaggcaatgccgaccgtggaaattgccggtggcaacgatgacgacacggacagctgccccgtctgcctggaggactacacggccggcgagcgcgctcgggagatgccctgcaagcacaggttccactccaattgcatcgttccgtggctcgagatgcacagctcctgccctgtctgccggttccagctgccgggcaccgacgacaagggctcatg

SEQ ID NO: 45239 - DNA, 405 bp, Zea mays
  Clone ID: LIB3066-011-Q1-K1-F9
tcggggattcctgctccgcgagtggcgccgacaaaatgctattcaccttgaggaaaaaggagaagaaggagaaggagctgaggagccaaatcatcgttgatgctgaagagtttaagaaagcttttgttgagaagagaaagctcaatgctgagacaagcaagggccaaaaccgtgacagggagaagcttttcctagcaaaccaggaaaagttccatgctggtgcggataagcaatactggaaggcgatatctgaacttatcccacatgagattgctaacatcgagaagagaggggcaaggaaagacaaggagaagaagcctgggatcgtggtgattcatggaccgaagcctgggaagccaacggacatggcacggatgctgcagatattgctgaagctgaagcaca

SEQ ID NO: 45240 - DNA, 414 bp, Zea mays
  Clone ID: LIB3066-011-Q1-K1-G1
atggcgaggagggcgactgtgatggtgctcgcggcggcgctcgcggtcctcctgctggcggcggcgtcttcgaagacggcccccgtggccagcgccgcccgggacgacccctcggcagcggcggctgcggccgtcacttcttctcgtgacctgcagaaggatggatcggcggctgcagcggaagggaaggggaaggagaaggagtgcgagggcgccaacgacgaggactagtgcatgatgaggcgcacgctggccgctcacaccgactacatctacacccagcagcaccacggctgatccaatagaatccgtcctacgttacatgcgttgctctcgtacgtgtgttcgtgtccgtgcgtgctcgtgtcgcgtactcgtgtgtgtgtgtgtgtgtgtcgtgtgaaacgccagcgc

SEQ ID NO: 45241 - DNA, 377 bp, Zea mays
  unsure at all n locations
  Clone ID: LIB3066-011-Q1-K1-G11
cccacgcgtccgcggacgcgtgggtccgaagctgaatggtagttcacgctgagcaacggcgattggcccgtgtggactcacttgtacatgaaactgtagtgccagccaaccagaataaatgtaaatctagtcggccggccttccaaagagaagttctttaggcctaggaaagaaatgtaatcctgttcttaagcttagcctccattaggggtccttcaatatccgattagccaatgaaattggtcttaggaccatggttttagtaaaccagttaatcaaatctatattcctggagttgcgtggcttaaaatnaaccttgatatatattcagcttcacaaaaggtggcagtatatacaaattttcttgtgaaattgta

SEQ ID NO: 45242 - DNA, 414 bp, Zea mays
  Clone ID: LIB3066-011-Q1-K1-G12
cggacgcgtggggcagcatttaagctgcctcaacactgaagccttcgggaccgccaggtctattaagtgcagccatgggtgcctgtgcaacgaagcctaagacgcttgaggggaaagccccagctgaggccaccatctccacacccaaggttgcacctgagaccactgccatccacattgaggttgcggcgaaacaggcagtagttgagaaggtggaggaggacaaggaggaggcactaacagtggcggcgaaacaagagccagcagccaccatcgagcctcaacagattgctggtgaggtgaccacttcggaagtggcggtcgtcgttgtcgagcctgagaacaaagaggaggaggaagttgtggagaagaccgtcatcgagaaggagaagccatcagcagtccatgaagagg

SEQ ID NO: 45243 - DNA, 165 bp, Zea mays
  Clone ID: LIB3066-011-Q1-K1-G2
gtgacccgggcgcaatgccgggagccgtgatcgtgcaccaccacacgaggtacaagacgtggcgcggcgaggtcaccggcatcgccatcttctcgtgcttcatcgcctccgtcgccggctgcatcttcggctatgacatcggcctcacatccgggctgacgtcga

SEQ ID NO: 45244 - DNA, 386 bp, Zea mays
  Clone ID: LIB3066-011-Q1-K1-G3
cccacgcgtccgcggacgcgtgagtgggccttcatttctcctagaaagtcgagaggagaagaaggcgagacgtgcagtccgtcgggctccgatcgagaacagggaagcaagaggctgctagatcgagctcatcaaccaaccaagtcgtacgtcgtcagcatcacgaccggatggcgcgtgccacgtccagctatgtatccaggagggggctctccacagcgatgacggtggccgaggagtccgtgaagaacgtggaggacaaggcggtgaagctgggaactgtggccaatgacatcgccagcgctatggccaccacgacggacgagaagacggcgttctgggaaccttaccccgagaccggatactaccgtccggtcaccggcacg

SEQ ID NO: 45245 - DNA, 408 bp, Zea mays
  Clone ID: LIB3066-011-Q1-K1-G5
cggacgcgtgggcggacgcgtgggacagaagttcatttcttctggtgcttctacttctaggttttatggtgagaacatccaacaattgtgtcctggttgccatgtggaagtactctctcaagatagtggtataaggggatgttggtttagatgtttgattctgaagaggcataaagataaaatcaaggtgcgctacctagaacttcaggatgctgatgagactggaaacttggaggagtgggttatgctaacacgagttgccaaacctgatcaactgggtgtacgtttccttggaaggccaatggttcgtccacagcgcgtggaacaaagcaaggcctcatgctttgatgttggagccattgttgatgcgtggtggcatggtggctggtgggagggaatcgtgctgta

SEQ ID NO: 45246 - DNA, 456 bp, Zea mays
  Clone ID: LIB3066-011-Q1-K1-G6
cagaagcggtctctcaagctaggtcgacgtagagctggaatgtgggctccacaattgttggggtggtaatgatatcggattgcttggagctgtaatgcattttgtatgtttaattattgcttagccatcatttgaacttttctcactgttttcatacgcagctagacttaaatacattggcctctaccttcttaacattttcaatttgattttgacagaactgtcggcactcattccacacctgttatctcattcgcaatgcaagggttcaccttcttattaatgtgtcttcttgccttcatcttttctgtaagtttaattgactatatgattggaaatgggcagcatcccgaagtttttcatttggtacaaaattttaatttggaggacaagtatcctccattttctcttctgaagggatacattcagaaggccaatcatacttttgtggagatg

SEQ ID NO: 45247 - DNA, 360 bp, Zea mays
  unsure at all n locations
  Clone ID: LIB3066-009-Q1-K1-C3
cgatctccattgtggagagcagtggcggcggcggcgacggcagcgcggggagcgacggggcggcatcgtccatgttccagaggttctgggactccgccatggccttgggccccctggacgacgagacggacacccagtcccagatgagcgaggcgtcgaggtcgcagatgatgatgtccgatgtccaccaccaccaccaccaccacgactccgcgggcggcggcagcgaagcggggttctcgctgtcgtccttctccttcaagctccaggacaagcgagggcggatgcaccgcttcagctgtgaggttcagagcttgacgcctctggtgacctgcatnctgcggaagctcggcgccgaca

SEQ ID NO: 45248 - DNA, 400 bp, Zea mays
  Clone ID: LIB3066-009-Q1-K1-C4
gaagagcatacgatggcgtgcacgaacaatgccacgagcgcatcgatgctagtgatggtgggattagtccttcgttgggagaaggataagtcgaaggtcttgtctgcgaacgcttacgcgactggtactgactccaacgttatcaacttgagcccctccaaccacagcttctaaaacagcaagaaaggttacaactaagcattgccataagcatgggcctgggcctgtcaaccaaactatcatcatacccaagggagactcatttgccgaacaacttaattccaaaggcccttgaaagggcaacgggacgttcaagttgaatgtcaatttgcaagtcaacacggacttaagccagtacacaacccatggtaatggcatcgctattttactcacgaataac

SEQ ID NO: 45249 - DNA, 416 bp, Zea mays
  Clone ID: LIB3066-009-Q1-K1-C6
gacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggctgctacggcggtggcaaccgtggcggcggctacggcaactccgacgggaactggaggaactg

SEQ ID NO: 45250 - DNA, 423 bp, Zea mays
  Clone ID: LIB3066-009-Q1-K1-C7
cccacgcgtccgcagaatagtaggagttggatgcgcatgcacttcacgacaaatgaggggcaaacaaatttcaaaaagttcatacaaactacatttggtggcactactagaggagaaactgcaccatgtccatgttcaagatgtcgatgcatgtcctacaaaacacaatctcaggttcagagtcacttggttattagagggtttgatgagagcttcatcgaagaaggaaaccaagcaaacgattcagatgagggcaatgctgcaacagttgtcaatgatgatgaaacaggtgacagtggttctgtgaccgaactagtttcaacgctaatcagtggtgctatacatgaagacatcataggaaatattaatgaagagccaaatgcataagcaaaggcattctttaatctattaacagaggcaaag

SEQ ID NO: 45251 - DNA, 411 bp, Zea mays
  Clone ID: LIB3066-009-Q1-K1-C8
cccacgcgtccgcccacgcgtccgcccacgcgtccgcccacgcgtccgcacatatgtgcagatggaactacaatactctccaagaggtacagcttcatgtatcagcatttaggaccttcttggacatagctggtgacaacttaagtggcaagatttttactgaggcatttgatgcggactgcttcccccttacactcttctcaagtttatttgaacctggatggtcttctgggagttcagcagtctccattaagggccttttatcattgctggtggaaggaggcgctgacaatgtaaatcagtgttttcttgaagcagcgcgctttggaagtactgaacttgtacgcattctgctgaaggtcgcatatcaaaatagcttggctgtggacaccgatctggctctggtgtatg

SEQ ID NO: 45252 - DNA, 421 bp, Zea mays
  Clone ID: LIB3066-009-Q1-K1-C9
aatatcctcttgtttgaagatgataggaatcgggcggattccctgatcgatctcagggtgtggtggtgggtgattggtggccagggtttgaggcgcgatgcacaacggcggggcgccgtgttcaccgcgcgcaagaggagagacgcgaggaaaggggcggctaggtcacagtaatcttccggctctctctggaaagccgaaacaatcttgtttctgcttaatccctatagagtggtgcttacaattatttatactcccttctagttcttatctaatgagataaatcccctattttctctctaacaaattttatctccttaatcttctaatccttatcatcttctaatccttatctgcatgcctatgctgttgcccggcgcctatagtggcggtcgatcataacagaagactttaaggcaaa

SEQ ID NO: 45253 - DNA, 423 bp, Zea mays
  Clone ID: LIB3066-009-Q1-K1-D10
aggaaggccaccacgatcgtggaggagtacttctccacggacgacgtcgccgcgacggcgagcgagctgcgggagctccgcgtcccgtgctaccacttctacttcgtcaagaagctggtctccgtggcaatggaccgccacgacagggagaaggagaaggcggcggtgctgctgtcctcgctctacggcgacgtcgtcgaccgcccgcagctctgcaaggccttctgcaagctcaccgagtcctgcgacgacctgtccgtcgacacgcccgacgccgtcgacatcctcgccgtgttcgtcgcccgcgccgtcgtcgacgacatgctgccgccggcgttcctggccacgcagagcgcgcgcctgccccacgggtgcaagggcgccaaggtcctccgcagggcggagaagagctacctgtccgtg

SEQ ID NO: 45254 - DNA, 428 bp, Zea mays
  Clone ID: LIB3066-009-Q1-K1-D11
cccacgcgtacgcccacgcgtccggctacatggtctccaagaagaagtacatctacggcatggacgacgactgcttcgttgccaaggacccatcaggcaaggatatcaatgcccttgagcagcacatcaagaacctcctcagcccgtccacaccgttcttcttcaacaccctgtacgacccctaccgtgagggtgctgactttgtgcgtggataccccttcagcctcagggagggtgcccacactgctgtctcccacggcctgtggctgaacatccctgactatgatgcacccacccagctggtcaagcctaaggagaggaacgaaaggtacgttgatgctgtcatgacaatcctcaagggaaccttgttccccatgtgcggcatgaaccttgccttcgacagggatctcattggccctgccatgtac

SEQ ID NO: 45255 - DNA, 425 bp, Zea mays
  Clone ID: LIB3066-009-Q1-K1-D12
cgcttcaacgacggcgtgcacagggcgacggcgacgcggtcgcggtccctggcgcagagggcgcggggcccctgcacggcgaccaaccccatcgaccagtgctggcggtgccgccgcgactgggcccgcgaccgcaagcgcctggccaggtgcgccatgggcttcggccacaggaccaccggcgggctggccggcaagttctacgtggtgattgaccccagcgacgacgccgccgacctcgtcacccccaggaagggcacgctccggcacgccgtgacccgggcccgggcgctgtggatcaccttcgcgcgcgacatggtgatcgagctctgccaggagctcatcgtgagcagcgacaagaccatcgacgggcgcggagcgcatgtgcacatcgtgggcgcgcagatcacgctgcagaacgtgcg

SEQ ID NO: 45256 - DNA, 395 bp, Zea mays
  Clone ID: LIB3066-009-Q1-K1-D2
ctaattccctcctcgagccacgcatgcgtcctaacagctaatgcttcactactagcacctccagttcctgcactcgatcccacatggggcaaatttcctactatgctatacaatatcccatctgtacctatcaccatctaggaccatctcgcacacacctgctgaccccttaaatagctagatttttactgacccatttgatacggccaccatgctccttacactcttctcaacttatatgaacctcgatagtcttctctaagttcaccaatctccattaaggaccatttatcattgctgttggaaccaagcactcacaatgtacatcagtgttttctttaaccatcgcgctttgcaagtactcaacttgtacacattcttctaaaacgtccata

SEQ ID NO: 45257 - DNA, 424 bp, Zea mays
  Clone ID: LIB3066-009-Q1-K1-D3
accttgtactgaggtgtccatattgcaagacgctgaattacgcagtggagtaccgcggcgggaagaccatggaggagaagggcgtagagcagcttgaggagcagagggtcatcgaggcgcagatcaggatgcggcggcaggagctacaggacgatgcagagcggatgaagaacaagcaggctgcgacgtagtagcatctgcacaagttgattcttgcagtactgacggtgcatcaacagtagctgcaagcagtccgcgaggcaacgatgctctctcgtccgaagtgcagcgttcggagttgatgttgaggaattctgaagccttcaaacagaggaggggcaataattttgatgtggatcttgaagaagtaatgcttatggaggcaatttggctctctgtacaagatcaggaagctttgggaaat

SEQ ID NO: 45258 - DNA, 416 bp, Zea mays
  Clone ID: LIB3066-009-Q1-K1-D4
ctgacgtccagaggctaccgtgccctggtatacagcggcgaccatgacctgctgggggcggatctgggcacccaggcctgggtcaggtcgctcaacttccgcgtcgtggacgactggatggcgtggcatctcggtggccagtcagctggatttacgatgactgactcaaacaacatgacattcgcgactatcaagggcgcctggcatacaggacctgagtacgagccggagaggtgtttcgccatgttcagccgctggatcctcaaccggtcactctaatccatatgtacgtggatccatcagtgaatgaagagattcgtgtgtaaatctttcttcacgaaactactggctatgagacgtacgtggatggaataaaatgctggctatgaacccttgacgctgatgatatatatata

SEQ ID NO: 45259 - DNA, 265 bp, Zea mays
  Clone ID: LIB3066-009-Q1-K1-D5
cccacgcgtccgtttttaatgggaagcatacttttccattcaagtgaaataagtgagggtaaacttagtacgattacatcatgtctaacttatggaacagagataacagggatactttcttttgctcaaacacgggaaataccttctaagcgagttacctaatcgccgcgacttcgtcagtcacacacacacacacacaccagataatcacaatgcaagaacgaggaaaatgaaacaaacatatcgctcaatgccttgacaaata

SEQ ID NO: 45260 - DNA, 392 bp, Zea mays
  Clone ID: LIB3066-009-Q1-K1-D6
cccacgcgtccgaacacactgaacccaataatccgatcccacagaaacttttcgctggtccgttcgatcgatcgctgccgtgtcgtttgccagacaccatcatcacccaaaaccatggcctgcaacctgtctcagtgcgccaccgccgccgcggcaaccgtcgcgccccgcacccctcgccctgctgcgtccgcgtccgtctccttctccgcgaggaagccggcgggctgcagcctgcggctgcagcggcaggcgtgctgcaagccgtctgtggcgccgtcgcgggcagtgttcgcctgccgggccgctgcgtctcagagcgcggccgacctgtcctccggtggcaagaagtcttacggcgtgccagtgatcgtcatgatgccgtttgacac

SEQ ID NO: 45261 - DNA, 418 bp, Zea mays
  Clone ID: LIB3066-009-Q1-K1-C2
cccacgcgtccggaggccttcagcctcttcgacaaggacggcgactgttgcatcacggccagggagctcggaactgtcatgcgatcactgggtcagaacccaaccgaggctgagctccaggacatgatcaacgaggtcgatgcggaccgtaacggcaccatcgacttaccggagctccttaaactaatggcccgcacgatgaaggacaccgactccgaggaggagctcaacgaggcgttcacggtgttccacaaggaccagaactgcttcatctctgctgcagacctacgtcacgtgatgaccaacctatgcgagaagctgaccgtcgacgaagtctatgagatgatccgcgaggccaacgtccatggctatagccacatcaactacgaggagttcgtcaaggtcatgatggccaact

SEQ ID NO: 45262 - DNA, 416 bp, Zea mays
  Clone ID: LIB3066-009-Q1-K1-A6
cgcacgcgtccggcagattgtaatgaatatgtgccgtgcacgtcagcctagtttgaaggttggcgtgcctcaaattttgtaaagccaatgtgcttctccgttgtatttctactcgtcctattttcccatggaaaactcacgggaaactttatctagcttagctctagtttggaaactcaaatcccttcgtggatggaaggggtttgagggacaaattagtttattttcatcttaatcccttctaatccccgggtgatttgagtttacaaactagcctttagagtaaagatttaccacattggcaatgaaagatgatggcctgtgaactaggtgaagatttactgcattggtggtgataagtgatagcctgaccctgatgagtatagtaattcgacgatgtaatgtgcataagtaac

SEQ ID NO: 45263 - DNA, 332 bp, Zea mays
  Clone ID: LIB3066-009-Q1-K1-A7
cactcggcctgcggatggcagccttgcccatccgcctgacgccatggcggaagctggcatgagcggcttgcgacggacctcgtttgcgcgcaagcgacaccaataccaaattcaacgtctgcgtcaggcacatgcggcggcggccggcatgcacgcagtgcactatgtgccgactcgcgggtgagggacggcgctgctggcgcggtctctagtggtggcgctagccataccttgcgggggcaggtagatccattctactaacaaacaaaatcataccacacaatttggttgcgtagaggaatcggagcctgtcgcataagacagttcggcta

SEQ ID NO: 45264 - DNA, 198 bp, Zea mays
  Clone ID: LIB3066-009-Q1-K1-A8
tcgcccacacgttcgaaaaaaaaaaataattatataaaaaaaaaaaaaataactaaaaggaagatttatcctatatcgaaaaacctaaaaatccatacaaataacacttatatctacttctaactttatattcatacatatatatcattttttaatatttatttattatattatttaatttactctttaataattttt

SEQ ID NO: 45265 - DNA, 177 bp, Zea mays
  Clone ID: LIB3066-009-Q1-K1-A9
ccgacgcgtccgcggacgcgtggggaataactttactaatcaaattcttattgtgatgtattcctccaaatgctgttctacttccaacaaggcaacaacaatctgatcctgactacaaacaaaacccaaataaaaacacacttaacccaataatccgatcccacagaaacttttctt

SEQ ID NO: 45266 - DNA, 173 bp, Zea mays
  Clone ID: LIB3066-009-Q1-K1-B1
cgcacgcgtacgcatgcaccctaaactccaggctcgaagactgcctgcctgactcggtggggagaggtctatcttccaaagagccccggagcactccctcgacttcagatgtctattctcaaaaccgctctaactaccccagtcagtgagccctttataatgtcgccaaccag

SEQ ID NO: 45267 - DNA, 424 bp, Zea mays
  Clone ID: LIB3066-009-Q1-K1-B10
cgaccagcaggaggtacgagcaagaccacctaggaggcctctctctccctctcccgagccacgcccgtagcgagagggagggcggaagaggatgagcgcgtccaggttcataaagtgcgtcacggtcggggacggcgccgtcggcaagacctgcatgctcatctcctacaccttcaacaccttccccaccgactatgttccgacagtgtttgataacttcagtgccaacgttgtggttgatggtaacactgtcaaccttggcctctgggacactgcaggtcaagaggattacaacagactgagaccactgagctatcgtggagctgatgtttttcttctggctttctcactgatcagtaaggccagctatgagaatgtttcgaagaaatggatacctgaactgaagcattatgcacctggtgtg

SEQ ID NO: 45268 - DNA, 177 bp, Zea mays
  Clone ID: LIB3066-009-Q1-K1-B11
gacatacgtaacttgacccttgagttcgacaatctggactgccaaacgcttgatgcgatcacgtacgcgtgctgtacgatgtagcaagtcatgcgcctgcctcactacaatgaaggacctccctgataaacagcgctcactcctttccggcagtatcatgatctctgatgaggctgc

SEQ ID NO: 45269 - DNA, 426 bp, Zea mays
  Clone ID: LIB3066-009-Q1-K1-B12
cccacgcgtccggctctgcgccggcggggagctcttcgaccgaatcatcgccaaggggaagtacacggagcgcgccgccgcgtccctgctccgcaccatcgtggagatcgtgcacacctgccactccctgggcgtcatccaccgcgacctcaagcccgagaacttcctcctcctcaacaaggacgagaaagcgccgctcaaggccactgacttcggcctgtccgtcttcttcaagcaaggggaggtgttcaaggacatcgtcggcagcgcgtactacatcgcgccggaggtgctcaagaggaactatggccccgaggcggacatctggagcatcggcgtcatcgtctacatcctcctctgcggagttccgcccttctgggccgaatccgaacacggcatcttcaactccatcctgaggggacaggg

SEQ ID NO: 45270 - DNA, 335 bp, Zea mays
  Clone ID: LIB3066-009-Q1-K1-B2
gagacgcttcctgctggacgttaatccacacgatttgactctgagcttacaaatgcgggaggctatatctgacaatgcagccactatgttcctgtttatataccagagaatactgacctgacaagtgtgctcaattgtctaggtaattacctatgcctatctaattcaatttaagccactgttatacctctcacttaacataacactgctttcacacttgactttactggtttaggactatccggccatgattatgacagcttgaattggcatgagaaagaatacctcaaatgtgcattgtcatgtcttccggacaataaacacgtttacactat

SEQ ID NO: 45271 - DNA, 345 bp, Zea mays
  Clone ID: LIB3066-009-Q1-K1-B3
cggacgcgtgggcggacgcgtgggaagcaaagcaagtgtctgctcactcagtcctggtcaagagctcgctctcggagaaaaaaacgcgggaggcgataatggagggaggtgccggtgcgagcgagaaagggaaggtgctggtcacgggggcgtcgggcttcgtcggctcctggctcgtcatgaagctcctccaggccggctacaccgtccgggcgaccgtgcgcgatcccgcgaacgttgggaagacgaagccattgatggaccttcccggagcaacggagcgcctgtccatatggaaagccgacctgtcggaggaaggcagcttccacgacgccatcaggggct

SEQ ID NO: 45272 - DNA, 417 bp, Zea mays
  Clone ID: LIB3066-009-Q1-K1-B4
cccacgcgtccgcaccgtcaccgccatcgctcgcccggatcgtcaacatggcagccggccggcgtgtcctcatcgccgtcctcgccgtcgtctcggtctctctccggcgcgccacggcgactacggcccccaccgtcgtcgacgaggcgtgcaagcagtacaccaagtacccggagctgtgcgtcaagtccctgtcgtccgcggcgccggaggcgaatgcgaatgctgagcggggcgggctggcggggctggccgggctggcgctggcgcaagcggcgcagtgcggtgccgagacggtggcgttcgtcaagggcctggagaaaatgccggggggcatgccgaccgtgtgcctgaacgagtgcgtgtccaagttccagggcgcgctggtcgacctgcatcgggccaaggtggctgtgc

SEQ ID NO: 45273 - DNA, 428 bp, Zea mays
  Clone ID: LIB3066-009-Q1-K1-B5
cattcatcggtcaaagacaaaagatgattgctgtgagcatcatgtggtcattagtgcaggtgcaggtgctggcggcgatggcactagcatttctggtaggcggtgcctggtgtggtcctcccaaggttcccccgggtaagaacatcacagccaactatggtagtgattggctagatgccaaggcaacatggtatggcaagccaacaggtgccggcccggacgacaatggtggcggatgtgggtacaaggacgtgaacaaggcccctttcaacagcatgggcgcatgtggcaacgtccccatcttcaaggatggtctaggttgtggatcctgcttcgagatcaagtgcgacaagccagcggagtgctctggcaagcccgtggtggtgtacattacagacatgaactacgagcccattgcggcgtaccac

SEQ ID NO: 45274 - DNA, 410 bp, Zea mays
  Clone ID: LIB3066-009-Q1-K1-B6
gcgacgcgcaaggcgacgccttcacgtcctcctagatctgctgcttctcatcaagacgggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagttcgggcgcctcggattggctcacttcgccggcgatgatggatggtgcccaactgcgactgcccagtctgctccattcgttgttgtttaaggcataatatctaaactgccaaattcacatgtatcttgggatatttgatatcatactatgaaatgactgtgaatcggtgttc

SEQ ID NO: 45275 - DNA, 403 bp, Zea mays
  Clone ID: LIB3066-009-Q1-K1-B7
cccacgcgtccgccgcgtctttccctctttttccaagcggtcaaagccaaatcaggggcgagcggcggcggtaacgagaacgagacgcgcgcgctagctgaatcaggagcagggcccagggaggagagtggagagccgccggcgagcagcaatgccttactgcgaggtgggcaggtacgcggacggcgacaagtgggagggcgtccgcctcttctaccgccgctacggcagcggcgccaccaaggtgctcctcgtcatcggattggcggggacgcacgactcgtggggcccgcagataaaggggctgaccgggtcgctggagccctccgacgacgaggccctgcggccggacgaggaggccggcgtcggcgcggcggaggccgcgccggcggaagcggacgac

SEQ ID NO: 45276 - DNA, 421 bp, Zea mays
  Clone ID: LIB3066-009-Q1-K1-B8
catgaagtgagattttatggcagaaagcttcattatttggagcaaagaaaatataagggccaaagagcatttaccaaacatattgcgacaagctctaatttgcaaaacacctggatttggaatgtcttcatttgctcatgtttcacttattctagctcctgatagaagtaaactgtctagacgacatggagctacttctgtggggcaggttacttaccgattgtttcctatcttaaaactctaccaacatatcttgttttattcaaggcataagaatgaaccatgatgtatttttcgctgcacaatataaagaaatgggctatcagcctcaggcaatggagatttatttagcactactgggctagggtgatggtactgaaaatgagttcttcactattgatgacctagttttgttcttaat

SEQ ID NO: 45277 - DNA, 265 bp, Zea mays
  Clone ID: LIB3066-009-Q1-K1-C1
tccaacgttcgtccacgcgttcaagagcagtgatccatccatcctatcccccgtgcgaagccctacccagctatgagcatcccgacgacgactcctcctcgcctcatccgacgccataacacctcttcctgttcgcaccccttctcactacgactaccctaccaagcgctcaacctggtcgcaacttctccacactctctcggcgctgctatgaccctgtcttcctgtctgcataacgtgtgcacaaccaccatctgctacgtca

SEQ ID NO: 45278 - DNA, 401 bp, Zea mays
  Clone ID: LIB3066-009-Q1-K1-C10
cccacgcgtccgcccacgcgtccgcggacgcgtgggaggaaggaatctgctgagagggcaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggcgatgcatgcgatggacagtaatctttggaggggggtgc

SEQ ID NO: 45279 - DNA, 407 bp, Zea mays
  Clone ID: LIB3066-009-Q1-K1-C11
cggacgcgtgggtgctatagctatggaaggccctcaaatgtgggctgctggttggcgaaaggctcttgcagaagttggacccaatgttgtctggtggattgctgcacagagcgtgttctaccacttatataaccaggtgtcctacatgtctctcgatcagatttctccattgacattcagcattggcaatacaatgaagcgtatatcagtgattgtttcatcaatcattatcttccacactcctgtccgcgctgtcaatgcactgggagctgccattgccatccttggcacattcctgtactctcaggcaaaggtgtgaggcgggccatgatgactaacgtctgcagaatcagtagcaagcactaaatccaattttgcttgttccagtggcatgtaaatatcgggtt

SEQ ID NO: 45280 - DNA, 445 bp, Zea mays
  unsure at all n locations
  Clone ID: LIB3066-008-Q1-K1-G8
ctgtggtgcccgagagtagcagcaacatgaatcaagacctgcagaacgaggagtcagcggcaacttctgatgtgaaatctgtgctgccaaagttctcacagatcaatttgcttcacaatgacctgggcctgcctgatgatgataagtcagcggggacttctattgcaaattgatctttcatatcaaggcgctccgtttgacccgagttagtgggttatggtgtacatactagttgcacccagaagtagaagtgtggcttggaaggtcaaagcagcggaagcaactgtcccatttccgtttgccggaccagttaactgtttctggtggttatcctgactntgaaatcccctgttcagctccttttgggccgaatagttagggatttctggtggggggtgtcatgagtttttacatctagttcgctctttaagactgagttgtactt

SEQ ID NO: 45281 - DNA, 403 bp, Zea mays
  Clone ID: LIB3066-008-Q1-K1-G9
gccaggatcagctccatcccgcaggatgcgacgccgtttccgtaccggcagggcgtgcggttcagacatccagtacgtcagctactggttcggcgagggcgacggagcggcgccgacgcagtggagcagggacatgtacgcgttcatggagccgtacgtcagcaagaaccctaggcaggcgtacgccaactacagggacctcgaccttggcgtcaacgaggtggtcggcgacgtcttcacctacgacagcggcagggtctggggcgagaagtactacaatggcaacttcgataggctcgccaggaccaaggccaaggtggacccctgcgactacttcaagaacgagcagagcatcccgacattgctcaagtgatcgatgatacccgggcccatacagatcctt

SEQ ID NO: 45282 - DNA, 426 bp, Zea mays
  Clone ID: LIB3066-008-Q1-K1-H10
cgcccacgcgtccggcactactgggcttccgtgacgtacaccgcggtgcccctcttcctcatggccgtgctgtggttcgtcggcttcggcatcgtgatgctcgtcatctcctgctgctgctgctgcttctgccggggcaagaacgacgcctactcgccggggtgctacctcagctccctggtgctcctcatcatcttcaccatggccacaatcgccgggtgcctgatcttgcacggcggcagcgacctgttccacgggagcaccatcaggaccgtcgagtacgtcttcgggcagggcaacctgacggtggaccacctgaggaacttcgccgacagcttggcggcggcgaaggacatcacgatcaaccagatcttactcccggccgatgtccagcagaagatcgacgtcatcgaggagaagctcaac

SEQ ID NO: 45283 - DNA, 306 bp, Zea mays
  Clone ID: LIB3066-008-Q1-K1-H11
ctaccaagccatcagctcgcggggccaccacacctacatgctgcagactgccgagctggtgcacgagtcgtcgacggacgcggcggcgtcgctgctggtgacggcgctgaacgaggggcgggacgtgatcctggacggcaccctgtcgtgggagccgttcgtgcggcagaccatcgcgatggcgcggtccgtgcaccggcagcgctaccgcatgggggtcggctacaaggtcgcgcccgacggcacgaccacggagaagtactggtagcccgtagaggaggactgctagcagcaggcaggaagggc

SEQ ID NO: 45284 - DNA, 384 bp, Zea mays
  Clone ID: LIB3066-008-Q1-K1-H2
gattcctgtaatggaaaccatgttcgatgcggattcagaaccaaaaaatcgtaagcttgaagaatttgacactaaggcaaatagaaacatgggaatgattgacgaagaatcagatgatgacgatgattatcaagttcctgaagctaatatagaggaagacgtgaacaaatctcatcatgatatcaagcgcacagatgagcctacagaaaaaattgatttatcttgttttttgagtattcttcatcgtgatcccgaggagaaaagtcgcaattgttggacagtacctgatagcaagatcttcaaagttcgtagcaaaaacttcccacaagacaaatcaaagatacctgcagcaagttatctcatggagcttgcagccattgactg

SEQ ID NO: 45285 - DNA, 376 bp, Zea mays
  Clone ID: LIB3066-008-Q1-K1-H3
gcgtgagcatcagcatcatggagggaacacagctggaaaattggcaactcagcataatgtagaactgaacatattggctgaagatacagacagaagccaagtagaattgaagggaggagtcttagattttatggcaggtccatcagacaacaagcaaattgtaccttatggcactatgtctaatgatgaatcaagtgttatttttggtgccttacataggcttcgcctgtcccgctcagatatcttaagatggctgagatcaccgatcatgcacactacgttagatggcttttttgtccgactgcgatttggtaaatgggaggaagcattgggtggcacaggataccatggttgccgcctgaatggagcacttgat

SEQ ID NO: 45286 - DNA, 168 bp, Zea mays
  Clone ID: LIB3066-008-Q1-K1-H4
atcaaatgcgtgcggcaaacgcatggaatgtgcttgcctagctagctaattgttgtttgttttgtctttacttttcttcatacctgtctctctctctcggttgtttaatttttcttcatgcatgtaatataatgtgatatacccaatatatacaacgcgctttaattc

SEQ ID NO: 45287 - DNA, 444 bp, Zea mays
  Clone ID: LIB3066-008-Q1-K1-H5
cccacgcgtccgcggacgcgtgggtgcaagtggaaggagactctttgtagatacctatgatcgcaagactaaagaaaccaaggttggcatactgcaggtggcacctgaagttgctcaatggcttggaagggaactaggttacaagagttatgacattgaagataatactaatttgctgtactggcctcttgtgaatgtctattttggtgctgcttatgcaaaatggctcttctcttgtgatgacagacaaagaactgaagaatttgttgttagagcatataaaggcggcaaaaagaaggctgctcacaaatcaacttgccccatcttccagcgttatctttatgtgaaagagaacctgttgtctataagacaaccagaaatttgccatgacctcgctcctgatcaagaaaaactggcaagcgcagaatcacagttgatatattg

SEQ ID NO: 45288 - DNA, 374 bp, Zea mays
  Clone ID: LIB3066-008-Q1-K1-H6
cgcatcttcctccgtgatccaagttctagcagcgcagcgctcggtttcgacaatatgtcggggcgcggcaagggcggcaagggtctgggcaagggcggcgccaagcgccaccgcaaggtcctgcgcgacaatatccagggcatcaccaagccggcgatccggaggctggctaggaggggcggcgtcaagcgcatctccgggctcatctacgaggagacccgcggtgtgctcaagatctttctggagaacgtcattcgtgacgccgtcacctacaccgagcacgctcggcgcaagaccgtcaccgccatggatgtcgtctacgcgctcaagcgacagggccgtaccctctacggcttcggcggctaggtcgcttt

SEQ ID NO: 45289 - DNA, 362 bp, Zea mays
  Clone ID: LIB3066-008-Q1-K1-H8
ggtagatttggcacaccattacccttcccaaaacccatgcatgtggtcgtgggtaaacctattgaagtcaataagattccccatcctacaattgacgaggtaggtttctggatttaatcaaaaccacttttttgagagaaacatttttgtaggctcatattgttctcatgctgcgtaatttttggaattggtccgaagtccaaacataaacaaacctaattaaaagtatatccatgaatttgaggtattgaataaaataatacgcttgttcttgcacaagaatgccaatatgtttcttatcttattgtaatgaaaagctcggtttgatattattgagctgttcaagttttttgaaaggaaca

SEQ ID NO: 45290 - DNA, 254 bp, Zea mays
  Clone ID: LIB3066-008-Q1-K1-H9
aattctccgaatcgacgcacgcagtccagcccacgcgtccagccgacccatgatcgctatcggcatcccttcattattttttcacttttgtatattggtatcttgccaatagtttaatgaattcttttcttatcattaaccattatataatgtatttacacccaaattcaactcattactcaataaagtatcttatcatccaataataactataccacacattgaatataatcatgtcactgctgctacaattc

SEQ ID NO: 45291 - DNA, 388 bp, Zea mays
  Clone ID: LIB3066-009-Q1-K1-A11
cggacgcgtggggtcgaccaacctgcggcagtaccacaagaactaccagcgggacgggtggagccgcgtgctggggctgctccgcgacgacggcgtgctgacggtgaagggccacgtgcagaagccggtgctcaaggagcggttcaagcagttcaacgccgccatggacgagatccaccggacgcagggcgcatgggtcgtcagcgacgagcagctgcagtcggagctgcgcgtctccatcgccgccgtcgtcgtgccggcctaccgctccttcctcggccgcttcgcgcagcacttcagcgccgggagacagacggagaagtacgtcaagctcagcgctgaggacgtggagaccatcatcgacgagctcttcgacggcaacgccacg

SEQ ID NO: 45292 - DNA, 390 bp, Zea mays
  Clone ID: LIB3066-009-Q1-K1-A2
gggaaggccaggactgtgttcctgcgctacacggtgatgtggcgcgactggagcccggcgggggtgctgcccgtgcggatctacatcttcgacgtggccggctgcggcgtggaatacgacgtggaggagcaatgcagcggcggcgcgggcggcgagtgcgtgcacgttaagacggccactcaagcgctgccactgggcggcgacttggtgttcggcgtggcgcaccagcacgcgggcagcgccagcgcgtcgctgcacagcgacaacagccgcctgctgtgctagtccgcggccacatacgggggcggtcaataggccatggacaaagctgtctacatcgtcagcatgtccacgtgctacccgcgctcccacgccatcacagtgctcgac

SEQ ID NO: 45293 - DNA, 431 bp, Zea mays
  Clone ID: LIB3066-009-Q1-K1-A3
catcgatcacgacaagatggcgtgcacagacaatgcgatgagagccttgttcctccgggtgctcttctgcatcgtgcatgtgagaaggaagagtcaaagggcatcgatgcgaaagcgtccgggcctggtgggttcttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatgggaattggatcgagattctacgcgtggataacctggtcatcaccggcaagggaaaccttga

SEQ ID NO: 45294 - DNA, 385 bp, Zea mays
  Clone ID: LIB3066-009-Q1-K1-A4
cccacgcgtccgcccacgcgtccgccgacgcgtgggaggaacgaatctgctgatagggcggtggtggcctataaggctgctcaagacattgatctggctgagctcgcacctacccatccgataaggctgggacttgctcttaatctttcagagctctattatgagactctgaactccccagacaaagcttgcaacctggcaaagcaggcgtttgatgaagctatctctgagttacacagccctggagaggagtcatacaaggatagcactctgatcatgcaactactgagggataacttgaccctttggacatccgacctcacggaggatagtgctgatcagggcaaagatgccccgaaaggcgatgcatgctacggacagttat

SEQ ID NO: 45295 - DNA, 425 bp, Zea mays
  unsure at all n locations
  Clone ID: LIB3066-030-Q1-E1-F12
gaaaccctagttcgaacgcgccgccgtcaccgtcgtcgctcgcgctctccgcccggatcggagcgagagtaggggcgtgtcggcggtgaaagcgactgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagaggaacaaggggaaggcattgtgctgggaagtgtcnctacatacc

SEQ ID NO: 45296 - DNA, 349 bp, Zea mays
  Clone ID: LIB3066-030-Q1-E1-F2
agtgggatggcttctcctccccctccggttcgggttcgggttcgtgaggttctccggggttcggtttcgtgggtgagcggatcgatatggcggtgtcggatgttgagtaccgctgcttcgtcggcggcctcgcctgggccacggacgaccacaccctccacaacgccttcaacacctacggcgaggtcctcgagtccaagatcatcctcgatctggagacccataggtcccgcggcttcggcttcgtcatcttctccaccgaggacgcgatgcgggacgccatcgagggcatgaacggcaacgagctggacgggcgcaacatcagcgtcaacgaggcccactcccacgg

SEQ ID NO: 45297 - DNA, 395 bp, Zea mays
  Clone ID: LIB3066-030-Q1-E1-F3
aaaaaaaaaaaaaaaaaaaaaagggcgccgctgcgatcaacctcgatgatatcaaatttcatcagtgtgtacgtttggctagatttgagaatgatagaactatatcgttcatacctcctgatggatcttttgatctaatgacatacaggcttagcactcaggtaaaacctcttatctgggtcgaagcacagattgagaaacattctagaagccgtatagaactcatggtgaaggcaaggagtcagtttaaagaaagaagcacagcaacgaatgttgaaattgaagtgcctgttccttcagatgccacaaacccaaatataagaacttcaatggggtctgctgcatatgctcctgagagagatgcaatggtttgggaaataaaatcattccctggt

SEQ ID NO: 45298 - DNA, 440 bp, Zea mays
  Clone ID: LIB3066-030-Q1-E1-F5
gaggactcagccaaccccatcttcatcgacatgaagtactgccccaacaagttgtgtaccgccaacggcgcctccaaggtcaccgtcaaggacgtcaccttcaagaacatcactggcacctcctccaccccggaggccattagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcatattagttgctatccattggtaacgcacaacagtaaaacgacaaacatccaacagctatattatgttcgacggtgtaacaccctgaa

SEQ ID NO: 45299 - DNA, 449 bp, Zea mays
  Clone ID: LIB3066-030-Q1-E1-F6
ggtcgacgacgcggtcgacaacgcgtcggccaacgcgtcggaaggaacttggagtgaactgtataaagctaatgccctgccatgagttcaatgagctagagtacttcagctcctcttcgaagatgaacttctggggatattccacaataaattttttctcaccaatggcaagatattcttcaagtggcataagagactctggatgtggtgccataaatgaatttaaagcttttgtaagggaggcccacaaacggggaattgaggtgatcatggatgttgtcttcaatcatacagctgaaggtaatgagaaaggcccaatattatcctttagggggatagataatagtacatactacatgcttgcacctaagggagagttttataattattctggttgtggaaataccttcaattgtaatcatcctgtagtccgtgaatttatagtggat

SEQ ID NO: 45300 - DNA, 431 bp, Zea mays
  Clone ID: LIB3066-030-Q1-E1-F7
cccacgcgtccgcaagcctcagccgccacctgagggccgtcttcctgatgccaccaagggttctgaccacctgaggcaagtctttggcaagcagatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggccttcttcagctcccaagtgacaaagccctgctgagcgaccctgtcttccgccctcttgtggagaaatatgctgcagatgagaaggcattctttgatgactacaaagaggcccacctcaagctctccgaactggggtatgctgatgcttaaatggtccatatcctggagcgggacacaa

SEQ ID NO: 45301 - DNA, 396 bp, Zea mays
  Clone ID: LIB3066-030-Q1-E1-F8
cggacgcgtgggggcggaagttggcgacgactgggcgaccgccgccgccgtacgccaggtgctcaggtctccgtcagacccttcgccaggtcttcttccgcggcgagcaccgccaggtgtgcatccaatcttcttcactgggtcctccgctgcttctagtcacgcatctaaatccggagttgccagcattcgcttgaggtgcctgacaaagcacaccatcatgcaggctagcgataggttcaacataaactctcagcttgagcatcttcaagccaaatatgttggtacagggcatgctgatttgtctagatttgaatgggctgtaaacatccagagagacagctatgcctcttatattgggcactatccaatgccagcatattttgccattgctga

SEQ ID NO: 45302 - DNA, 409 bp, Zea mays
  Clone ID: LIB3066-030-Q1-E1-F9
ctcgtcaaggagccgcacctcgacgagcttgagcagcggcggcacgccgtcctcctctatgatgagccgcacctcgaggggcaggagaactgcgcgctcgccatcggcctgctgggccgcgacccggagtgcgtcgagcagatggtccaggccggggtgtgcctcgccttcgccaaggtgctcaaggagggacccatgaaggtgcaggccatgctggcctgggccgtctcggagctcgccgccaaccaccccaagtgccaggacgccttcgcgcagcacaacgtcatccggctgctcgtcggccacctcgctttcgagacggtgcaggagcactccaagtacgccgtcacgtccaagatgtcgatacactccgtgctgatggacagaaagaacaacgccgcctctgcgg

SEQ ID NO: 45303 - DNA, 399 bp, Zea mays
  Clone ID: LIB3066-030-Q1-E1-G1
ggaaacaacctcaatcggtgcgcctctcgctctcgctggtggtgctcctcctcctcctcctgctcccggggcgggcggcctccttttccacctcctgctggtgccacggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacgcaaagttcatcactgata

SEQ ID NO: 45304 - DNA, 333 bp, Zea mays
  Clone ID: LIB3066-030-Q1-E1-G10
cacgcgtccgcggacgcgtgggcggacgcgtgggcggacacgtgggcaaaactgaagtttttggccgaacgaggcattttcttgacattttctcaacacaaaccatgtaataggttttgttgtagacttcatatagagttgtttgagcacgatgacaaggtttgtttgaatttaaaaatttgcatttgttgacacgcgcagtttcaagcacgcctagtatttatcttctcatgcgagcagttggttcaacttcgagaaatatttaaactacactttactgggggccttcgtcttccgaaggtcccaacaaacatgatttaacaatgtttccgg

SEQ ID NO: 45305 - DNA, 380 bp, Zea mays
  Clone ID: LIB3066-030-Q1-E1-G11
aattattcttctgatctgctcctccaacaacaacatcgtcgtcaacgtcttcaaccatctctaccatctgctccggtccaccagaaacgggaagcaatttatgtaaaaaacatgggtggacgggaagacatgccgcattatgcaatactggctgatacaaacttcacatatacctgggaacccaaggatgagatccccaacttcttctaattcccgtccatcgtgatgcaccagagcggtaggcggatatagtgccaacaaaatggacagacgcctccgcatctttgtcacgttcgattagcccccgccagaaaactaccacatggagttcaacgagtattggaaaatcaacgaccaaaatagtccaaccccccatatgg

SEQ ID NO: 45306 - DNA, 231 bp, Zea mays
  Clone ID: LIB3066-030-Q1-E1-G12
agactgcatctgagtcgtccaccgaagctcccgctggagctggcactggcgctgcaggtggacatccgcatcttcgtctattaccacaaacgggcatccaccctggggggggtgcctacggggttattattctccatagtcgtgtactaattccagtaaccttctacatgcctgcctacgacttcatggtccacgacggatactggtacagtagcgattacactgtcctgg

SEQ ID NO: 45307 - DNA, 141 bp, Zea mays
  Clone ID: LIB3066-030-Q1-E1-G3
gatactcatgcaacttaaaagcatcacccggggggacggtcaaaagagattacatttaccgttcgtttgaatgacaaatccttagccgtgaaaaggctgaagtaaattaaatcaaaagcggtggaggtaaccacccttaaa

SEQ ID NO: 45308 - DNA, 415 bp, Zea mays
  Clone ID: LIB3066-030-Q1-E1-G5
accacgcgtccgcccacgcgtccgcccacgcgtccgcccacgcgtccgactttcaagatccatagcttcatgcaaagtagaagcaagtactgtcagtgcatggatcaactttttgaaagatacgtggaaattgcagtccttgtttgaagagctaagagaaaaacaggccaacgaagaattggatagatgtggactctgctttgcgaaattgatgaagtatcatgtttctgcatccatggaagagctaagcacttctattgaccgtatcaaaacctttgttgataacttgaaaatatttggtaacagatccgtgtcagcagaggatggagctaatggtccgtctaagcaatcaaaccctcgtagatatcttgaggaagaatatctccaaactgagaaaaaggtcgtagctgcattc

SEQ ID NO: 45309 - DNA, 413 bp, Zea mays
  unsure at all n locations
  Clone ID: LIB3066-030-Q1-E1-G6
aggacacatgggctctcccggcacacgagggcgcaccgttgatggtggcagcaccgacggacgcaaccgtcgcggccgccagcatggacctcctctaggacgatgacgagttcgcaaagttcgagatcaacgacaaatgcgatgaccacgcagaaggcatcgaagccctccaacagtgggacgatgagtgagataaccatcacctgcacgatgatttctcgctgcaccatatcgaaaagctggacagaggcaacgggcagcataactgaggttttatttctcgacattacacaaatgacttttatatggcagccacttttggtacagttgatgtgcttaggttatccaagtttttggccgtcagaacctcaagcccattancgaaagtggcggggagccgcctcatgggaaac

SEQ ID NO: 45310 - DNA, 432 bp, Zea mays
  unsure at all n locations
  Clone ID: LIB3066-030-Q1-E1-F11
aacgtccgatcaaggttcctcatgatcagttgccttccttgctcaagagttagggccaaataaaataaatgcaagacagaaggagtggtatgaaatggggccgggacacaggtgctcatcatatatatggatcagcgtaacacagagaaatcaatggtgggaaggtgagagaggcagacagacacagcagagagaagcatgcatggtgtgctgcagctgcagtgcaggacgacgacgacgacggcagcagctancagcgagtggtgatgtgagatagagaaacaaaatgcatgcagcaaatagctttcttcactttttttgcaggcggatcggagggggagcggcangcatgaattgatgaacgaattaacacaccaatgcaacttggaggagcgctcagctaaacatgtatcttcgttcacttgtgcattt

SEQ ID NO: 45311 - DNA, 385 bp, Zea mays
  Clone ID: LIB3066-030-Q1-E1-D7
cggacgcgtgggctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaagtctg

SEQ ID NO: 45312 - DNA, 421 bp, Zea mays
  Clone ID: LIB3066-030-Q1-E1-D8
ctcatgatcaagatcaacgaggacgcgctgccgtggatccgcggccacatcgcgaggaagaggatgcagaagaagggccctacccccaccatgggcaagacgccttcgctgagaggctacgtcgtcgatccggagctcggttccaacgagggctagaggtcgtgcttgctcttttgggtagcggaaaaaaaatagggtgtttctcccccccggctcttggtgttatattgtatatttaagatcaggggaaaaaaactggtatcacacgttttggaaccgaagctaatttgagtacaggtatacatacatgcatgtaatgtgagcgaagtggcatcggagattcggagagatcgatgccgagtgatacatgcatgactcgttgttcagaatttattgccctcgacttcgacagacgaagaag

SEQ ID NO: 45313 - DNA, 406 bp, Zea mays
  Clone ID: LIB3066-030-Q1-E1-E10
cccacgcgtccgcccacgcgtccgggaacatccatcgatctccccccagcggcgaggagagccggcggccacaggaaggagaaatggcttccgcacacaacgctctccgggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaaggggagcaacatcgccat

SEQ ID NO: 45314 - DNA, 228 bp, Zea mays
  Clone ID: LIB3066-030-Q1-E1-E11
acaaaacgtccgcccacgcgtccggccgtgcaaatccatttcgtgccttgccggcaaagctctgcatagctccccccaacattaggattacgattttggcttggatttggatttggatcgggtgtgtttcctgcgtaaccatgagcgagatgatgaaactaaagcgtgggattagcaccaaaacaggagaccacctcgtccataatggccatgaacatccatgtcacg

SEQ ID NO: 45315 - DNA, 415 bp, Zea mays
  Clone ID: LIB3066-030-Q1-E1-E12
cggacgcgtggggccgcaccctcaaatcccgcgggcgttaaactctttctcggtcaccgtcaatggaaggtcccagatctcttctcgccattaccgcgcccgccccgtcaattcccatatctcttcaataaggccgcccgcggctggcgcgacgtcgccggccatggtgcgggtgcaggagaccgggccatggcggcaccggcgccgagccccatccctggcgacgacgcggcatcaagccccggtgacggcggcccctgcgcagacgcggccaccggcctcagccccggtggcggcgcgctgcctcaccggccccccagcacaagaggacgcgtcggtggctcggtgctatggacgcgtcggtggctcggtgctatcgacctcgctgtcgggttcctgttcccgctgtcgctcg

SEQ ID NO: 45316 - DNA, 433 bp, Zea mays
  unsure at all n locations
  Clone ID: LIB3066-030-Q1-E1-E2
accacgcgtccgcccacgcgtccgcccacgcgtccgcccacgcgtccgcccacgcgtccggcataaccccaaccggagaggacggccgacggctacgagctacgtanccgtggtccggcgagtcggggattccaggtccttgacaatgacccactggaaaaggcaaatgcatccattaggagcagaactctcatgaacaagcttgttctgcctttacttttggttgaacttgtgataaccaacccaaactgccaaaaaatctggtgttgctacatttgtatcaatctttacctgagcttgtgtttttgtaagcttatgcatgtacctccacatgtatagatatgctacctacattttctttctgtggtcatatgatatgttgacaaggtcacagatatactctcagtatatgatgacgcttctatgaatctat

SEQ ID NO: 45317 - DNA, 437 bp, Zea mays
  Clone ID: LIB3066-030-Q1-E1-E3
cggacgcgtgggtctcgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcaaggatggaccggaagcgcatcaaggacgcgctcgagaagcacctggagaggtcgtcgccgtctacttccaagggcgtcgtgtccaaggagagggagcgcctcgctgccgggaagctgccgtcatcgcttggcaaggcggaggtgtctgatggtgaggaatttgaaactgacagtgaagattctgatgtgagtggtttcgagggagaggacacgtcctggatttcatggttctgtacattgcg

SEQ ID NO: 45318 - DNA, 304 bp, Zea mays
  Clone ID: LIB3066-030-Q1-E1-E4
ccacgcgtccgcctacttgtccgtgcaggttgctcaggctggaaatcatactattgaaaatttggctgcactcgttgtccactccgcgtttcgattgttcgtgaatacgcgtggttaacgaactttgaaaagaatcattctacttaaattcactgacgacgggacattctgtaacaccgtcaacatcaaagacgcctcagtgtatacatacgctggtgaaagcacacactcgtgtcagatgacaacaagttcatattgccttattttctcaggtggcactgaagcagcatcctgaccaagatga

SEQ ID NO: 45319 - DNA, 365 bp, Zea mays
  Clone ID: LIB3066-030-Q1-E1-E5
gtgataacaggagaaacaactgttcactgtcaacaatgcttcacaataagatgctggcaaggacgaacagattcaaaccaattatttagcgaacagagttcaatcattttttttgaccatccagtcttttggttcacaaaaggtttctctgggagcaaaccatcgatgttactttttccagcgtgcatatgtatttatgctgggtaactcaaaacagtatctggcctttgcgtaccagattaggttttgttcggttattcctatcttcatgtggattgtatgagattggaaggaattatgagagatgttgacttgtttaggatttaaatcatccaataatccacataattcaagtttcgttggtg

SEQ ID NO: 45320 - DNA, 416 bp, Zea mays
  Clone ID: LIB3066-030-Q1-E1-E6
ggaagaaaacatgctgacagctctcttggttccttacattttcttcaccctgcctaatgtgctgttttctctgatcagaggagaggtggggaaatggattgcgattattgctgttattctgcgtctattctttccacgacacttcccagattggttagagcttcctggttccatcatcctgctcacagtggtcgcccctagcctgttcgcggacagcttcaggggagacctcgttggtgtcttcatatgccttgtgatcggatgctacctgctccaagaacacatcaaggcgtcaggtggattcaagaacgccttcaggaagggcaatggtgtgtcgaactccatcggcatccttctgctcttcatctaccctgtctgggccggtgtgctgcaagtcctgtaagcaccattgcctc

SEQ ID NO: 45321 - DNA, 393 bp, Zea mays
  Clone ID: LIB3066-030-Q1-E1-E7
cggacgcgtgggcaggccaccgggtcgctggtgcacgacgccgccgtcccgctgcggagctgaccggccgggacaggacgggacagaacggaagcctacgatcgagtgtacatacaagggttgggacttgttgggttttcctttgggtggagagcgagggagcgcagttgagacccagcgagcactctctcgagcactgcagtgtagctccggcgtacatgagattgtattatgaccaagccgggatggaaagcacggaggggaggataaacaagttttgtcacatttcacgctccagccatcacctgagtttgtccggcgaatatatcgatttcctattacaaatccggataaaatgatgtgttcctgcactgcctgattacgtaacgcact

SEQ ID NO: 45322 - DNA, 405 bp, Zea mays
  Clone ID: LIB3066-030-Q1-E1-E8
ggcggccagacagggctcccacaggccatcaccacaacacacaaagacagctcagagcaggtcacacacaggctcctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaccgccggagggagtgccgcgggacggtggccgagtgcctcgccgaggagtcggatgaggagggccttgacctggccggattccaccgccgcgcgctctacggcggcgggtacatcagctacggcgcgctgcggcgggacaacgtgccctgctcccgccgcggggccagc

SEQ ID NO: 45323 - DNA, 335 bp, Zea mays
  unsure at all n locations
  Clone ID: LIB3066-030-Q1-E1-E9
gcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgctccggcggcggnnggctcatccggtccctctagcgcaccagcgccatcgt

SEQ ID NO: 45324 - DNA, 423 bp, Zea mays
  Clone ID: LIB3066-030-Q1-E1-F1
ggaccacgcgtcggctaaggaacgaccaagtgctgctgaggccctggcagatccatactttaatggattagcaaataatgaacgtgaacccatagcacaacctatctcaaaacttgaatttgagtttgagaagcggaaactggccaaagatgatgtccgagaattgatttaccgagagattttggagtaccatcctcaaatgctacaagaatacctacaaggagcagaccacaatcagatgaccttcatgtatccaagtggggtggatcgcttcaggcgccaatttgctcatttggaagaaggtactgcaaagggtgaaaaacacagtccacagctgcgacagaatgtttctttgccaagggaaagagtaattggcactaaacatggagatggcaatacaggtgatacgctagcgcatgcctc

SEQ ID NO: 45325 - DNA, 377 bp, Zea mays
  Clone ID: LIB3066-030-Q1-E1-F10
aggattttgtgacgaacgtccagatccgcggcatcacgctgctcaacagcaagttcttccacctcaacatcttcgagtgcaagaacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggtgtcaagtgcggcccatgccacggcatcagcgtcggcagcctggggcgctacaaggacgagaaggacgtggaagacgtgcaggtgacggggtgcacgatcgccggcaccacgaacggcctgcgcatc

SEQ ID NO: 45326 - DNA, 447 bp, Zea mays
  Clone ID: LIB3066-030-Q1-E1-D6
cgggcaataattatcgggtccaaccaccccttcgggaaaaatcttctttatcccttgggccccggatacatcaagggtgaaaagcaagatgctgtacgcaagctccaaggaccggttcaagagggagctggatggcattcaggtggagctacaagcaaccgacccgagcgaaatgagcatggacatcgtcaagtcgcgagccctctgaaacagccccggccgctgcacctgcacgctgcaggggcgcatcggctcctgcatgcccgtgggtcgtcgaatccttgcttgtgtgttgggaacggtcttgtgttttcgtgtccttgttttcctggaagcaaaagccctgcattctatatgagactgtatgccattttccatctttttctctccccatatctctgccctagtcctgctaccgctgtagactagaacttatttggtgtttga

SEQ ID NO: 45327 - DNA, 407 bp, Zea mays
  Clone ID: LIB3066-030-Q1-E1-B9
cgaagccggagaatgaagagctagcctatcaaccatgcatggaagtagcaatggcacctgaatcagctacaaaccatgatccaatcctagcggctagcgatctctagtttatattacaattaggagcaagcgatccaattatcgatagagcgcgagatcgatcgatcatgccgggccgctcggtggtctccatcctcctcctcctcctccatggcctcctctgcctgcagctggctgccttggccgagatggacgacgacgacgtcatggaggacggcagctgcatgcatttcagtgtgtccccgccgcctgctccgccggaggacgcggatgagcggcgcgactatttccgcgccatgcaggccaaggatctgttccggcacgagcagatgatcacgatgatgggc

SEQ ID NO: 45328 - DNA, 432 bp, Zea mays
  Clone ID: LIB3066-030-Q1-E1-C1
accacgcgtccgggctatcgcagttgagcaccgtaaagatgttgattccgcggtggttactgtccttgatgaagtcatgccgtccatgactggttcagctggaactttgtttacccataaagaagtgttgccatctatggatgattctgttgggaatttgtttgctaatcgcagcacacatgaagtgggtagttcatcatgtgcaggacatgagatacatatcgatgagattgatgtaagtgttcaccctgcacaacacacttcttctggggaggctaaaactggcaagcaagaaaacataaacaatgaatgtgtgggaagacttgcatcagtcgaaggggtcagtgagcaactaaatctacattctgattctattacaaatggcagtcagcatgatttgattcccaaacttgatgtgctatcatcaaatac

SEQ ID NO: 45329 - DNA, 405 bp, Zea mays
  Clone ID: LIB3066-030-Q1-E1-C10
aggacgcgtgggcggacgcgtgggcggacgcgtgggctggaacgtcctatgatcaggcatcccagtttaataatgttaattcagggtggaatgatcaagctgccagccttccagcagagcaagcactgaattacgatgatcaaagtggaaaccttccgccacctccttgggaggctcagccagcggcaagcaacgaaatgccaaatggtgaattgggaggcgtgcaacctcttcctgggacagctgggcagttcggcggcatgcagcaggcactgcaaccacaagttaaccacatgggagttccacaaaggcagccaatgtacagcaaccagccaggggttgtggtggcgccaacacagatgcaggcacgcttggggaaccagcagttgggttcgacatccatga

SEQ ID NO: 45330 - DNA, 248 bp, Zea mays
  Clone ID: LIB3066-030-Q1-E1-C11
cccacgcgtccgaaaaaaaaaaaaaaaaaaaaaaaaaaaaaaaaaaaaaaaaaaaaaaaaaaaaaaaaaaaaaaagaagggggggccgaacagatggatgtaagcttcggttggcggggatgggaagtcattttctcttgtatcgtgtcattttcatttcatttccctgggtttttgttttgtcgcctctggaatggaacattccttttcgtaacttaagtgaattgcattacattaaattttccttt

SEQ ID NO: 45331 - DNA, 355 bp, Zea mays
  Clone ID: LIB3066-030-Q1-E1-C2
agcacatctatgggctccttgccatgaattcatggttctggagtgccatatatcacagttgtgacacaatttggacagaaaagctatatttttcatcagctgctgcctttctggggtactctctcattttggcgatactgcggacttcaagtttaagagacgaagcttctagagtcatggttgccgctcctattctggcatttgtgacaacccacattctgtacctcaacttctatgagcttgacaaaggcctaaacatgaaggtttgtactgtgataagcattgctcagtgtctcctgtgggcactgtgggctgtcatgagtgggcatcgttcgcggctcaagatcatatctgt

SEQ ID NO: 45332 - DNA, 423 bp, Zea mays
  Clone ID: LIB3066-030-Q1-E1-C3
attggaccgtctaacccacaagtggaacattgaaaatttaaatactacagagcaccagatgcaagacacaccatacttgtccagtcgatataccagtagagatattctagccttgggtatcagagacttcaattcctctcaacttacttaccagcaagaacttcaacatcttgaaagttgggtgaaagaatgcaggttggaccaactaccatttgtgcgacaaaatttggcatacttcttattgtccgctgctggctgcatgtactcccctgaactgtctgaagctcgcactttgtgtgcaaaaaatggtgcgctcataactattgttgatgacttctttgatgttggaggatcaaaagaagaacttgaaaaccttgtcatgttggttgagctgtgggacgagcatcacaaaattgagtttta

SEQ ID NO: 45333 - DNA, 421 bp, Zea mays
  unsure at all n locations
  Clone ID: LIB3066-030-Q1-E1-C5
cacacgcgtcggataaaaataaaatggcgtgtatagacaatgcaatgaaagccttgttccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcangaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcac

SEQ ID NO: 45334 - DNA, 390 bp, Zea mays
  Clone ID: LIB3066-030-Q1-E1-C7
gagagagacgcaggcccgccggcgacgatcgaggagggaggaaccagagacccggcggcggcgacgatggctccgcgcagctcatcggcggcgacgtgcctgtgcctcgctctcgccgcggccacgctggcgctggcccacggtgcgcaaggaggaggaccatcggcatcggcggcggacctggacaaggtcacggccgagaccttcttcgacatcgagatcgacggcaagcctgcaggccggatcgtgctgggactgtttggggacaccgttcctaaaactgcagagaacttccgagcactttgcacaggggagaaaggaattgccaagtccggcaagcctctgtggtacaaggggtcgacgttccacaggattatcccggggttcatg

SEQ ID NO: 45335 - DNA, 413 bp, Zea mays
  Clone ID: LIB3066-030-Q1-E1-D1
agcggttgtaggggaagaggcggaggcggaggcggagacggagactgaaggcgaggcggaggcagaggtcgaggtcgaggccgaggtcgaggtggaggcggaggccggtgcatcgtctgcgaagaagaaccgtatccaggtgtccaccaacaagaagccgctctatttctacgtcaatctcgccaagaggtacatgcagaactacgacgaggttgagctctccgctctggggatggccattggtaccgtggtgaccgtcgctgagatcctcaagaacaatggcctcgccactgaaaagaagatcctcacatcaaccatcggcaccaaggatgaggcgaagggccggcttgtccgtaaagccaagatcgagatcctgctgtgcaaatcagagaacttcaacagcatcatgtcga

SEQ ID NO: 45336 - DNA, 402 bp, Zea mays
  Clone ID: LIB3066-030-Q1-E1-D10
agcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgcctcggggccctccgccagcagcggcgcgcccgccctcgccgccgcgcccgccgcgctcctcttctccctcctcgcctactacctccactaagcgtgtgcgtgcg

SEQ ID NO: 45337 - DNA, 363 bp, Zea mays
  Clone ID: LIB3066-030-Q1-E1-D11
cacacatcgtctatcagtgctcatccaacaatccgtgcgcgaccaaggcaataatggtgtcgtcctcccgtgctgtcgtcgtcgtcgtcggcctcctcgtcgccgcgtcctccctcgccgtcgctgcctccgatggcggtgggccgacgtacgggtacacggcggggagccccgacgggccggagaactggggcaagctgagccccgcgtacaagctgtgcgggcaggggaagcagcagtccccgatcgacatcgtcaccaagcaggccgtccccaacgccaacctcgacaccctcaagcgcacctacgccgccaccgccgccacgctcatcaacgacggccacgacatcacgatgacgttcg

SEQ ID NO: 45338 - DNA, 407 bp, Zea mays
  unsure at all n locations
  Clone ID: LIB3066-030-Q1-E1-D12
cggacgcgtggggaacaagtcgtcgatcgacagccgtgctcatcgtaggcgcggcggcatccgggcatggacaggtgcggcggcggcgccatggcgtcgtacctggtgtcagtcgtcctgcttgttgcgctcttcgcgtcgtctgcaaaatgtcgtcctgagccactcgacggcggcggcaacgttaacggcaatggcacggcgccgccagtcaacggcggcggccccggccccggccccggcgccgtactgaagctgcagttctgcatccagaggaactgcgtgtacgaaggccgtggcaacgccccgtgcttctgctgcggggccttgaagcccaaccagtgctacgaaacgagggacgggtgcagcggcaactgcgtgtancggtgtagccgccgccgccggcg

SEQ ID NO: 45339 - DNA, 382 bp, Zea mays
  Clone ID: LIB3066-030-Q1-E1-D2
gctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgtggatgccttccgccagcttcttgtacttgaagagctgctaccatcgcagcatgatgactaccacatgatgctaagatttctcaaggcaagaaagtttgatatcgagaaggcaaagcaaatgtggtctgatatgctgaagtggagaaaggagttcggtgcagataccattct

SEQ ID NO: 45340 - DNA, 404 bp, Zea mays
  unsure at all n locations
  Clone ID: LIB3066-030-Q1-E1-D4
acagaatctcgttccaggccactcaggatctgtcttctctcaagaacatggcaggggaaaccgggaaaaagttgacatcgatggcatccaacatcatcactgatcttcaggaccgcatcctctgagctttaaactcacagtaaacttctgcgttgtttcagtggctggcttctcccgtcgacccgggtgacaaactggcctggcctggcctgcagatctgtctaggagttcgtaggcgtctgagaacttcctggcaatctggcatatctgtctangagttcggaagcatctgaaaagtggcatatctgcctaggagttcgggagcagctaaaatcttgaagttagagagagagagagagaaagagagagagagggtgaaagaagagaacttatgaccaatactg

SEQ ID NO: 45341 - DNA, 435 bp, Zea mays
  Clone ID: LIB3066-030-Q1-E1-D5
atagcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgccggtgagcgggcagaagggcgagcacttcgacctcaccataccggcgttcctc

SEQ ID NO: 45342 - DNA, 433 bp, Zea mays
  unsure at all n locations
  Clone ID: LIB3066-030-Q1-E1-B8
cccacgcgtccgcccacgcgtccgaggaggcgtccactgacgacaagagcaccggcggccaggctgacaacactactgtacaagaggcatccaccactgacgataacagcaccggcggccaggctaacaatagcaccaaggacacaccgacagagtcaaaagagaccgttggcggtgacgacggcacggcccagagccagacgagcttcgacgacatgaatggcagtacgaacgactcgcagcccatgaaagaagacgggaaggtcgccgagaatagctccgatgaaactgccagcggcggcaaggtggaaagcacagacgacgacgcgacaaccggcgcggcgtcaaacaacgcaacttccggaggccanaacgtcgcggccgagaccatggcatttgcagccgcggatgatggcgccaacggcaacatcac

SEQ ID NO: 45343 - DNA, 428 bp, Zea mays
  Clone ID: LIB3066-004-Q1-K1-E2
cccacgcgtccgcccacgcgtccgagcggaagatcggcgtggcgatggacttctcgccgagcagcaagaaggcgctgcgttgggcgatcgacaacctggtccgcaagggcgacaccctcgtgctcctccacgtccggcaccacggccgtgaggagggcaagaacgtcctctggtcccgcaccggatcgccgctggtcccgctggaggagctcatggagccgcccgtgaggcagcgctacgacgtgccgtatgacgcggaggtgttcgacatgctcaacgccgcggcccggcagaaagagatgtacactgttgttttggtgaaaaaggctgccagataaactgcccagcttgtatcactacatgagaaagtcactggacagcatcactattaccattttttttaacaagggatagaatggctctgctta

SEQ ID NO: 45344 - DNA, 274 bp, Zea mays
  Clone ID: LIB3066-004-Q1-K1-E3
gtgatttgaaataattggcgaataaatagttcgagaatccctgaagcgtgcatatatatgtgcgtgccaagataaaggtaatggagtcctcacgcacgttccagccggccgacatcctgcttctcctgctcattgtgtcacacacgatatggcacaagcaaaggaatgctacaagtacaatgagcgatttgttgaggcatgcatgatcgcagacaactacgccaatctctgcccccgttacgacttgttggccgacacgtgcagcaactacatg

SEQ ID NO: 45345 - DNA, 367 bp, Zea mays
  Clone ID: LIB3066-004-Q1-K1-E4
acaagatctgcagtttcgctggcgccgtgaaagccaacagcgatgtagctgagaccgcgagcgtcccgagcacagaatgagctcccgtttggttcagagtgacatgttcaaaaatttctggaatgatcgtatattgatcctaggacaggcaggaagtcttggggcttatgtagtgtacaatttctgtatctcatataccgtgctcgttgccagtttgtactataccatatataaaccatagaacatgtgacatttagaagtctggccaaggtcagctgtaatgcttcacatgcttatagcctggaaacattagacattgaaaaacccgagcagtgaataaaggatgcccaaggcagaaactttgatg

SEQ ID NO: 45346 - DNA, 427 bp, Zea mays
  Clone ID: LIB3066-004-Q1-K1-E5
cccacgcgtccgcccacgcgtccgcccacgcgtccggcaactgaaaacagccgagcgggctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggca

SEQ ID NO: 45347 - DNA, 424 bp, Zea mays
  Clone ID: LIB3066-004-Q1-K1-E6
cccacgcgtccgatacgaaaaccctcgcggcgaggagcgctctccgtcccacacacgcgcgccgcagcctccgcagtccgcacctgcctccacgacttgtcgtgctcgtgcgctactctcctagagcgcattgcgctgcacggggacatcaaatggcggcagcggcggagatcggtggtttcgcggcggcgagagtggcggtggcgacgctcaggccggctgcgcacccagccccggcggcggcggtggcaccgcagcctaggagggcggtggcggcgcagtcgctgcagacgaccgccaccgaggcgctgacggcggatctcgccggcacgaccaacggcgctgtgcatgctcggatgaatagtaaggctacaagtgaaatcacttcacaggcagttactgcaaattctatgagaaagacaaa

SEQ ID NO: 45348 - DNA, 425 bp, Zea mays
  Clone ID: LIB3066-004-Q1-K1-E7
aattgttgtctatgatataacaagtccggaatcatttagcaaagcacagtattgggtaaaggaacttcagaagcatggtagtcctggtattgtaatggttttggttggtaataaggctgatctacatgataatcgaagtgtatcctcgcaggatgcgcaggactacgcagagaagaacaatatgtttttcattgagacgtcggccaagacagctgataatataaaccaactgtttgaggaaattgcaaagaggttgcctaggccaacggcatcgtgacagaacacttgtgtgtattgcttgtaccatgtaatgcatgccagtccatatacacgggtactgtatggactacggaagacctctcatgtaaagatatttcccccattctgtcatagttgtggatgacaattggtattgagaatatcct

SEQ ID NO: 45349 - DNA, 427 bp, Zea mays
  Clone ID: LIB3066-004-Q1-K1-E8
cttcaacatctcgtctctctcatcctccgacgccatccgctcccggcccggccgagccgcgcgttgtgtatggattccaaaagcaatcatacaggggctatggcgaggccttacaaacctaagaatatcctcattacaggagctgctggttttatcgcctcccatgtcgcaatccgcattaccaagaagtaccccgattacaagattatcgtccttgacaaacttgactactgctctaatctgaagaacctgcttcctgtgagctcatcaccaaacttcaagtttgtgaagggtgatattgcaagtgttgatcttgtcaacttccttcttgtcacagagaacattgataccataatgcacttcgcggcccagacacatgtcgacaattcatttgggaattctttcgaatttaccaagaacaatattt

SEQ ID NO: 45350 - DNA, 369 bp, Zea mays
  Clone ID: LIB3066-004-Q1-K1-E9
ctcggcgtgcgcgccgccggcgccggcgccggcgtcgacatcaaggtgtcgtgtgcagggacgccggacccggacgtgtgcctacgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtggcagtgcctgaacgagtgcgccggggagatcgaggaggcgctggaccacctggacgacaccgagggcggcctcgacgacggcaagctccacgacgtgaagctgttcctggacacggcggatgaggacacgtggtcctgcgacgtc

SEQ ID NO: 45351 - DNA, 427 bp, Zea mays
  Clone ID: LIB3066-004-Q1-K1-F1
cgcgggtccgggcgactccggcagctacaaggactggccggaggacacgggcttcttgcggcgcgagggcgggtggagcacggagtacggggagttcttcatgagctggtactcgcagatgctcctggagcacggcgagcgcatcctgtcggcggcgacgggcgtgttcacgggttcccccggcgtgaagatctcggtgaaggtggccgggatccactggcactacggcacccggtcccacgcggcggagctgacggcggggtactacaacacccggtcgcacgacgggtacgcgcccatcgcgcgcatgctggcgcgccacggcgccgtgctcaacttcacgtgcgtggagatgcgcgaccacgagcagccgcaggacgcgcagttgccgcccgaggcgctggtgcagcaggtggccgccgcggcg

SEQ ID NO: 45352 - DNA, 358 bp, Zea mays
  Clone ID: LIB3066-004-Q1-K1-F10
cccacgcgtccgataattttttgaccaaaaaaaatttatattgattcattcacaagacgtcaataaccaatgacaatccgaacacatggtgttgtttgctagtagcctcatcatgcgtctcattagaattgaatggaccttaacatattgtgttcaaaaatcacaggtgagaagcataggtagcgacagttattgcagtcttgatgaataggggaggaaagcggcggccgatacaccggcacaaaactttgttagcgctaatgaagaaacggcaacgaatacgggggcaggtgaagctggcggttgtaacggcttccccacggcttgcatttctcgggcccaaagaattataagcatt

SEQ ID NO: 45353 - DNA, 326 bp, Zea mays
  Clone ID: LIB3066-004-Q1-K1-F11
cgaagattgccaccccaggatcatccaccgtgacatcaaggcagccaacatccttctggacgagaatttcgaggctaaggtcgcggatttcggacttgccaagctgaccacagacaccaacacgcacgtctccacgcgtgtcatgggaactttcgggtatttggccccggagtacgcgtcgagcggcaagctcaccgacaagtcggacgtgttctccttcggcgtcatgctcctggagctcattaccggcaggagaccggttgatcccacgaactacatggaggacagcctggtcgactgggccaagcccctcttggcgcgcgcgc

SEQ ID NO: 45354 - DNA, 327 bp, Zea mays
  unsure at all n locations
  Clone ID: LIB3066-004-Q1-K1-F12
cccacgcgtccgcgctgggcgccgacccgcgcagcaaggaggccggcaacaagaacatgcacgcgctggcggtgctggccaccaggatggccatcgaccacgccgccagcaccgagtccaagatcgacgacctcgcggagctggaagcggcgtcgtcggatccgcaggcgcgcgcacgcttcaaccactgcctggagcagtacggcggcgccgccgacctcctccgcgacgcgctggacaacctcaaggccaagatctacggcaaggccatggagcagctgaccgcggcgatgggcgcctncgagagctgcgaagacgcgtggaaag

SEQ ID NO: 45355 - DNA, 431 bp, Zea mays
  Clone ID: LIB3066-004-Q1-K1-F2
tcttatagcctccagcctcccctcgccccccgccacccctatggccgccgttttcttgcaccatgtcgtcggcgacctcaccgtcggcaagcccgaggtcgccgagctgcacgacaccgacacgctcgacgacgccgcgcgcgccatcgccgccagccccgagggcgccgtgcccgtctggcgccccagggccgcgccggacgacgcgccctcgggggccaggttcatcggcatgatctccgcgctcgacatcgccgccttcgtcgccgccgcgggggtcggggatcgctccatgcgcgccgtcgtcggcgaggtcgtgcagcccaatcctgcgctgctcagggagatcgatccgggtaccaggttgatcgatgctctggaactgatgaggcatggagtgaagcgctttcttgttcgcaagagtgggagct

SEQ ID NO: 45356 - DNA, 428 bp, Zea mays
  Clone ID: LIB3066-004-Q1-K1-F3
gcgtacgaagacgactgatcctacacaatctacatttaactgacaggcaccaacctccaccaatagtggcgtaccaccgccggcgggttcgccactaagccctctagcaacaacccatccgccagcgtcggctgtagcaggtacggcaagcactccgatgaaggccccctcaactactgcgagtacggctcctccaggaacgactcggagaagtacctgaaagaggagaaggagcacaagcacaatgagcacctcggcaacataggcacccttgccgtcggagccttcgacctgtacgagaggcaccatgcgaagaatgacccggagcacgcgcagcatgcacaagatcgaagagggcctaactgctgtggctgccctgggcaacagccgcttaacgttccacgagcaccacgacaagaagaggccaa

SEQ ID NO: 45357 - DNA, 391 bp, Zea mays
  Clone ID: LIB3066-004-Q1-K1-F4
ggcacacgtctgctgcctcgtgttcttgcttgcgatggaggatgcagttgggctaccgatggatggtgcctgcgctcggctagacaccagtggcgctaccacggccgtctacattaccgtccatcacatcgccgtgttcatagaggccatcgaccttttcgacggggacggtgacaggagcatctcagccagagacctcgaagctgacgtgcgatcactgggtcagaactccaccgaggatgatctccatgacatgaccatcgaaggctatactgacggctactgcactatcgatttcactgagttgatgcacctcatggtcagcctgatgaaggacacggacttgtacgaggagctcaacgacgactgcatggtgatcaccgacgaccac

SEQ ID NO: 45358 - DNA, 369 bp, Zea mays
  Clone ID: LIB3066-004-Q1-K1-E12
cccacgcgtccgcccacgcgtccggcgagtgcgtgcgttcgtgcagccacagacaggcgtccgggcaccatgtctttcaccggcacgcaggacaagtgcacggcgtgcgacaagaccgtccacttcatcgacctcctcatgccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctg

SEQ ID NO: 45359 - DNA, 425 bp, Zea mays
  Clone ID: LIB3066-004-Q1-K1-F5
gtggagttcctggggactttcgcgagcacggtgcacctgagcgggagactctggctcgctagcatgatgatcggctcgggaagcctgctgatgggcgccggcctcaagttcatccctgtcgatccgggcagtgaaggctcgtctgaccgccacgatgggtaccagcccatccccaccggccccaacgccgtgtgatttccaagaagacctcctgccatccttcttgatttttatttccttctatagaaacaatagaactgaaccctcggatgcgtttgcagtttggggaaaaaaaagatgttttagataggagcgacggttgcatatgatggccgtcctcaagaattttaatcctcgtctcttggctattttgtctttgtagccggcaatgttttgtttctgaatttggatgatagaatcgatgt

SEQ ID NO: 45360 - DNA, 427 bp, Zea mays
  Clone ID: LIB3066-004-Q1-K1-C6
cccacgcgtccgcggacgcgtggggaaaaatccaagaatcagactgagatattgctagaactttctgcttcacaagccgaacaagagtcgttgagacaagaaattgaagaattgaaattgtctttgaaggtggctactgaacgacaaatagttggtggaatttccaaatctggtgatgcaatagatgtccaatttgagctaaaagatgaggtacagtttttgagggaatcaaatgaaaacttaacaatgcaactgaagaagagtcaagatgcaaatatagagcttgtttctattcttcaggaactggaagaaacaatagaggcacaaagaacaacaatctccaatttcactcaaatgagtaatatgattgatcaagatatacccacgaatgcattatcagcgcaagaggatgcagagtgggaaagaa

SEQ ID NO: 45361 - DNA, 393 bp, Zea mays
  Clone ID: LIB3066-004-Q1-K1-C7
aaggcattacttatccaagaacatagaatgaagaagagaactgcagaaagccgtcctagggtccctagaaagtttgacaaagataggaaattcacaactgataggatgggacgccagctttcatccatgggtatggatcctagtgctgccatgaatagaattcgcagtcagtctaggggtcgcaggcttgaaaggtcattgagcaaagctgcaccgaatggtgcacggttggatatagatggccagcagagcaccggaattgcgtcggacatttaggtgtaggtctagggctaggtgacgtgctcccgaggaagtgctttctggagaaagggtcaagggctctgagcacaagaaaaaggctatcaagaaagcacaggccgctactaggaacag

SEQ ID NO: 45362 - DNA, 425 bp, Zea mays
  Clone ID: LIB3066-004-Q1-K1-C8
cccacgcgtccgcccacgcgtccgcggacgcgtgggctattttcctccttcactgcaccacttgagtttgctctacatgggaacaaatgatatgcaaatactgtttccatatgctactgcacttaagaagttagaccttcagtttacattcctttgcacagaggatcattgtcagatagttcaacgctgctccaatctggaaaccttagaggtgagggatgtcataggggatcgtggactacaagttgttgcacagacctgcaagaaattgcataggctcagagtagagagaggagatgatgatcaaggaggtcttgaggatgaacaaggtaggatttcacaggtggggttgatggctatagcccaaggctgccctgagttgacatactgggcgatacatgtatcagacattacaaatgcagctt

SEQ ID NO: 45363 - DNA, 360 bp, Zea mays
  Clone ID: LIB3066-004-Q1-K1-C9
cccacgcgtccgcccacgcgtgcgcccacgcgtccggacgacgtgccctcccggcgtgccccggtcgtcctgccgtccggggatcgatctggccatgggacaacactgagatcctcgtcgtcgtgagccgaacgttaatccggcggacgcgatggcggcgccatatgctgcagacgcagataggatgacaatcacgtacgccgtcgatgacaactgaccgatggtgcggccataccttgaaagctgtcaggacacgttagcagaccttgggtactctgttgtggccgtgtgcatcgacaaggtcgagatcagccagaacactctcaagagggccatcgactcgctggtacagaatgggca

SEQ ID NO: 45364 - DNA, 415 bp, Zea mays
  unsure at all n locations
  Clone ID: LIB3066-004-Q1-K1-D1
gacccacgcgtccgcccacgcgtccgagtcgctcaaaaccctagagctctcgcctgctggcctccgccgccggagcgagctccccatcttcatccgtcaaccatggcgacccagatcagcaagaagaagaagttcgtcagcgacggtgttttctacgccgagctcaacgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctncgtcgtccagaagaggttcaacttccctgagaatggcgtagagctttacgccgagaaggtcgtcaaccgtggcctctgtgccatcgcgcaggccgagtccc

SEQ ID NO: 45365 - DNA, 352 bp, Zea mays
  unsure at all n locations
  Clone ID: LIB3066-004-Q1-K1-D10
cccacgcgtccgttttttttttttttttttggtcaaattatcgtgtcctcctctttattgccgacacaaaaaaaaaggttaaattttttgattggtttacaacaccatgcaaggggaagaaaaattgggcagaacatgaatggcattgttcagcttccatttctatgctcctgccgtccaaatcttatgccattagataacctccaaactgattggctctatactagctatatcccgctgcagagccttaagtgcatccacagaatagccaagaaaggaagccgaaaaattccccgaggagagccggaatattaaggatgttttgaagggaaaaaaagatnaaaatgagagc

SEQ ID NO: 45366 - DNA, 362 bp, Zea mays
  Clone ID: LIB3066-004-Q1-K1-D12
ctgggatactgccgggcaggagaggtatcatagcttggctcccatgtactataggggtgcagctgctgccattgttgtctatgacatcacaaatccggcctccttcacccgtgccaagaaatgggttcaagaacttcaagctcaaggaaatcagaataccatagtggctcttgctggaaacaaggctgatatgctagatgcgaggcaagtgccagcagaggaagcaaaggcgtatgctcaggagaatgggctcttcttcatggagacatctgctaaaactgcaatcaatgtgaatgacatattttatgagattgcaaagaaattgcttcaagggcaacaagctccaagcccacaggctggaa

SEQ ID NO: 45367 - DNA, 429 bp, Zea mays
  Clone ID: LIB3066-004-Q1-K1-D2
cccacgcgtccgggcgccgggcctggccgtgttgccgatgcgggtgatggcgtccgactccatcgcctcggtgaagctccgcgtgcagacgtcccggggcgtgagggcgcgcaagcagaagctcgtcttcggcgggcgcgagctggcgcgcgacgacgggcgcatccgggactacggcgtggcggacggcaacgtggtgcacctggtcatccgcgtcccggacgtgcgcctcatcaccgtggagaccgtgcagggcggcaagttcaggttccgcgtggagcccgggcgcaccgtcgggtacgtgaagcagcagatcgccaaggaccaccccgcggcggcgcgccccggcgagcagcggctcgtgctcgagggcgaggacctcgacgaccggcacctcatccacgacgtgtgcagggccgacggcgccgt

SEQ ID NO: 45368 - DNA, 425 bp, Zea mays
  Clone ID: LIB3066-004-Q1-K1-D3
caacgcggacgtgctgagggccacgacgcggcgggcgctggcgaggtacgatggcccgtgcatggcgaccaaccccatcgaccggtgctggcgctgccgcgccgactgggcgacggaccggaagcggctggcgcagtgcgcgcgcgggttcggccacaggagcgtcggcggcgcggccggcaagctgtacgtggtgagggacccgagcgacgacgagatgatcatcccgcggaagggcacgctgcggcacgcggtgatccaggaccggccgctgtggatcgtgttcgcgcgcgacatggtgatcgagctgcggcaggagctgatcgtgaaccacaacaagacgatcgacgggcggggcgcgcaggtgcacatcatgttcgcgcagatcacgctgcagaacgtgcagaacgtgatcctgcacaacc

SEQ ID NO: 45369 - DNA, 411 bp, Zea mays
  Clone ID: LIB3066-004-Q1-K1-D4
gcccgcccaaccatggcggcggcggcgcccgtgcgcgcctgggtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgccgccgcgcccgacgacgtcggccacgacgacggcagcgactacaacgaccccgacgtgcccaacaacgaccagctcgtcgtcgtcggccactgaaagctgccgcgcgcgcgcgcgcgccgacccgtggaccatgcgtgcatg

SEQ ID NO: 45370 - DNA, 374 bp, Zea mays
  Clone ID: LIB3066-004-Q1-K1-D9
ggtgatccagcaaagaacgaggacaggaggaggagaaaggagcgaaaggagaaaggccgcccagaattcgacaaggttgtcgagggtagtcgggttataggtgatccagcaaagaacgcagacagagttataaacaacgggtgggcagctggacggcttacctcgacgattgcaggagaggaaaatttcgtcttcagctctaacagcgtacttaggcaatgatctagttttgttttcctttatctatacattgaaaacggtaaataatagtcttgcggatccaatagagatatcgttggggcttgggcatttatagcgaagttctgtcaagaaaagagaattcactctatataggttggatttgaagatttaca

SEQ ID NO: 45371 - DNA, 428 bp, Zea mays
  unsure at all n locations
  Clone ID: LIB3066-004-Q1-K1-E1
gggacttcctcgactggctcggcccggacatctccaccaccatcttccagctcctccacgaccccgcggacctcgcccgcgtcgccgccgtctcccgctcctggcgccgattcgtcgccgtgaacaaattcagcaagcacctgtgcaggcagatatgtccggaggccgccagcttcacccgcgcggtcgtggtggcccgattgccgccgccgccgccgccgccggcgcacgccgcgtgcgagtccagccaggtcgccgagtgcagggcccgcgatggggagcacgcggcctactcctacctcgccggcgcgctcgtctccggcaagcccgccacggacctcgtcatgcgctgcgtcggcgcctncagcaccgacaacttccctgacgagaccatcgagaacacgctcgtgccgcacgacatggttaac

SEQ ID NO: 45372 - DNA, 403 bp, Zea mays
  Clone ID: LIB3066-004-Q1-K1-E10
aggagctgatggaggacccgggggacaacaacgccttcggagacgccaaccagaacgagctcttcgccagcatcgttaactacgaccaggagaacatgctgcccgacgtgtctgcagcggacgttgctgcagggaaggacattcaggggatcccgtgggagaagatgctcttcgggagggataagtaccgggagatgaagatgaagaactacagaaattaccagaatctaagttacgcacgggaggatgctttgcaggagtgcaaacaagtgacgaaagatagtccttactatgatttccactacaacacaaggcgtgctcggccatcaattgtacaatttcagctacggaacctagtgtgggcaaccacgaaacatgatggttatacaatgcatgatcaatc

SEQ ID NO: 45373 - DNA, 423 bp, Zea mays
  unsure at all n locations
  Clone ID: LIB3066-004-Q1-K1-C5
aacatctccggcggccacgtgaaccctgccgtgaccttcggtgcctttgtgggcggcagcatcagcctcctcaaggccctggtctactgggtggcccagctcctgggctccgtcgtcgcctgcctcctcctcaagatcgccacgggcggcgcggccattggcgccttctcgctgtcggcgggcgtcggcgccatgaacgccgtggtgctggagatggtcatgaccttcggcctcgtgtacacggtgtacgccacggccgtggaccccaagaagggcgacctcggcgtcatcgcgcccatcgccatcggcttcatcgtcggcgccaacatcctggcggngggcgccttcgacggcgcctccatgaaccccgccgtctccttcggcccggccgtcgtcaccggcgtctgggagaaccactgggtg

SEQ ID NO: 45374 - DNA, 372 bp, Zea mays
  Clone ID: LIB3066-004-Q1-K1-E11
cggacgcgtgggttcccagatccatcgactcgctcgggccgcccctcccgtcgtccccgttcgaaggtgcggcagccggcaggcgagcgatttcattcgacatgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccataaaacttcaaatttgggatactgctgggcaagagcgcttcaggacaatcactagcagctactaccgcggagctcatggaatcattattggatatgacgtga

SEQ ID NO: 45375 - DNA, 432 bp, Zea mays
  Clone ID: LIB3066-004-Q1-K1-B1
aaaagatgagctgatcaaacagctcgaagaacaattgaaggaattgatggggcagaaagaaaccgttcagtctcaacttgacaattttcgtagagttgcaatagatgaaaattttgatgaccatgcaataagacaatgggatcaacgaaataggtcttcagagtcccttccacataatgtgtctgaagatgctctttcttcttttgatacttacgatgttgtttatggagaacaagatggtctaggcccaaaagcatttgatgtacatccaatatctatcttgcatcaaccaagaaaccatatttctgataacattcagatatatcaaccaaataaggaggcttcctcagaggtctctgaggagcattgcaaggaagtccagtgcatcgaaacaaatgagcttaggaggagtccattattctttcctgttga

SEQ ID NO: 45376 - DNA, 379 bp, Zea mays
  unsure at all n locations
  Clone ID: LIB3066-004-Q1-K1-B10
cccacgcgtccggaataaactatggggcaagccttcccacggcttgtcctcctcgccctcgtggcgttgttgtctgccggcctcttcccgcaggcgttagggaacggcaagggcaaggtgcatggcggcggtgccgtcaacccgctggttgccggcatctgctctcgcgccccattcccagaggtttgcacggccacagccgggcgccatgcatccaagtacccggtcatcgaccatttggccgtgctgaacatgcaggtggccgcgttcgccaagcgcacagcgcatgcgcggaagcacgtcgcggtggcggcccgcactattccaccgncgcaggcacaggccctcagaacctgcgacacgatgtacatgaacacgc

SEQ ID NO: 45377 - DNA, 426 bp, Zea mays
  Clone ID: LIB3066-004-Q1-K1-B11
cccacgcgtccgcccacgcgtccgctcaaattgcagctgatcaacagctctatgcaatggtccgtcctggtttttggatggatgttgggcagccaagagactacattactggattgcgtctttatctagactcgcttaggaagaaatcggctgccaggctagctgctggagcacatgttgttggcaacgtgctggtgcatgagagcgccaagattggagaaggttgcctgatcggtcctgatgtcgcaattggacctggatgtgtcgtggaggatggcgtgaggctttcccgctgcactgtcatgcgtggtgtgcgtatcaagaagcatgcctgcatctcgaacagcattatcgggtggcactcaactgttggacaatgggcacggatagagaatatgaccattctgggcgaagatgttcatgtgt

SEQ ID NO: 45378 - DNA, 351 bp, Zea mays
  unsure at all n locations
  Clone ID: LIB3066-004-Q1-K1-B12
cccacgcgtccgcttcgcgcctaggggcggaaggccgccgtgccggttcttcccagctgcagcaaccggccagtgcgcgcggttgcgttgcatttgcatggctgcgcgctgcgctctgggagcttgcactagcgggtcggcggcctaggcgcggggcatctttcgagtgcgtgcgtgtctgttcaagctctgatcgtctctccggcccattcgccggaggaaactgaccgccgncttctcgctctcgctctctaccctattcccggggctgaaaagggaggagagaaagccacgtccacaccataaagcaggacgtacagacacgtgtacgagggggatcacggtcgggtg

SEQ ID NO: 45379 - DNA, 403 bp, Zea mays
  Clone ID: LIB3066-004-Q1-K1-B2
cccacgcgtccggtcccaggatacgctgccggacatggcagccgacgagcaaccgccggaaccggcgccaccgcaagacggggaaggagaggacaactaggaggaagggaccgccaccaatatatatcacacacacacacactcacacattctcacactcaagtctgcgtttgccatttttcttttctttttctctacgacgcttcgttattccctcctttcatctatctctccgtgaactcggtttgtcgtccagctggctgtaagtgtaccagatgccttcgttacgtctgatgaagctcatgacaatggcgattttggcatggagctgtgttagcctcgcggaaaaactgtaactgtgtaagcagaactgctatatattggtcctaacaatgttgtcctt

SEQ ID NO: 45380 - DNA, 404 bp, Zea mays
  Clone ID: LIB3066-004-Q1-K1-B3
gaattaaggaaaataacaggagcgaactccagcgactagacagcgaaaggaaagaagaattcatgaggatgctaaaaggatttgttgcaagtcaggcggcctacgcggacaaaatcgtggatggatgggagacggtagcggaggaaacgagcggttatgttggtgtgcgtggatctgatagcatgacttcgtagcttcgtttggttggatgtcaagtgtttgtacaatgtaatctaggttatggatttgggaatagaagaaaggtgcgccaggttcgatttgtttgtataatcaaataaaggtactgccatggagccacgatttcacgtcctggatgtcaagtatacgttgttcttctgtggatatcacaaatacatcattgctccggttcgttccagagcagg

SEQ ID NO: 45381 - DNA, 422 bp, Zea mays
  Clone ID: LIB3066-004-Q1-K1-B6
cccacgcgtccgacttgtttgattatttgcctctcacagctcttatagaaaatcagatgttctgcctacatggtggtctctctccatcactggatactttggataatgtccgctcccttgatcgcatacaagaggtcccgcatgaaggacctatgtgtgatcttttgtggtctgacccggatgacagatgtggatggggaatttcaccaaggggtgctggatacacatttggccaagatattgcacaacaattcaaccatacaaatgggctaagtcttatttcaagagctcatcaacttgtaatggaagggttcaattggtgccaggataagaacgttgtgacagtgttcagcgcgcctaactattgctaccgatgcgggaacatggctgcgatcctcgaaattggcgagaacatggatcag

SEQ ID NO: 45382 - DNA, 424 bp, Zea mays
  Clone ID: LIB3066-004-Q1-K1-B8
gaagacagggcacgcactcgtcgttggcatctacgactagccgatgacgcctgggcagtgcaacatggtggtggaaaggctgatcgactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctcctccacgccataagatatctagcaattggtcactcgccttaattagttcgctttgcttttgaggttgattcgaccattttgctgtagcgtgaattgcatgcatggacatgcaacgctccaatggcctttggaatgtggaatttttttccccattttctgtatttttcctataaaaaatgaactggttcttatataa

SEQ ID NO: 45383 - DNA, 332 bp, Zea mays
  Clone ID: LIB3066-004-Q1-K1-B9
catcctcggttgcagccggagttcttgacgacggtgcccaacgaggaatagaaaggagggaaggaaaaaacgcgtctctgaattccacacggccggcgaagacacttgaacagtcttgctggcaatgggaaacaagggaccagtgccaacacaggaatcgacgaatgatgacgccgaggcaccgtcgtctacgtctgctgcgagcaatactaagagcaagacagacgtggagcgagagcagctgttcgaaggatcaagcgacgacgacgcccacacgccacggaagagaagcacccaggagatcctcaccaaatacaagttcaaaggggacg

SEQ ID NO: 45384 - DNA, 399 bp, Zea mays
  Clone ID: LIB3066-004-Q1-K1-C1
ccaaatgtctgtgacctctagaacacggagcgctgtgaagcctgctgcccccatgatgaaggccggacctcttgtcgtcttggtgcgcgcgctcggtttcccttcctttttccctcgcgcgcggccaacctagaaagcgacggcggagccggagagggaaggggaggcgggccggctggtcaagggcggacgatgtgctgcggcggcgacggggagtgccggccgctcgggtggctcctgggcctgcccttcgcgctgctcgccgtcctcgtctccttcgtcggcgccgtcatctggatcatcgggctgcccatctcgtgcatctgcccctgctgcctctgcgtgacggtgctgctggaggtggccgtggagctcgtcaaggcgccgctccatgtcatg

SEQ ID NO: 45385 - DNA, 360 bp, Zea mays
  Clone ID: LIB3066-004-Q1-K1-C10
gaggcatccggatccatgtccgcaggcatcgccctgccaccctccaacgccggagcgcgctcctacggggcggcggcgccgttcggaggcgccgcggacgcacccgccggcacctccgagggccctgccagcgccagcgggccatcggctggtgacgccccggcgtatggcgccagcgccagcgccagcggcccgactgctgatgctccggcgacggcgacggcggcggcgtcgtccgggccctctagcgcacccgcgccatcgtcgtctgagtcctccggcgcaccagggccgtcgtcgtctgatgggtcctccggcgccccggcgccatcgtcgtctgatggggcctccaacgccccg

SEQ ID NO: 45386 - DNA, 384 bp, Zea mays
  Clone ID: LIB3066-004-Q1-K1-C12
ctccctcgctaggttcctcgtccgcctctctgtcctagtctcgtcagcaacagcacagtgttggtactgacgcgccttcactctgttgacctgcatctagccaagtttatttggagactccaacctttggtctcccaaacttggagctcccaaggggagaggttctgccaaaattttggcttctgagcatccattttcaaggggaggttctgccaaaatctgctcctgtgaacatagatttctcaaggggaggttctgccaaaatttcctactgtaaccaccagctttccagggggagattctgccaaaatttcctgcactgatcatcattcttctaaagggaggttctgccgaagttttcttgtgtgacgacgacgatcagtt

SEQ ID NO: 45387 - DNA, 429 bp, Zea mays
  Clone ID: LIB3066-004-Q1-K1-C2
cggacgcgtggggcaacatggaaggctcaggtcgtcgcatcaatacgtggtgcacgtggagaaggctacctcaccggcaagaccaagatgcctgccgctgaacttgtcagcaaagatggtgacaaagttgccaactctgcctacgaagattggctagcttcggaccaacaagtccttagtttccttcttgcctctgtctccaaggatgttttgatccagattgcgactaagcacaccgcgacggaggcatggcatgcaatcgagaccatgttctcgtcacaaacaagagctcgggcagtaaacacgcgcctggctttatccaccgcccacaaagggaacatgtcggtggccgaatatgtcgggaagatgcggtctctcggcgatgaaatggctgcagcaggacgacctctcgaagatgaagaattggtg

SEQ ID NO: 45388 - DNA, 362 bp, Zea mays
  Clone ID: LIB3066-004-Q1-K1-C3
cactgatccaagacaaaacatggctgtgaatgtgagcaccatgtggtcgttgatgcagggacaagttgccatgggtgtggcgttggcctttttggtgaaccgcgccttgtgccgtgcttcccaaagtcccccctggcaagaacatcacggccacctatggcaaggactggttagacgctaaagcaccatggtttggcaagccgacggttgccggtcccgacgacattggtggcggttgcgggtccaaggacttgaccacccccctttaatatccatgcgcgcgcggggaaatatccatatttaaaggtaggctctgttttgggggccgcgtttagatctaatgcgctaagcttgtggagtgc

SEQ ID NO: 45389 - DNA, 430 bp, Zea mays
  Clone ID: LIB3066-004-Q1-K1-C4
cggacgcgtgggcggacgcgtgggcaattgcaagaggagcaagataccaccaccgtagcgaccacacgcaggtacgaagaaggcgacgaacatggcgaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgtgtgtatatattacacacatgcattatacat

SEQ ID NO: 45390 - DNA, 250 bp, Zea mays
  Clone ID: LIB3066-004-Q1-K1-A9
gccgtcgagcgagcagtctcccaatgccacccaataactaataacatctcctcgaacggcaggttccttggaccactatatccaggagcgacgaagtgatccacccgccagccatggagatgaagaaggtcctctgcgccgccctcgtcgacgacgactctgacaccgtcgtgctggcctcggtcgactgctaggcgctctccgaggcgcccgcacactccgcctgtggtgcggctggacctaacgcaag

SEQ ID NO: 45391 - DNA, 428 bp, Zea mays
  unsure at all n locations
  Clone ID: LIB3066-010-Q1-K1-F2
gcaaacgcaaacaagaagcaaaccagcaatggcccgcgcctgcgtcttcctcgtcgtgctgctcctagccgccgtcgccatggcgccgttcgcgggcgcggcgcgcatcgacgtcgtcgagggcaggtccatggcgtccgcggacgcaccggaggccgncgccgacgctcccgctcctgctcctggccccgactcctcctcgaccccgtcgccggcaccctccagcagcagctcttccgactagccgcccggcagagatatctacggcgtccgatcagtctttggcgccacctataacctatcggatcctgcaaagctatatatgattctatggtataatgtgtggttgcggcaaacgcgcggaaataatgtgcttgcgtgattgtttttctctctctttttttgtttaataatgtaaaacaggcata

SEQ ID NO: 45392 - DNA, 431 bp, Zea mays
  Clone ID: LIB3066-010-Q1-K1-F3
aaaggcggctgctgcggctgcctgtgctggtgctgctgcttcctgttgttcatcgtggcggcgctggccggcacggccgcctacttcttcttcgtgtacaagcccaaggcgccgtcctactccgtgagcaacatgtccgtctcgcagttcgacttcagcacctccgacctgacgctgtacgtcaagctcaccgcctccgtgcgcgccgagaaccccaacgagatgatcaccatcaggtacggcgagggctcccacaccgtggtctcctaccgcggcacgccgctgtgctccgggaagctcccggccttcttccagggctacaagaacgtcaccgtcatggacatctccatggagggccgccacggcttcgggtcggggctccagcaggcgctagaggagagcgagaaggccggggacatcccgctcgacat

SEQ ID NO: 45393 - DNA, 388 bp, Zea mays
  unsure at all n locations
  Clone ID: LIB3066-010-Q1-K1-F4
ttcaagaacatcaccggcacctcctccaccccggaggccgttagcctgctctgcagtgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagacccttcgtcgactgacccatctctctagttataattnttctctcgtccttgcattgcccattagttgctatccattggtaacgcacaacagtaaaacgacagacatccgacagctatattatgttcgacggtgtaacaccctgaatttgaaggtataaaatttcttctctaaataccaaccaaattcaggtg

SEQ ID NO: 45394 - DNA, 171 bp, Zea mays
  Clone ID: LIB3066-010-Q1-K1-F6
ccagctcgttggcccgggccctgggccccgggcgccctcacgcccgctggccgctgtaaatagcgttcggcgttcctgtctccacccatcccaagaagagccgccctacctattccttctccccgccgccgacctgccaaaccaaaacaaccagcagccttaacttctttc

SEQ ID NO: 45395 - DNA, 162 bp, Zea mays
  Clone ID: LIB3066-010-Q1-K1-F8
tcgacgcaagccacccgtccacaacatcatcggcacctgctctacccctcaagcccttagactgctcttcacggccagggacacatgcaccggcgtcaccatagatgacttcaacgacgactatacctacaccaacaacaagaccatcgctatattcacgaa

SEQ ID NO: 45396 - DNA, 432 bp, Zea mays
  unsure at all n locations
  Clone ID: LIB3066-010-Q1-K1-G1
gccgccgcccccagtccccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgtcgtggaacccaagttctaccctgccgacgacgtcaagccccgcgttcccagcacccgcaagcctaagcctaccaagctcaggtcgagcatcacgcctgggacggtgctgatcctcctcgcaaggcgcttcatggggaagagagtggtggttctcaagcagctcaagttcggcctgctccttgtctcttggcctttcaagatcaatggagtaccgatccgncgtgtgaaccagacctatgtcattg

SEQ ID NO: 45397 - DNA, 417 bp, Zea mays
  Clone ID: LIB3066-010-Q1-K1-G10
gaaggatatagtggaagtgatctcaagaacctgtgcacgacggcagcatatcgcccggtgagggagctaatccagaaggaaagaaagaaggagctggagaagctgaagcgtgaaaaaggagaaactccatcggatcttccgaagaaggaagagaccatcaccctaaggccgctgagcatggcagatctgaaggaagcaaagaaccaggtggatccatgccttaccaagtgcaatttgaaacgatgcggatgcagattaacacttttcaacttgaaaaataaactaatggcagttcgaatgttataataccctgtaaactctcaaattcaggtggctgcaagtttcgcttccgaaggtgtctgcatgagcgagctgaagcaatggaacgagttgtatggtgaaggaggctccagaaag

SEQ ID NO: 45398 - DNA, 173 bp, Zea mays
  Clone ID: LIB3066-010-Q1-K1-G12
acgcgaacatatactcgtacttattctcataaccactacacgactacagccagtggccggtttacaaaactcattcttacatatacaaacatgcaactgcataaactgtatcattataaaagctaaactcacatccaatcttcccaactatacaacgaccataattctaaaac

SEQ ID NO: 45399 - DNA, 429 bp, Zea mays
  Clone ID: LIB3066-010-Q1-K1-G2
cggacgcgtgggtgccaatgctatgtgggaagactatcatgcaaacactatttgatggttatgtattttccagtatctctatcatttgtatggacatgtatcttttatttgtaaggacatctatatgttattcgtgtggacatattgctaaattttggaagtatcttttatttgtatggacatgtatcttttatttatatggacatctaggtcatggataaggagacaagtggtgcaaaagctggtggtggactatgtcaatggacaccaactcaatccacatttgttctcacctttcttagcaacattgttgctgatggcactaaaacctgcactggcttcaagaaagttcatctcaatgcttgtgctaaggctctcaacgaccattttaaaattataaggacaggcgatcaagtggctaatcacttg

SEQ ID NO: 45400 - DNA, 435 bp, Zea mays
  Clone ID: LIB3066-010-Q1-K1-G3
cccacgcgtccgcaggggcatcgcccgggagttcgtggacgcccacaacgagctccgcgcgcgctacggcgtgccgcccatgaagtgggacaaccagctggcgcggcaggcgcggcgctggtccaacgccatgcgcaaggactgccagatcctccacagcggccacgagtacggcgagagcgtgttcaggagctacgacgactggaacgccaccgccagggaggccgtcttctggtggggcaaggaggaggccatctacgacaaggacaaggagaagtgcaagtacggcaaggtcttcaaggagtgcggccacttcgcgctcatggtcggcaagaggagcaccaaggtcggctgcgcacgagccgagtgcttcaagggcggcgtcttcatcacctgcaactactatgcaacggacctggacaagaacaagaacaa

SEQ ID NO: 45401 - DNA, 105 bp, Zea mays
  Clone ID: LIB3066-010-Q1-K1-G4
agataactctccagctgatacagcaatgatacaaaagctcgctcgaagaatcgaatggatggagcactgagaggagcccatgaattgggacagccaggtggcgcg

SEQ ID NO: 45402 - DNA, 429 bp, Zea mays
  Clone ID: LIB3066-010-Q1-K1-G5
cccacgcgtccgcccacgcgtccgatctacggcaaggccatggagcagctgaccggggcaatgggcgcctccgagagctgcgaggacgcgtggaagggcgaggaggaggatgtccccgtcgccgcgcacgacagggagtacggtcggatggcgcacatcgccttcggattcacacaccacgccgccgtcgccgtcgccgccgcatgaatcgattaattattatatatatatatgcatgctatctactatgatcgatcgcttctcgaccttcttgcatcgatctgcatgcatattataatttatattatattgatgccacgccgcatgcaggtctttccaaggcgtacgtactatatcaaattattttaatttccttacatgtatatgtatgtgctgctgttggatacgtacgtatattatatatgttct

SEQ ID NO: 45403 - DNA, 378 bp, Zea mays
  Clone ID: LIB3066-010-Q1-K1-G6
cccacgcgtccgaccaactgtccattaagaatgagaatcacttgctgcaggacttggttttagatgaaaaccacagcctgccagagattgatagtgatagtgttggatcacgattgcaggataaaagaagtaggcgcaatgaggagtcattttcattcacaagctctaacagagaaagttggggcagatgttcatctttaggagcagccagtgatgaatcattctcaggcgataataatgataagcagaatttgacagtcaaggctatggctacgcctgtaagacaaaaccagaggcaaagccagaggaaaccgattgagaaaactaaacagaagaagattcaagccctatggaagaagattaagagcgaaaaggtgg

SEQ ID NO: 45404 - DNA, 427 bp, Zea mays
  Clone ID: LIB3066-010-Q1-K1-G7
cccacgcgtccgcccacgcgtccgcccacgcgtccgcccacgcgtccgcccacgcgtgcggcggagaaggagactgccgccgccgccgcaacctcgaaggaggaggaggaggtggagtcgcccaagaaaggagcggctctgtcgccggtgccggaggctatcgtcatcgccaccgccgcaacctcgaaggaggaggaggaggaggaggtggtggagtcgcccaagaaagaagcggctctgtcgccggcgccggagcctatcgtcatcgccggcgcaacctcgaaggaggaggaggtggtggaatcgcccaagaaagaagcggctctgtcgtcgccgtcggcgccggaggccatcgttgccgtagcagcagtggaagacgtggtggcggacaagttcgtgacggttgtgaaggaggcgatcaagaagc

SEQ ID NO: 45405 - DNA, 100 bp, Zea mays
  Clone ID: LIB3066-010-Q1-K1-G8
tcggccacgcgtccgaccaaccgtccattcataaggaaactcacacaatccaagggtctgtacaatatgaaaaacaataccctccataacttgatagtga

SEQ ID NO: 45406 - DNA, 431 bp, Zea mays
  Clone ID: LIB3066-010-Q1-K1-H1
cccacgcgtccgcaccgccgctgcacacaaacccagaaaccaccggcaataaacaagtcccgctcccagtctccgatccgaggaagccggaagaggggatttcgagccgcggcgatcggggctagagtggccctcgacgcgtccgcgggtggaattgccgagaagccgagagagaggggttggagcggagttgcgggaggtgggagagaaggcggcgatggggcgcctgttcctgatgcacctggacggcaacgtctacagctgcaagcactgtaagacccacctcagcgttgccagcgacatcatctgcaaggccttccagtgcaagcacggcaaggcgtacctcttccataaggttgtcaacgtgacttctggagtaaaagaagaccggatgatgatcacaggaatgcatactggttctgatatcttct

SEQ ID NO: 45407 - DNA, 339 bp, Zea mays
  Clone ID: LIB3066-010-Q1-K1-F12
cggacgcgtgggctccatgaaagaaatattgctcacagagacattaaatgcgcaaagattctgatgcatgcaaatggatctgtgaagcttgcagattttgaactcgctaaggagattaccaaattcaatgaacttaaatcatgcaaaggaactgtttattgcatggcaccgcaggttgttgatccgcagcatacatatggacctgcagctgatatatggagtcttggttgcactgtcctggagatgttgacacgccagataccctatcctgaccttgaatggtcacaagctctatacaggatctgtaaggcgtaatcaccatcaatttcaaacactctt

SEQ ID NO: 45408 - DNA, 133 bp, Zea mays
  Clone ID: LIB3066-010-Q1-K1-H10
cgcacacacaaccccgcatttttctccttacaagtccactcagtacacaaggtgccgttgcaaatttagttccggtttgctgtcaagctcttcctgcttgcccttcggtaagcatttctcggagaagacgact

SEQ ID NO: 45409 - DNA, 330 bp, Zea mays
  Clone ID: LIB3066-010-Q1-K1-H11
ggcgaaagaagcgtgggaggcggtgaggtcgatgaggatcggcgatgaccgggtgagggccgttagcgtgcaacgcttgtggaaagagtacgagaacgtcggtttctgtgatggtgagagcgtcggctacttctcgttgcggatcaacggcctcgtcgcaagccttcgagagatgggcgagacgctggaggaccaccgagtcgtgaagaagatcctccgcgtcgttcccaaacgtctcatgcaggtggccgtggcgatcgatatgctcacctgacctaacacgacgacgattgaagagctcttcggtcgactacacgttgctgatgacgc

SEQ ID NO: 45410 - DNA, 311 bp, Zea mays
  Clone ID: LIB3066-010-Q1-K1-H12
aggggatgtaacaacaacccctgttctagcaggtagtcgcccagaggatggggcaacgaccccttcccctggaatgcatgttgatgatgttgctggttccaacttcgttttcagtaataataacaacaaagcgaagaccctcctacctaccctatttgcttgagcggctcttgtccgcgccacaagataccaattgttgcgctgggaatattcagttacgatgacccgctttagttcagttttttttttgggggggttggttcgatcatttggctgtagcgtgaatcgcatggacaacagactgcaattac

SEQ ID NO: 45411 - DNA, 429 bp, Zea mays
  Clone ID: LIB3066-010-Q1-K1-D2
cccacgcgtccgcccacgcgtccgcccacgcgtccgggcccgatgtcgtctttcagggagcggacgattttcgactcgatgcggccggacccggccgtcatggctggactggagaagatgtccgacgccgccattccgccagcgaaatacgatactacgtcgccggccccgaatgcgctcaggtccccctgctgctgctgctgctgcgacacaccgaatacgtcgtgtatgtcgatgggtgacggctcgaacgggcccagctggttgcacgacagatatttcttacgctcctcgacgcgggtgagtgtgtccatgaggaatttctcgcacgtctcggcttcattcgtcaacaccaacaccgccggatctggctcgaacatcctaatttgcttctccaactcttcgacctgatgtctggattttctaatc

SEQ ID NO: 45412 - DNA, 418 bp, Zea mays
  Clone ID: LIB3066-010-Q1-K1-D3
gccacgcgttcggccaaattccccagcccacaccacctgcacacttcagttgtttcgggcgcaaagggttagggcttgctgtcggcgatgtcgagatcggcagccgtctgaggaaccggaggagcaggtggacctggagggggacgacgacggcatggacgactacgacgccgggtaccgtcgccgcggaagccgggacgactcgtaggagcccgaggaggatgacgacaatgactagcgccacggcgaggccgacgacgacgccaggatggagccggagccggccggaagtaaaggcggggatgacacggtcaaggggcccgacgtcgtcggtggcaggcccgaggacgaggaggataggagcaagtgggatgacatgctcgccctgccgacccatggctttgacgtcttcattggt

SEQ ID NO: 45413 - DNA, 422 bp, Zea mays
  Clone ID: LIB3066-010-Q1-K1-D6
gagggatacgccctcccccacgccatccttcgtcttgacctggccggtcgcgagctgaccgactacctgatgaagatcctgactgagcgcggctactccttcaccaccaccgctgagcgggaaatcgtgagggacatgaaggagaagctcgcctacatcgccctggactacgaccaggagatggagaccgccaagaccagctcttccgtggagaagagctacgagctccccgacggacaggtcatcaccatcggcgccgagcgcttccgctgccccgaggtcctcttccagccatccttcatcgggatggaagctgccggcatccacgagaccacctacaactccatcatgaagtgcgacgtggatattaggaaggatctgtacggcaacatcgtcctctccggtggcaccaccatgttccc

SEQ ID NO: 45414 - DNA, 385 bp, Zea mays
  Clone ID: LIB3066-010-Q1-K1-D7
cccacgcgtccgcgccagccagccatcgtcacactggtgagctctgcagtcggcactgtgcttagctccgagcttcagtgccttcgttgttagctgttagctccacagtccacagttccacacacacgtccagctgcactgcaccaatggccgccgtcgaggtccaggtcccgactgccgctcccgtcgaggaggctgctgctgctgctgcagcgggagtggaggctgcccagctggccgccgtcgagaccccgaacgaggagaccgctgctccggcggctgataccgaagtcgtcgccgctaaggagccggtgtcggccgaagccgagactgatttcaaggaggtcgaggtcgaggccgatgccgtagctgaagctgaaccgac

SEQ ID NO: 45415 - DNA, 418 bp, Zea mays
  Clone ID: LIB3066-010-Q1-K1-D9
gggttctcttcccttccctgagcaaatagaagtagccacaagcatgtctggggtcagcgacaatatccaggtgaggctccacatcggtggcgaccacaaggaggagcacgagcacaagaagggcgaggagcaccacatgaagggcgaggagcaccacatgaaggacgactgggagcacaaggagggcatcgtggagaagatcaaggacaagatcaccggctagcacggcgacaagtccggcgaccacaaggacaaagaccataaggagaagaaagattttaagaagaagaaagagaagaatcacggggaaggccatgaccatggtgatggtgactgccacagcagcaacatcagcgacagcgactgatctcgccttggcgaacgccgtacgcacaaatgcaccgcgcaggttataata

SEQ ID NO: 45416 - DNA, 431 bp, Zea mays
  Clone ID: LIB3066-010-Q1-K1-E1
caccacctcgcctgcgatctccgtagcctccgtcgcgtcgagcatcgatcatgtcgggctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaagccatgacgaccttggc

SEQ ID NO: 45417 - DNA, 423 bp, Zea mays
  Clone ID: LIB3066-010-Q1-K1-E10
cccacgcgtacgcccacgcgtccgcccacgcgtccgcggacgcgtgggtcgggccgggcctccctcacacaaataataaggaaaggtcccgcccttttcctccgacatccacaaggggggaggggaaaacacgtacattcacccggcggcaataatggccttggttccggctccggcgacgacgaccgccgtcgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcggacgccaaggtgaggctggagtgcaagcacttcggcaccggcaagctcgagcgcgccatcgacggggtcaccgacgcgaccggcacctacac

SEQ ID NO: 45418 - DNA, 391 bp, Zea mays
  Clone ID: LIB3066-010-Q1-K1-E2
gttactccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgtcggccttcaggaacggcggcggcgacggcgggtacaggcccgacttcggcgacggcaaccagtacacgccggccaaacggaagaagtgggccttctgtggctgctgaatcgaagctcgctgtgctgctgtgctgac

SEQ ID NO: 45419 - DNA, 431 bp, Zea mays
  Clone ID: LIB3066-010-Q1-K1-E3
cccacgcgtccgagcgaacgaaccagcgaccgacgctccccgaccagcgtggtgaagaggacagcagtcagcagccaatggaggcagcactgacgcagcaggcgacaccgacgaggtggcggtgcgtgggggacgcgtcgctggctagccatggccagggccagcagcgagcaggcgccgtccggctcggagcggcgcggcgtgcggtcagcggggctgtccgggctagcagcagcaggcatctgggccccgtgcgggcgctcgtctccgaagaggccgccgccggcgagcgggcggcggagggcgagggaaaggacgccgcggtgaggctgttcgtgggccttcccgcggacgcggtggtctccgacggccgcggcgtgggccggcccaaggccgtctcggcggcgctgcgcgcgctcaagctgctcggc

SEQ ID NO: 45420 - DNA, 341 bp, Zea mays
  Clone ID: LIB3066-010-Q1-K1-E4
attaactaatgcatgagctagcatggctggtaatgtcctaaccacttggacttcatggcgatcacatattgctagcgctgccgcacatggtgtgacgtggtgatcgcggcataggctagccctcccaatgtccttcatacgctaacatgccagtccactatggctggactgtctgtacgcgtgtacggacatggtatcatctgcctacctttgtcatgttatgaaacgacatttgccacgtggaactacaatgacccagaacactctggggctcctataacgtgtgctacatgctggcacatacgtatcagtgatgacggcttcggttgttggcaatgctt

SEQ ID NO: 45421 - DNA, 430 bp, Zea mays
  Clone ID: LIB3066-010-Q1-K1-E5
gacccacgcgtccgcccacgcgtccgcacgaatatacccatcccattccccacgagggtccgtcccttcggcggcggcggcgatgtctctcccccctggcccggcggacagtggcaccggcaccggagacgactggttcctcgactgcggcatcctcgacgacctgcccgccgcggcctgcggagccttcccgtgggacgcgtccccgtcgtcttccaaccccagtgtggaagtgggcagctatgtaaacgccaatgatgcattcaaggagcccaatgatgtcttcaaggagcctggcagcagtaaacgtttacggtcaggatccagtgatatgccaacatctaaagcttgcaaggaaagaatgaggaggaacaagctgaatgacaggtttcttggactggggtctgcattagaacctgggaagccagtg

SEQ ID NO: 45422 - DNA, 284 bp, Zea mays
  Clone ID: LIB3066-010-Q1-K1-E6
ggaccttgtcaggcgctacctcggcagcatcgtaccgcctggcgacaactaggatgccgccctcaattcagcggtgttcagcgacggatccttctgctacgtgcccaaggacacggtctgccccatggaaatttcgacttacttcaggatcaacgacaaggagacaggccagcttgagaggactctgattgtagccgatgagagaagctctgttagctatttggaaggctgcactgcaccagcatttgactcaaatcagctgcatgctttagttgtggagcttg

SEQ ID NO: 45423 - DNA, 412 bp, Zea mays
  unsure at all n locations
  Clone ID: LIB3066-010-Q1-K1-E9
gacgcattcagctcctcgttttttctctctcctctcttcgtccccgcgtggagaaggagagagagaaacaggggagcgccccccactcctcttcgctgccaagaaaccaccattcctaacggatttctacccagtcttctttaggatttccgattcggttctccggtgagagggtgggaattttattttcctccgctgcaaccggtgcaaacatttcgaatccctccattccattcctctccgtgcaatcgaccattcatatgttccttggctgcattgaggcatcggtacgcgaattttgatgtgagctgaccagacatggctgcgaaagacggctcgggatcacaagatctgggggggcacacgttctggcccatgctgtcctacgcttgcngcgagctgtgtgtgatcg

SEQ ID NO: 45424 - DNA, 418 bp, Zea mays
  Clone ID: LIB3066-010-Q1-K1-F11
aagtgatcttgccaagttacgagcagcgagcagagatcagatcatccatcgggaatggcgaacatcgggcagtccttgcaggccggcaaggctgaggcccaaggcgagtaccaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgccgtggcgggcgtcacgaacacggtgaccggcgcggcagcaggtgtcaaggacaccgtgaccggcggccactgatcgacgacccaag

SEQ ID NO: 45425 - DNA, 421 bp, Zea mays
  Clone ID: LIB3066-010-Q1-K1-D11
gtgggactacctgccgctcctgcggcggttcgacgtgctcggggtgaggaacgagagcagggacgttgtcggcaggagggacgccttcctgcagcggctcatcgacgcggagcggcggaggctggacggcgacggcgacggcgacgagaagaagagcatgatcgccgtgatgctctcgctgcagaagtcggagccggacgtgtacacggacaccatgatcatggcactgtgcgggaacttgtttacagccggaacggagacgacgtcgtccacgatagaatgggccatgtcgctgctgctgaaccacccggaggcgctgaagaaggccgaggcagagatcgaggcggccgtgggcgcgttccgcctcatcaccatggacgacgtgcccgggctgggctacctgcagtgcgtcatcaacgag

SEQ ID NO: 45426 - DNA, 419 bp, Zea mays
  Clone ID: LIB3066-010-Q1-K1-B12
cggggagagagcgaaaaacggggcgaccgagctagctcgccgtcgtttccggctccgctccctcctcccataccgttgccctacccccactaccgcgccccgcggccccgccgggtcctcctccctccgctcgctcggaaccagaggcctcgcgacgtctcgcgccatgcgggctcgcgatctgctagggtttcctccggcgggcgcggccatgtcgtcggcggcggcgctcctcctcctccccctcctcaccgtcgctggccaggggccggtctgccagaggccgcccgtcgccgccgtcatcctgcagcaggcgtccacctgtcgagcggtggacgccccagggctccggggtcaccgcgccggcttcgtggagggggatgatggggccctgcaaaaggcagtagcacttgtgctgc

SEQ ID NO: 45427 - DNA, 428 bp, Zea mays
  Clone ID: LIB3066-010-Q1-K1-B2
ccaaaacttagaggtctcttggacttggtttgaggttgaaaatcgcattgggtgctggaaagggaattttgtatctacatactgaagcagatccacctatattccaccgtgatgttaaggccagcaacattctgttggactccaaattcgttgcaaaggtagccgattttggtctctcgaggcttgctccagtgccagatgtcgaagggacattgccagctcacgtatccactgttgtcaagggcaccccaggctatcttgatccggaatacttcctaactcacaaactgaccgacaagagtgatgtttacagcctgggtgtcgtgttccttgaaatgttaactggtatgaaaccaattgagcatggtaaaaacatagtgagagaggtaaactcagcttgccagtcgggcgcagtttctggaataatc

SEQ ID NO: 45428 - DNA, 432 bp, Zea mays
  unsure at all n locations
  Clone ID: LIB3066-010-Q1-K1-B3
cccacgcgtccgcccacgcgtccgcccacgcgtccgcccacgcgtccgcccacgcgggcgcgatcctttagttgccaatttaaaggaacagtagaaggaataccgatttgatggcccaaaataagcagatcattgttgtggtggctctcctttttcttgtggtggcaacatcatcatcagtgtgggttgcagaaggagccgatgacttaaaagtttcttgcgttaaagagtgcacccaaaattttaacactcccgagggcaagaagatctgtgaaacgatgtgtgccaaccctaaaggaaggcctatcgacagagttagagctgattgatcaatgctcatctttatttgtagctagctatcatgcatgcgatgatggccttcttgattattattatttcattcctcatggtngttgttcttgcatgtttttt

SEQ ID NO: 45429 - DNA, 173 bp, Zea mays
  Clone ID: LIB3066-010-Q1-K1-B4
cgcactcttaatcgtattcatatctttatccaattgacatactcaaccattatactggcgagagactctttcatctacttacctcaacactataacatatacccaattcatatcctactatcagcatatacatattctcctccatattatcttcatcattaaccttacattat

SEQ ID NO: 45430 - DNA, 145 bp, Zea mays
  Clone ID: LIB3066-010-Q1-K1-B5
gcgcccacgcgtccgccgcaagttcgacaacatgtacatccgcaacctcgagcggggtggaggcctgctcagcacagacaaggcactgtgaacagacatactcactaagccgccggtgctaagctagtcattgaacgccacagtc

SEQ ID NO: 45431 - DNA, 212 bp, Zea mays
  Clone ID: LIB3066-010-Q1-K1-B6
cccacgcgtccgcccacgcgtccgcccacgcgtccggacgcggaatctcgacgtcaggctaaacaagaggggcagggtcgagatggatggcggtcagtactgtcgaagaggcacgctcgtcatcgaggcagagatcttcgaggtggctccatcggtgcgcgtggtggagatgtggaagattggccgagactcagatgagtaacgagcgttgt

SEQ ID NO: 45432 - DNA, 194 bp, Zea mays
  Clone ID: LIB3066-010-Q1-K1-B7
cgggagcgggcgccgaccggttctgcgtgctctcactggccttgactgacggggtgggtggcttacaagggaggcagactcacttggataacaggtccctgctgatcaactcgaactcctgacgaaattgtgaagcctgattctctcaaggcaagcaacgatgaatgcatgcccatgtatcataggcccttcat

SEQ ID NO: 45433 - DNA, 408 bp, Zea mays
  Clone ID: LIB3066-010-Q1-K1-C1
gcgccccggactccttctactaccagctgaagcggcagctgggcgagatggcccaggaccggtgcgacttcgccgaggaggaggagtcgcgggtggaggccggcctcatccacctgcgctcgctgcagaagcgcaccggcagctacttccgctacacgggctccctcaccgtgccgccatgcaccgagaacgtcgtctggagcgtcctcggcaaggtgcgccagatcagccaggaccagctgcagctgctcaaggcgccgctgcccgggagcgacgcgcgccccacgcagccgctcaacggcaggaccgtccaattctacaacccgtccaacagcaccatctacttccagatctaacactaaagagtactttggaatctttaatatagcggaactctgtttatgatta

SEQ ID NO: 45434 - DNA, 412 bp, Zea mays
  Clone ID: LIB3066-010-Q1-K1-C10
cccacgcgtccgcccacgcgtccgcccacgcgtccgatcgccagcaaagggagagcggcgaggtgagagagataatgcggtggtggtgctcatggtcgaatgaatgggggtgtcgggctatgcgcggttgacgtcctcatcgaagcaaaccccttcaccgttggttgcctcgtgccgtggcctgggaagtcgatgactgctcatcatggtaggaggccccgaccgaccgtgcaatcgtgtgccgacgctgtggctgtgcgccaatgaaatcacggtatcttcggatccaagtcggcatcacagtagaccagagtaatacgaaggttgatacagcgccgaaggtgtgagcaggaaagcttcggcgcgacaacaaaaagtgaaaccgacttaaagatgaaaaggctatttagac

SEQ ID NO: 45435 - DNA, 409 bp, Zea mays
  Clone ID: LIB3066-010-Q1-K1-C11
gatctttatattggcaggtggatgctttcaaaaccacgagacaagataattgtggcggccaaagttgccggttattcagagtggtctacatttctttgagacaatgcaaaagtggttcgtgttggtgctgccaatatcaaagaaagtattgaaatgagtcttaaacgcttgtctacagattacattgatttgcttcagatacactgggttatgttgtgtaccttgtctgtgtgaggcgtggtggtaggaagaggcctttgcccaagtgtattatctatggctagcccaagcaccagggtatcacccaactcaagttctagaggtacaagagctctctcgctgatgagagagctagacgcaagcttggtggactgaaggttcttaacttctactgggtgaacgaagtaca

SEQ ID NO: 45436 - DNA, 423 bp, Zea mays
  Clone ID: LIB3066-010-Q1-K1-C2
gcccaggcaacaagagacacgaataaagcatcgatcacaacaagatggcatgtatagacaatgcaatgagagccttgttccttctagcgctcttctgcaccgtgcatggtgagaaggcaaagtcaaaggacaacgattcaaaagcgtccgggcccggtgggtccttcgacatcaccaagttgggcgcctctggcaatggcaagacggatagcacgaatgctgtgcaagaggcgtgggcatcggcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatgggaattggatcgagattctacgcg

SEQ ID NO: 45437 - DNA, 309 bp, Zea mays
  Clone ID: LIB3066-010-Q1-K1-C3
cggagttggcaactgcaaggagtgatattgtggtacaacactagttctaattgaaggaatagggcgatgttgaaactgtctgctaccattgcttccatggcaactaatgagaacctcccgccaaatgtcatcaagcaattggctaaagaactgaagaaccttgatgagtcacctccagaagggattaatgtgattgtcaatgatgattacttaactactatttttgctgacattgaaagccctgctggaactccatatgagaacgtagtattcatgatgaagctattattgtcacgcgatttccctcaa

SEQ ID NO: 45438 - DNA, 426 bp, Zea mays
  Clone ID: LIB3066-010-Q1-K1-C4
ccctggcggcggcggcaggatggcggcttctactgcgaggacggtgaatgatgtgaacccgcacgagtttgtcaaggcctactccgcccatctcaaacgctccggcaagatggagcttcctgagtgggttgacattgtgaagactgcgaggttcaaggagctccctccttatgaccctgactggtactacatcatggctgcatctgtagcaaggaagatctacttgagacaaggcattggtgttggtggcttccagaagatttatggtggccgccagaggaatggctcacgcccacctcacttctgcaagagcagtggtgccatttcacgcaacattcttcagcagctgcaggagatgggcattattgatgtcgatcccaagggtggacggcgcatcaccttccaaggaaggcgtgatctggacca

SEQ ID NO: 45439 - DNA, 253 bp, Zea mays
  Clone ID: LIB3066-010-Q1-K1-C5
actacttcaagaggttgttcaacttcaagaaggatagggatggctattggaagtggtgtgctggcaacctggcctctggtggtgctgctggagcttcctctttgttttttgtgtactccctggactacgcgagaacaaggttggctaatgacgcgaaggctgccaagggaggaggtgaaaggcagttcaatgggcttgtcgatgtctaccgcaagacacataagtcagatggtattgctgggctttaccgtgg

SEQ ID NO: 45440 - DNA, 360 bp, Zea mays
  Clone ID: LIB3066-010-Q1-K1-C8
acgaagacgtgaggtctgctgcgctcaataccctaaacagggcaaggtttacggccggcagttattccttcattaaaactggtcacattcactccttgaaggaaggaaactcacactacacgatatttaatccaccttgccggcatgagccagtcgcaataggttcaaggcccggacaagcatttcaagagccatcttcatttcttgccatacgacctctgtatgaagatgagagatacatggtaacatataacccaacaaaggataaaatatatgcattgcttaatgaccaatcaaaattagacgacattatcaagctgctttccatactcatatgctattgcattttattaatgcatc

SEQ ID NO: 45441 - DNA, 257 bp, Zea mays
  Clone ID: LIB3066-010-Q1-K1-C9
cgcacgcttccgaacccaacaccctttcattaacgtgatccacatatcggaccgggctatctaagacgctgatcgacatactgaacccatcgaacaagcccggaggatcaccacacatcacaatgatggatgcacataatttcatggtctagttacctcaccttatcctcacggctctccatgctatacacaacgatatcttgatcactgacccgatatacagtatcaccatcaataatccttacagactaaacatt

SEQ ID NO: 45442 - DNA, 433 bp, Zea mays
  Clone ID: LIB3066-010-Q1-K1-D1
ggcaaatgctctcctaggtggcctgtgggcgatcgtcgtcgtcgcgcgcggtcgtcggcgtggtcgccaccgtcacccactccggcaagaaggccggcgacgacttcaccgtcccgggggaagcctccattgccacgtccggcaagtcggtcgagtccctgtgcgcgcccacgttgtacaaggagtcgtgtgagaagacgctctcccaggccaccaatggcaccgagaaccccaaggaggtgttccacagcgttgccaaggtggcgctggagtcggtgaaaacagcggtcgagcagtccaagacgatcggcgaggctaatgccagcgactccatgaccgagagcgcgcgggaggactgcaagaagctcctcgaggacgccgttgacgacctcaggggcatgctcgagatggccggcggcgacatcaaagtgct

SEQ ID NO: 45443 - DNA, 259 bp, Zea mays
  Clone ID: LIB3066-010-Q1-K1-B11
cacgcgtccggttcattcgacgcgagaggaattgagtgggcatgtatgtgatggtaaactgttcacggttcaaacttgaaagcgcactgattcaagggcaaaaaatggtgtcagcaggagctgcaacgtcacagttttttagatttgtttgagcagtttaacattatgtatgtttggttagatcgtttgtagatctatatatatattcacttaaatccacatgtgttggagtggtattggtttttatatttttttattt

SEQ ID NO: 45444 - DNA, 385 bp, Zea mays
  Clone ID: LIB3066-010-Q1-K1-D10
gcctgccgcgaggtggccggcggcaccgcggcggcctgttccgctgtgtgctgctgcttccgcggcgtgatggtgtacgtcgcggtgctcgccacggtgcgcgcgcccgcggcgctgcgccgcaaggccgcccgcgtgcgcaagggccgcaggcgctctgcctacgcgggccaggccacggagatatacgagctcctcgtggacgacaccggcgtcgtcgaggtggatgccggcgccgtcaatgcggtggcgctgcccgtgaagcccgccttgcagctgtaggaaaagggggagctggataaagaagtgctggccaggttctacggcaccggcttttggaggagcccttcgcagctggacgacaacgacgacaggtgatcgggac

SEQ ID NO: 45445 - DNA, 393 bp, Zea mays
  Clone ID: LIB3066-033-Q1-K1-B4
cccacgcgtccgcccacgcgtccgcggacgcgtgggcggacgcgtgggtcagcgggctgcaaagccgacgaggataaagaggagcccggctccgcacgcgggagcgagaggatcgccggcgcaggatgtggtgcgcatcgtgcttggcgtccgcctgcgcgggctgcacctgcaacctctgcacgtcggcggcatcggccgtgtcccgccgatccgcgcgcctcgcttactgcgggctcttcgccggctaccttatcctctacttcttgctccgtcagttcgccgagccgctcctcaagcatatcccatgattcactaaatttctgcatgtgctgaaggcttaagatgcagaacagtgatgtggagtgtccctttgctccacaaaatgaaatg

SEQ ID NO: 45446 - DNA, 419 bp, Zea mays
  Clone ID: LIB3066-033-Q1-K1-B6
cggacgcgtgggcgacatttcgaataacacaggtgagcgcgacgatgggatccctcgctaataacatcatggtcgtgggtgtcgtccttgcagcgctcgtcgccggatgctcatgcgggcccccgaaggtgccggccggtcccaacatcaccaccaactacaacggcaagtggctcaccgccagggtcacctggtacggtcagcccaacggtgccggcgctactgacaacggcagtgcgtgcgggatcaagaacgtgaacctgacaccctacagcggcatgaccgcgtgtggcaacgtccacatgtataacgaccgcaagggttgcggctcatgctatgaggcgagatgcaaggaaaaacctgagtgctcggtcaatccagtcacggtgtacatcactgacatgaactacgagcctatc

SEQ ID NO: 45447 - DNA, 421 bp, Zea mays
  Clone ID: LIB3066-033-Q1-K1-B7
cccacgcgtccgcggacgcgtgggcgatcacgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggat

SEQ ID NO: 45448 - DNA, 442 bp, Zea mays
  Clone ID: LIB3066-033-Q1-K1-B8
cccacgcgtccgaaccattgttggacgcgttcccctcctgcacgcaacctcatgtcgtgctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttatgttttggtggtcgagcatcgcatgttctgcttctggatccagatctggagaaatcgcgaagtcgtcgtcgttcggttcggagcggatctgatgcgacgatagatggaggcggcgggatctctcggtctgcagtcctgctccacctcgatggatgatgtctctgcgctgataaatatgggatcaatttcgat

SEQ ID NO: 45449 - DNA, 438 bp, Zea mays
  unsure at all n locations
  Clone ID: LIB3066-033-Q1-K1-B9
ccagagggcgccgccgcatgtccacgcggccccaaggaaggtggcggcggtgcgatttgtctctgctttggtcgcgtctgcccggatctagtcgggttccaggaggtgggggcgacgtgtgtggggcggcgacccttcgccggcgcggctcggcctcggcggcatcctggcggcagtgagcgcggcgttcgtatgtcacttccgggcgttgcgggtcctggctgggtgtccgcgcagcaggggggcatgcggccggccgtgggtcgcaggcgcgaagaaggtgctgtctggcgccccagggcagggagcggcgccgcgcgtggaggtctggaatctggtgcgcgtggggttcgcggcctccgcgtgccagcctttcgaggcgccagtaggctggtcccgggcatgttccgnggtggtgtttcgccgtgtgccgtcgtg

SEQ ID NO: 45450 - DNA, 448 bp, Zea mays
  Clone ID: LIB3066-033-Q1-K1-C1
acgcaccgagtggcgaccgcctgacgcgcccgtgtcggcaagccgacgacgacttgacgtggggcgggggaaacaaaacaacgcgggcagcgccacggcaagcgcgtgcctgccacggcgcggacacagagagtggaaaccggaaggggggaagagagatggattcctacacctcggcggcggcggcaggggaggcggccgtgccgccggaggacgacgtctgctacgtctgccacgaccgcttgcggatcccgtgccaggcagaactgcttccataggctctgtggagagtgcatcatccgcgtttggaattatggacctcctgtacaggcttgcaagagtaccatttgtcgtcgccttataaatctactggtgcctgctgcattatcaaggcacgatgatggtccacacgctcaacgtattctaggagagattcagcactataact

SEQ ID NO: 45451 - DNA, 309 bp, Zea mays
  Clone ID: LIB3066-033-Q1-K1-C10
cccacgcgttcgccgacgcattaaacggtctcgtgttcatgacatgtcatatacaaactgggccagggcagcctcgcttttgccttcgctttcatgcataggagatgtagagaatcaccaccggaccggcctgactctataccgtgtggcgctattggccacactgatatgctcaaggttggaatgtcctgtaagggctgagatagagctctaaagactgtcctgagcaatatgcaacgcgctgcgtcctacctcgtaaacattatggaatactacgtaacggtgaatggcattgtgatacactaagct

SEQ ID NO: 45452 - DNA, 433 bp, Zea mays
  Clone ID: LIB3066-033-Q1-K1-C11
cccacgcgtccgcccacgcgtccgtgcagaagggactataaggtgccatgataatcaaattaacttgtcaccaggacttgcaaacacaacaactaaattgaacaacagcccaagccgtaaagcgttttcagttcaggataagctctggtcaatttatgctgccggcaacactgtaccaataccatttcttaaggcaattgacatttcaccactagctctagtatcagaaaatgaatcaggaaatggcctggctgggtcaagtacaaatgatgctttggaggcagttagggagctgttcagtggtgatgggcaggcaaagaaaggacggaaagggcaaaacgaagtccctcttcctccgggtgtgcatcacaggctgatgacaagccccacattgatgaacctggcccaagctctagcttatcacaaaacgtgc

SEQ ID NO: 45453 - DNA, 392 bp, Zea mays
  Clone ID: LIB3066-033-Q1-K1-C12
ctcggacggacggtccgccgggcggcggcgccgctaggtaagtaggtagctagagcgctgcgccaaccacgacgtagcacatgcaatggcactcgcggccgtggcgctgccgtcgtcctcgatcgtcggcctggtgtctagctgcacggaaccgcagccatgcagacgatctcgaccgtacgccgtgtgtagccggccccggccaccgcccactgctgccaactgcccagtgatgacgacccggccatgtccgccgtacgcacggtcctgcctctcgatcgtacgccgtgagcaacaggagttctgtccggcgctggaggtcggtccttgtcctggctagagctagcccgcccgccggtcacacggatcggatctctccatccactcccagc

SEQ ID NO: 45454 - DNA, 436 bp, Zea mays
  unsure at all n locations
  Clone ID: LIB3066-033-Q1-K1-C2
cggacgcgtgggtttgtacttaaatttaaattgtattttaataagtaaaagaagtcaggtaattcattaaggctatgtttataccgtgtatcaatggtcaagaaggttccattggaacaattattatttatttcaagctatttcggctctttcttaatcttcaaaaagaaatgaattccgtaatggtaacacgaaaaaagaaaaaaaaaggaagtgtggaaaaaatgacaagaagatattggaacatcaatttgaaagagatgatagaagcgggagttcattttggtcatggtattaagaaatggaatcccaaaatggccccttacatctcggcaaagcgtaaaggtactcatattataaatcttgctagaacagctcgttttttatcagaagcttgtgatttaagtttttgatgcagcangtcaagggaaaaagc

SEQ ID NO: 45455 - DNA, 443 bp, Zea mays
  Clone ID: LIB3066-033-Q1-K1-C3
cccacgcgtccgcccacgcgtccgcggacgcgtgggctattttcctccttcactgcaccacttgagtttgctctacatgggaacaaatgatatgcaaatactgtttccatatgctactgcacttaagaagttagaccttcagtttacattcctttccacagaggatcattgtcagatagttcaacgctgctccaatctggaaaccttagaggtgagggatgtcataggggatcgtggactacaagttgttgcacagacctgcaagaaattgcataggctcagagtagagagaggagatgatgatcaaggaggtcttgaggatgaacaaggtaggatttcacaggtggggttgatggctatagcccaaggctgccctgagttgacatactgggcgatacatgtatcagacattacaaatgcagctttagaggcagttggtacat

SEQ ID NO: 45456 - DNA, 431 bp, Zea mays
  Clone ID: LIB3066-033-Q1-K1-C5
cccacgcgtccgggtgaacggtaagctaagcgaggagcctgggttggtgaacgcaagcccgtacgagaaggggtggattatcaaggtcaagctcagcgattcaggcgagctcagttcgctcatggatggtgacaagtactcgaaattctgcgaggaagaagacggtcattgaagaaatcagagggtcttctgaacaccaaggacctgtgtctcaagctctatcagtgctttctggtctggagacctgctgtgacaaatttaaattggcaaggttcattgcatggaataaattagttaggaattgccctattccaccagggctttgggaatcccgacttgtgttgtgagtggcgttgtcaaagtttgattatctctttttagttgtaatctcgtgatttccttctttttttaaaaaaaaaattatctttttg

SEQ ID NO: 45457 - DNA, 365 bp, Zea mays
  Clone ID: LIB3066-033-Q1-K1-C6
cccacgcgtccgcctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcac

SEQ ID NO: 45458 - DNA, 324 bp, Zea mays
  Clone ID: LIB3066-033-Q1-K1-C7
aacaaaagatatacaaatactgtttacatatgctactgcacttaacaagttacaccttcattttacattcctttccacagaggatcattgtcagatagttcaacgctgctccaatctggaaaccttataggtgaaggatgtcataagggatcttggactacaagttgttgcacaaacctgcaagaaattgcatacgctcagagtagacagaggagatgatgatcatagaggtcttgaggatgaacaaggtatgatttcacacgtggagttgatggctatagcccaaggctgtcctgagttgacatactgcgcgatacatgtatc

SEQ ID NO: 45459 - DNA, 342 bp, Zea mays
  Clone ID: LIB3066-033-Q1-K1-C8
ccctcgtcgtcgtctcactcaccccgccttcacgcctccctcaccaaataaggtcccggccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgaccgctccatcgacggggtgaccga

SEQ ID NO: 45460 - DNA, 401 bp, Zea mays
  Clone ID: LIB3066-033-Q1-E1-H9
tggaacctttgggctgatttatgtgcttgcgcgcccctctcagagctccttggtatattaccccaagaaagcccggttcctataggccagtgttctagtacggcgatatcaacccctcgtaacggcgggaaagagccctagtcaccgcagcgaggaaaggaccggatctctctaccacttcgggagtacggacgactcggaagtacaggaatgaagcgacgcctaaaggagccctcttcaactctatctcctcttcggagctcgtcaacgaggaaagggagaaacggtaagccgtaagagttaatggcccacttcccccggtcgtcttcagctgcaacgcccagggatagcggccggggccccccaccccccgacgctccccacggatacccccgcgcacg

SEQ ID NO: 45461 - DNA, 303 bp, Zea mays
  Clone ID: LIB3066-033-Q1-K1-A1
cggacgcgtgggcggacgcgtgggcggacgcgtgggggccgacgaggaggccgggtcgctgctgcaggagcgcgactcgcacggcgaccgcaagactgacaaccaggcctagcgagtgtgacggatctgaccgcccgatcggtctgaaccctgacaacccgtacaagttcgatgcaacatttgttcattccttgtgtcgaacatgtggggaaaaaaagggaaatatatatgagcattttttgtattttttggccagttgtagctgttactaccacgtaaacagtacgcaaagtcgttcgcatt

SEQ ID NO: 45462 - DNA, 272 bp, Zea mays
  Clone ID: LIB3066-033-Q1-K1-A10
ccgacgcgtgagcggacgcgtgtgccatcttccttcgacaccatgctcatcgacattggtgactaccctcttcctctccttctccttctccctctctctctccactgcgatgactaccaggtcattgctgaatgtccaacgacctcatgccggcctatacatgcaaggctggatccacagacactgcatccacggaatctagaactctttcatcaccactagattcatgtttgaaaagctcctgcctctgacgctagatctcatcaccaatg

SEQ ID NO: 45463 - DNA, 308 bp, Zea mays
  Clone ID: LIB3066-033-Q1-K1-A11
cttgtgaccctccctcagccgcgtcgcgtcgcatcctacgatccaaagctctctctgcgcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaaacatcatgctgaattggctcacggcgctaacgcggtgctggacatcgcggtgc

SEQ ID NO: 45464 - DNA, 404 bp, Zea mays
  Clone ID: LIB3066-033-Q1-K1-A3
cccacgcgtccgggtgaacggtaagctacgcgaggagcctgggttggtgaacgcaagcccgtacgagaaggggtggattatcaaggtcaagctcatcgattcacgctagctcagttcgctcatggatggtgacaagtactcgaaattctgcgaggaagaagacggtcattgaataaatcagagggtcttctgaacaccaaggacctgtgtctcaagctctatcagtgctctctggtctggagacctgctgctacaaatttaaattggcaaggttcattgcatgggataaattagttaggatttgccctattgcaccactgcttgggaaatacgagcttgcgttgtgagtggcgtggtcaagtttgattatctctttttagttgtgatctcgcgatatccttctt

SEQ ID NO: 45465 - DNA, 305 bp, Zea mays
  Clone ID: LIB3066-033-Q1-K1-A4
cttttcttgaagaaaagaaatgcatgccttgggtcgttcagtagtcttacacagacatgccaagatgtttcttgattctgaaattcgctaacactagcatgttttatgtgtgtattgttgttatatgaaaagtgaagtatgatcatctccagtgtccactacatgagtacaacaaaccatctggtgtttttttcctgtacacacacaaacacaaacacacacatgatgacgacgacgacgctacttgcactgcctgttggggaaggcctctgacctgacgaccccgtgctcgacgccatcgacga

SEQ ID NO: 45466 - DNA, 402 bp, Zea mays
  Clone ID: LIB3066-033-Q1-K1-A5
cccacgcgtccggcagcggaggcggccggcaagcctgagtggggccacggtgggccgaccgacgctggcggctacaacaactggccggaggacaccgtcttcttccgcggcgacaacggtgggtggagcaccgagtacggcgacttcttcctgtcgtggtactcgcagatgctgctggagcacggcgaccgcatcctgtcgggcgccacgtccgtgttcggcgcggcgcccgtggaggtctccgtgaaggtggccggcatccactggcactacggcagccggtcccacgcccccgagctcaccgcgggctactacaacacgcggcgccacgacgggtacctcaccatcgcgcgcctcctggcgcgccacggcgccgtgctcaacttcacctgcgtggaaatg

SEQ ID NO: 45467 - DNA, 337 bp, Zea mays
  Clone ID: LIB3066-033-Q1-K1-A6
cccacgcgtccgcggacgcgtgggcggacgcgtgggcggacgcgtgggcggacgcatgggcgtccggaaccgccgcggccggcacgcacccacccgctggcctgacccgctccggcgcatgcggcgagacccctatatcgaatccacttatatacatacatcacgtgtactacgacatcgaacaataataatgaacagttatcagacgtaccggcggacgattcacaagtgtacagaaaacgatcgactccactccaactatacatatcctactatggctgttgatacaccccgatggatcacaaggcatgcatgcatgtacatgcacgcatggtca

SEQ ID NO: 45468 - DNA, 400 bp, Zea mays
  Clone ID: LIB3066-033-Q1-K1-A7
cgaatgcccaagccattcccctccagatactccgtgacaccaccgacgacgtggagaacaacctgtacccgttcgtccacctccttcccgacgggactctgttcatcttcgccaacgaccgctccatcctgttcgaccccaggaacggccaggtcgtccgcgagttccacgttctcccaggcggtggtcggaactaccctgcctgcggcatgtcggcgctcctgcccctcgacctccgacgcggcgacgtcctcagtcccgaggtcatcgactgcggcggctcccccaagaacgccttcacgctcggcgagtccaacacgttcccgcccgacctcaaggactgctcgcgcatcaacccctttgagcccgacgcttggtgggcgctggaccagatgcccgt

SEQ ID NO: 45469 - DNA, 205 bp, Zea mays
  Clone ID: LIB3066-033-Q1-K1-A8
cttttcttgaagaaaagaaatgcatgccttggttcgttcagtagccttacacagacattggaggatgtttcttgattctgaaattcgctaacactaccatgttttatgtgtgtattgttgttatatgaaaagtgaattatgatcatctcacagtgtccactacatgagtacaacaaaccatttggtgtttttttcctgtcacaca

SEQ ID NO: 45470 - DNA, 393 bp, Zea mays
  Clone ID: LIB3066-033-Q1-K1-B1
gccacgcgtgcggcaaagacccagaaccctagcacccccggcccgtcgccgacgggcggcggagtagagagatggcggcggacgaggtgaactcggtctacgtcggcggacttccctacgaggccaacgaggagatgcttcgcgacgccttcgggtactacggcaccatcgtctacgtcaaggcgattaatgatcatgctgtcaaaggcaagtgttatggttttgttactttcactcaccccagagctgctgagcaagcaattgcgggcatggacggcaagaaattaggcaaccgtattgttcgagtaaatgaagtgcgtacaagaggcccccgcgattgtggccgagatggtttcagacgagatccaagaaagtatggtcgagatccatact

SEQ ID NO: 45471 - DNA, 366 bp, Zea mays
  Clone ID: LIB3066-033-Q1-K1-B10
cccacgcgtccggaaacaacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaagacgagatctgcgacgtgcgcctgctcaagagccccgaggcggactgcgccgagatcgaccac

SEQ ID NO: 45472 - DNA, 395 bp, Zea mays
  Clone ID: LIB3066-033-Q1-K1-B11
gcgcaccgcctccccgtgtcccctccttctcgcccggcaccgtcgagctcggctgtggagacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagc

SEQ ID NO: 45473 - DNA, 390 bp, Zea mays
  Clone ID: LIB3066-033-Q1-K1-B12
acgggattcaccacgcaggccttctcgggcctcggcaccttcttcaagctctcggcagcgtccgccgtcatgctgtgcttggagacttggtacttccagatcatcgtgctcatcgccggcctgctcaagaacccggagctctctctcgactccctctccatatgcatgaacgtgaacgcatgggtgttcatgatctccgtcgggttcaacgccgcggcgagcgtgcgggtcgggaacgagctcggcgcgggcaacccgagggcggcggcgttctcggtgctcatggtgacgtcgctgtcgttcatcgcggcgacggtgtgtgccgtcgtcgtgctgtgccttcgcgaccagctgagctacttcttcactggcggcgaagccgtggcgcgc

SEQ ID NO: 45474 - DNA, 424 bp, Zea mays
  unsure at all n locations
  Clone ID: LIB3066-033-Q1-K1-B2
ggtgaagcaagcagcacacgagacgatatagagggagggatcatggctctcttccgtgccgccgcgtcaggagggttcgcgctgatccttctcgcgtgctgcagcctcatcatgctggcggcggcgtctggcggcggcggcgtggacgacgacggcgtcggtggtgacaggctgatgatggaccggttcctcagctggcaggcgacgtacaaccggtcgtacccgacggcggaggagaggcagcggcggttccaggtgtaccgncgcaacattgagcacatcgaggccaccaaccgggcgggcaacctgacgtacacgctcggcgagaaccagttcgccgacctcacggaggaggagttcctggacctgtacaccatgaaggggatgcccgtccgncgtgacgccggcaagaaagcggccaacg

SEQ ID NO: 45475 - DNA, 437 bp, Zea mays
  Clone ID: LIB3066-033-Q1-E1-H7
tggcttggaacctttgggctgatttatgtgcttgagtagggtggtgttactgatgatcttgccactgttaaggctattgattattatactcggtggctgctgctaatgttggacgtagggataaggattctgtttatactgaggtgtatacggaggttcctaataagaagggtggggatgctaagcggtatacttatgatgattgactgtcgtctgtaccgtagggcttctccgtcgtattcatctcgtagccgtcgatgaaagaagacccgagtaaaacgcatcctagcgatcctaagacgaccgatactaacggacacgtacgtccctcgatgagaatcggtcatattggtgaagacggccccgagactctcgccttgctagaaaacgtagcggactccgtagaagttacttcaaagagactggaaagtaaggcg

SEQ ID NO: 45476 - DNA, 293 bp, Zea mays
  Clone ID: LIB3066-033-Q1-E1-F8
ggcttggaacctttgggctgatttatgtgcttgttagatgtggtctggatctgaaccccccctccactagtgtaaactctacagtatacgggggggacgtcaaacaggttcaatggcagtacacttcgcctccccacaaaggatactatctgatccgtgaacgcaacatcagagtaagcggtcccagacgttaagataacacgcggacgatcgtaagaggcatagaagaacctggattcccacccaaacgatctccgatatagctcaggctgaagcccatctctgttatagtc

SEQ ID NO: 45477 - DNA, 388 bp, Zea mays
  Clone ID: LIB3066-033-Q1-E1-F9
ggttggaatttgggctgtttagtgctgttattgctggtgagggtgaggggtgggttgattacggagtagggtacggggtgccacggagttgatgctagtaagaatttcagtaggtgcatttaatcatagggttctgatccggtgcaatgaggggtggtgatgctctatcatatgtggagggctcggggtgagagatcataaggtatcctagaggtctgtaggattaagtaagcggatttcggatcatccagaatgagtagatacttgtaccgtcaaggatgacgactttggtttactagactccctgatgtttagtaaaagatgagagctgatacgaccgcgaccacacaacagacgactcgtccgtcgtgcgagttggcgtccgtac

SEQ ID NO: 45478 - DNA, 397 bp, Zea mays
  Clone ID: LIB3066-033-Q1-E1-G10
tggaacctttgggctgatttatgtgcttgtctgctgctgctctatctattttgttcctatgttctttctattaaacaaggctttggttgcccttgatacctataggggggataggaaactagtggttacggttctgaccttggtgatgattcctgttgctactccacttgcttctcctcgcgttgtggtcggtattgttgctgataatgattcttttgatcatgctacttagggttgtgctcatcgtgatattcgttgtgttgggcctgcgattaacgctattgagcatactgtgggtgttaaggcgaggtcggagcgtaagtatcctggtattggtaagtctgagtgtcttactgatggggcgattgatgtgaatggtatgcatatgactgagtct

SEQ ID NO: 45479 - DNA, 355 bp, Zea mays
  Clone ID: LIB3066-033-Q1-E1-G11
gaacctttgggctgatttatgtgcttgtttatgtacttgtttatgtgcttgtccatctccttgcccatactgtggtcgattatgtaggccccaatatactcgacacggatttaatcacacaccgcaccttcaccaactcgatacctatcaagtcaaccgcgccccccttaaacaaaataaatataataccctcctccacaaaatgtataccccaatgttgcttgtctcagacgactcaagtccatgcatgtacgtacgtgatacaccattatctccacactgctattcaaacctaacataactgttgggtacacataataccgccatcatcaaaatttctttccaatttaatcca

SEQ ID NO: 45480 - DNA, 448 bp, Zea mays
  Clone ID: LIB3066-033-Q1-E1-G12
gttggaactttgggctgatttatgtgcttgtttatgtgcttgtttatgtgcttgtgcatgtgcgggtaaaatacggtcgcgaacgcgagtgattacgcggctgccgacgtaggtataagccgtgacggccgcggtgccgcttcctccggcgagtggtgtacggcgtggcttctttaaagcttttttcggtaagaatactatggttattcacggtaaggatcggccagatgtcaaagtaatacggcacggtaagttgatgggcgttggctttgatgataacggcggtggtcgtgggcataaggatgcgaataagttttttcctaacagtacgggtgtgcgtggtaatacttttactcctaaggacggctcgggccgcgggcttcgtcctgagactaagcgtgacaagtccgcggagcgtcttggtaagtttgcggcggcgtatactatg

SEQ ID NO: 45481 - DNA, 257 bp, Zea mays
  Clone ID: LIB3066-033-Q1-E1-G2
ttattcgtcccaaatcttcttctacttttattcattgccttattcatcctcatacctattcgcatcgctctctttctatctatgtctcttttgcatactaccggcatatttatattcctctctaaccgatctctgaccatttatttccccctgtccatcctctttgttcttctctttctttcctgttttctaatgatatcatttctactctaacttttgcgtacgatctgatctttcctttctactctactcattct

SEQ ID NO: 45482 - DNA, 377 bp, Zea mays
  Clone ID: LIB3066-033-Q1-E1-G3
cgtgacgagagttccgccttcttcggcttctcctcgtactgcgtacggcgagaaggaagagctaaagggtactgacgtgaaagtgcttgggttcggcgggcttcctgatactattaagccgggtgttcttggtaacggtaagatagatagtatgaaggtcgcgtaggaggtacgggtactggtacgtggtggtatcgggaagtagataacttctacatttaagggcgatccttccgctggataatctaatcctataggtttccgtaagggtgatgcgattacttaggcggacggtaactcgtcggtgattatggattcaagttagcataaggattacggcaaccggactgagacctcatgtgcggacaattcggcta

SEQ ID NO: 45483 - DNA, 447 bp, Zea mays
  unsure at all n locations
  Clone ID: LIB3066-033-Q1-E1-G5
gttggaacctttgggctgatttatgtgcttgttagcccttggcagtacattattacgggttctcgtacacttgcgctctctcggaaggagagagtctcatngtgttgatggtagtagttggctggcgtagcgctgtgctgcttacgaggccgttggtgcggagagcggcgatcgtgagcgtgggaatccgggaagtgatgttgatgtgtcgggggcagagtagaaggtggtggtcttggtggttacggatgcgaaaattggcggagcggagggaatcgttgtcgttgcgctgggcggtatcttcgcgtggttgacacggtagaggagggcgtcgacgggtgctaagcgttagtcgttgtggcctagtgggacggcatctcatgatgagagtggttggttggcgcgtatcggtgcctgggatagagtctgcgattaggagaaatacgt

SEQ ID NO: 45484 - DNA, 438 bp, Zea mays
  Clone ID: LIB3066-033-Q1-E1-G6
gttggaacctttgggctgatttatgtgcttggcagacaaaaagaatatttacccattagggccgtctcctcctacttcgtcaacttaaatggagatcgatattcttccgttaccgtcaatgtattactagaagtcgctaataaataaaaatactactactcgatgaccagtagttaaaagtacgcttcgtctgctctccggcgctagatgtggtcccgcctattgcttgctgcggatgtctcgtctagcgggtgacttaggggagaagggtatgaatttgtggttgttaaatacgggttgtacgagtgtgctgctgaatccgtgttagcagcagcgtattgcgcgggccggtccgtccaggagtacttggaggtcggatggttctataactcgcgttgattttgctctgacgcttgagtttcggcctcagactgtgag

SEQ ID NO: 45485 - DNA, 453 bp, Zea mays
  Clone ID: LIB3066-033-Q1-E1-G7
tggcttggaacctttgggctgatttatgtgcttggccctaagcctctgctgccgtcctgagatcgttacggcggtcagcctgccgcgtatgtaggcttagaaaacataggccacgactgcataaaatccactactactcctcttgacttactaataactgttgagagtgactgagagacaaacaaagacgaagaaagcggtactactgctagttgcctctcctgcgtcagtttcgatgtcagcccgcgttttgtcgacagtagaggtaaagaagaagagagctgttgttgttgttgttgaggagaagaaggcgtaggataatcctcgtctgatgtcgcgtgagggtaggaaggggacggattcggcggcgcgtaaggagcttcgtgattctctatagtgtcttaattcggcgtcgcatggttggacttagcgtaagggtaagcgtattgagta

SEQ ID NO: 45486 - DNA, 477 bp, Zea mays
  unsure at all n locations
  Clone ID: LIB3066-033-Q1-E1-G8
tggcttggaacctttgggctgatttatgtgcttgtggatgtgcgggtggatgtgcgggcgaatacgcattggcgtaaggatacgtcgactggggatgcgattgcgatggtgtttggggatagttttaatatggacggtacttatacgggtgatctacttgggactattactattaatattgctaccggtgctggtgatgatcgtactcttactggttttgggattcttaaggcgaatactattggtgcgattcgtggtttcggttatggtactagtactggaagttcagggtggcataaggatgagaaggatgctatggatactaatgctaaggaccgtatctccaagaagatgacgcctggtgcttgtactaaggtgcatgaggatgttgttcntgcgtctattgctcttaagacttatcatgagaacactaagacggaggatctagttaattttactcctactgatacgaagcat

SEQ ID NO: 45487 - DNA, 261 bp, Zea mays
  Clone ID: LIB3066-033-Q1-E1-G9
tggaacctttgggctgatttatgtgcttggttataatacatctattaaaatccagctccccctcctgccttcatcttcccatcttgaggcgcccacaaaacatgagtaagttttattattatttcaacaacaccgccgcatatcatactactacctctctatatccaattattaaaatgactcaacgaataatcccctcccacagatatttccccctccattatctactccaaatgtcgctcccatttactcgacaaacga

SEQ ID NO: 45488 - DNA, 167 bp, Zea mays
  Clone ID: LIB3066-033-Q1-E1-H1
acgcatagggggatatttgctctatgagagcgtaggagtatagatgagcggataggtaatattgtgaagagtgtgtgtggttagtgtcgcttgatgtatagagtattgtattatatatcgtagtatatattatagtagtagtattgtattgtgaacgttgtacgata

SEQ ID NO: 45489 - DNA, 175 bp, Zea mays
  Clone ID: LIB3066-033-Q1-E1-H12
cgctgggtattctctaatctaagccctatacatacgcttgggtaggatactcgataggatcgttggaggttttgggatgtttaatatgacgtactatacgtgatctactggatatgactatatattgtaccggtgcggcatgacgactctactggtttggatctaagcgaataca

SEQ ID NO: 45490 - DNA, 432 bp, Zea mays
  Clone ID: LIB3066-033-Q1-E1-H3
aaacttagtagattgatgtgaattgagaaaaactttatgaaactctgcggttgtggtgattggaagaagaggatgatgatggatggagtggtgacggtgcgttttgtatccgtttcttgtctttcgtcttcttttgatttgtcatattgttccttggttgtggtgttattcgcccggagagtgctttgtggcggttgttgcttgtattcttgtcgtcgtcttggtggtgggggtggcgagtttgggtagttgttgtaagaagtcgcgtctgaggttacacttaagacagtaaggctcaaaggaagggccgtatctataataaacacggctacgggcggcatcgcgatcgatgacgtaagcgacgaacggtccgcctcggactagaaggcaaaccttcattttatagacagaggacccatagtaaccggtatc

SEQ ID NO: 45491 - DNA, 211 bp, Zea mays
  unsure at all n locations
  Clone ID: LIB3066-033-Q1-E1-H4
tggcttgggacttttggcttgatttatttgcttgtttatgtgcttgactataggtcattttagcgacggggccggcgtcntaataaacggtcgggcggtagaaataagtcaaaaatacgcaatatacgttaccgctacatcgatttccaaacccatatattactatcacactcgccagcattaatcatacgttcccccttcgagaactaac

SEQ ID NO: 45492 - DNA, 355 bp, Zea mays
  unsure at all n locations
  Clone ID: LIB3066-033-Q1-E1-F6
tgcttgaaaaaaaaaaaaaaaaaaaacaaaaaaaaccaccccccccncaaaaaaaaaaaaaaacaccgtgggacccaaaaaacaaagagggcgacaaaaaaaaaaaggggtggttgccccaaagaactaaagcccatcaatttgcgtacgtaatccaaaagtctccccacagcgctattcaaaccaaacctatcggttgttgcccaaaaatgctcgaatcggaaaaattccggtgccattaaatcaaactgtcccgaaaaaaacttttcccctgttagccggtcaaaaaataaaaaggtttgaattaactgttcccttaaatacccgtttaattcgaacggtaaacggaattttt

SEQ ID NO: 45493 - DNA, 283 bp, Zea mays
  unsure at all n locations
  Clone ID: LIB3066-033-Q1-E1-H5
tcctactcgtcatccttatcattgttattctgctgagtgcggcacggctttttctaagaatgaggagtagtctatggatgggcattcagatattactgctgatcggactttgggtgtgtttaaggattcgtggtcntaggatccgttgagtcctgcgtgtattatggacttgaatgatgctacgtctaatcctcctacttatgagatggagggtacgctgtaggtgctggtggcggctactaatattcctgatgagtctgatgtgatgtcgtctgtcgttacg

SEQ ID NO: 45494 - DNA, 164 bp, Zea mays
  unsure at all n locations
  Clone ID: LIB3066-033-Q1-E1-H6
cttatcctccctcagagtctggttcatatcctctccgctctcccattataagtgttcgtggtactactngtcatccttatcattattattctcatcagtgctgcacggctttttctaagaatgatgagtagtctatggattggcattcagatattactcctcat

SEQ ID NO: 45495 - DNA, 291 bp, Zea mays
  Clone ID: LIB3066-031-Q1-E1-D10
ggaactttgggctgatttatgtgcctgaagtccatgcatgtgcgtacgtgatgctacagccttctcacagagctattcaaacctaacctaggggttgctgacccataatggtgcgatcgggaaaatttcggtgacatttaatccaactgctccgtagtatactttttccctgttagtcggtgcaacagtgaacaggtttgtattgactgtttccattaatagacgtgtagttcgaacggagaacgggatgtctttcgcagtggtgtacaagtgtcgtgcgcgcggcggcca

SEQ ID NO: 45496 - DNA, 235 bp, Zea mays
  unsure at all n locations
  Clone ID: LIB3066-031-Q1-E1-D11
tggaantttgggatgatttatgtggatgtggatgtgagggtggatgtgtgggtgaagttggagaatgaagagttagttaagtaattaggtggggggggagtaatggtattgggactagggataaattatgagttaaattgagtggtgattgagtgtgaaatgataagataaaaaggagtaagtgagttaatgattgagagagtgtgaggatgaataagtaggttgggttgtatgg

SEQ ID NO: 45497 - DNA, 313 bp, Zea mays
  Clone ID: LIB3066-031-Q1-E1-D12
ttggaaccttgggctgatttatgtgcatgtgcatgtgcatgtgtgttatcggtcccctaattaagtctgacgattaaccgcgcgaactaatgggcttcggctcatcaggccgaaccatcactgtggtgtggctactagcagggcaaaatcaattcgctctatgatggctcaaatttagtctatgcctttcaccggcgggcgaataacgtaatatccggcgaacgtcgtcctataacgacaggaagagttggtactaaaggactatccggtgatgtcatcaccaatgtccggtcggtataagttaggcactttc

SEQ ID NO: 45498 - DNA, 493 bp, Zea mays
  unsure at all n locations
  Clone ID: LIB3066-031-Q1-E1-D2
tggcttggaacctttgggctgatttatgtgcttgtggatgtgcgggtcttcttgtttgcctttattgactctatgtctctctctccttcttgctgtgctggtgctgttactgttggttacgggccgtggcggtcttaaggaggttgcggttattggtaatattagtgttggtagtaaggcttcttggaggaagcttcttcttgctcttattggtgtaagttatattcntattatgctgttgctgcttcttggtgctgctgctaaggatgctgcgaaggacgtggtggtggttggtgaggcgacgatgtttgttgatgttgagaagttcactctcgctgattttaaggtagatgttactgcggcgacggatgttaagaaagaggagggtaataataaggcggttgcggaagaggactcgtccttcgaacttattacggttgatgaggtgtccgtcgcggaggaagggttttaggccgatgaattatctaaaact

SEQ ID NO: 45499 - DNA, 482 bp, Zea mays
  Clone ID: LIB3066-031-Q1-E1-D3
tggttggaactttgggctgatttatgtgcttgtttatgtgcttgtttatgtgcttggttttatatatataaaagtaaaaagtactactataacaacggtttgtgtgcgcgcgccttctgcggcgtcttcttcggttgttgctgtggcggtgttgcccgtgggggtcgtgtgcgcggacgctgcggagggtaggcttacggtgcttgttgatgtgttcgaggtggtggtcgatgtgtttgtctttggctttgatcttgttctacttttggatctgttgctggaggtgtttcttagtagtagtctacttgatcagttgtgtataatgtagcctccgctacgactcactcagtaaacaaaaagactacacgctctgcccgacctctcggaacaatcaacagcacacacgtcgtgtttggacgacacacaaacacgcgtactaaacgtgcgtggtaaatgtacggaacgcgtccgttcagtcagtc

SEQ ID NO: 45500 - DNA, 484 bp, Zea mays
  unsure at all n locations
  Clone ID: LIB3066-031-Q1-E1-D4
tggcttggaacctttgggctgatttatgtgcttgagagtgcctttttgtggtcttcttatggtaagagtctgtgcgtgcatggtcttactcgggagcttattgctaggaatgctaagcctgcgctggataagatggcgaagttggcgcataccactatttttattgaggttgtgtatacttaggttattgcggtgcgtgggtgtaagtatgggtcgtgggcttgtgcgtggagtggtgggtatgatcatgagggttcgctgcattggcttgttaagttggagatgcctgttgcggcggattcgcttacgacgtggtaggcgtgtactgatggtaaggttgttatggtgcgggcggatcttggtgtgtagtctggtgagtctcatcatgttgcggtgaagacgatttttagttctgggcctttggtgggtgcgcgtgttatgactggtgctgggggttatcctagtgggggtggtcctngtacgt

SEQ ID NO: 45501 - DNA, 440 bp, Zea mays
  Clone ID: LIB3066-031-Q1-E1-D5
ttggcttggaacctttgggctgatttatgtgcctgattatgtgcgtgctctttctcattctcatgacttacctcgtagtgtagtgaagcgaatacgcgcgattggctaaagacgctgcggtaggtgcatgcggatgagtattcgacgcgtgagactgagggttattattctgcggtggtggctactgctggttatgatggcgttgatcgggtgtatagtatggcgcctgttgagcccacgattgaggatacggctaatactacgaaggatcctgatgagttagggtattctgtgtcgataggttcgccttctggattcattaagcctacggctacttaacgtgagttcggcgttgctacttgcggtaagaatggactaggaggtacgattgcgaagaagatagggcaggtatctgctgccggtacgcatgatcagttgac

SEQ ID NO: 45502 - DNA, 489 bp, Zea mays
  Clone ID: LIB3066-031-Q1-E1-D6
ttggcttggaacctttgggctgatttatgtgcttgtatgtttagtccagtctagtctaggcagtcacagccagtcagagagtcggatgatttttgtgtgattctagacagacccccaacggaggtgttagtagtgttattcttgctgcatgatggtggtggtggtcatgcttctgctgattcgctttcgatgtcgggtttgattgtgatgttatatttcgttgttcttcttctcttcgagttcgattatatattagttgttgttgttgttggccttagccttgttggtgcgtggtcgcctttgcgttctcctcgtaataagaagccttctaagctgtaggtgtctggtggttattagaatgtgtataagaaggagaggagtgcggggcggaatgtttattctcattctttgttgttggttgtggatatggtgctggtgctggctgttggtgttgctgctgtctgcgttgtgatgatgtttgctggtagt

SEQ ID NO: 45503 - DNA, 462 bp, Zea mays
  Clone ID: LIB3066-031-Q1-E1-D7
ttggcttggaacctttgggctgatttatgtgcttgtttatgtgcttgctctttctctttctcttgacttacctcttagtgtagtgaagggaatacgcgcgattgggtaaagacgctgcggtaggtgcatgcggatgagtattcgacgcgtgagactgagggttattattctgtggtggtggttactgctggttatgatggcgttgttcgggtgtagagtatggcgccttttgagcctaagattgaggatacggttaatactacgaaggatcctgatgagttagggtattctgtgttgataggttcgccttctggattcattaagcatacggctacttaaggtgagttcggcgttgctacttgcggtaagaagggactaggaggtactattgcgaagaagatagggtaggtatctgctgccggtactcatgatgagttgacgatgttcgggtagcgtaatacg

SEQ ID NO: 45504 - DNA, 432 bp, Zea mays
  Clone ID: LIB3066-031-Q1-E1-D8
tggcttggaacgtttgggctgatttatgtgcttggttatgggtactgcgtcagggatccatacggcgtctgttatggtgtctcctccgcattcggtgtatgatattgatggtcctattaatgttcctggtgcgtggcttactaaggagaatgataaggagtcgacggtggtatcgcattcgtaagcgagtacaacgagttaggtgtctactcctgggatttggctttggagtcggcatcctgcggactggattggtgtgtcgtcggcgactgatccttcggtggactagtcggaggtcatgtgtactgatgtgcatgttaatcgttagcctcgtaagacgtagggtactggtcgcggtcggggcggtattactcgggtgcgtattgccgctattcatcctttgtcggatgcgtctaagcccgctacttgtca

SEQ ID NO: 45505 - DNA, 478 bp, Zea mays
  Clone ID: LIB3066-031-Q1-E1-D9
aacctttgggctgatttatgtgcttggactattggttgctgagtgagtagctctttaaccttatttaacaatcaacaatactcttctgagtgttaggccttccggattatcacacttaggagtgatgaagcgacttatttgttagttacggagacgaagaaggcttctcgtgttgtttctgctgttgttgttctggttattgttgcgtcggttctggctgttcttgaggtgtttcttgaggtgtttgttggtgtggttggcggcgtggtcggtttcagtgtaagtggtgttgttgctgctgttgcgtttgttgctggggtgtctgctgttcatccttctgttcatcattcttatcgagtgatgatgtgtggggtggtaatgccgggacgtactgcgcccggcctacttggacaaccaaccggcgccccccacccatgcgggccgtgaccgggcaaccggccgcccgcctgcctggcct

SEQ ID NO: 45506 - DNA, 398 bp, Zea mays
  Clone ID: LIB3066-031-Q1-E1-E1
tttgggctgatttatgtgcttgattatgtgcatgcttatgtgcttgagtttgtctccggtagcgttacggccgtaaaacctcgggtgtgactctgtacggtatgagtcgtagaaaattgaccaaaaaaattaaacaatatattggcaaagcaactaaattaaatatgtgtcgatattgattgactaggtgattttgtcttaagaggaaacttattattgtggttggggttccttagactctgtcggaggtagtggtagtgatggtggccgcgagtgacggtgtctaatacgaagatttcgatgtacgtgtcggtgaaagtgccggtcgctacttagaagatggcgcctatgatcgcgtacgaggcgatgggtttgtgtttgtcgtaagatcatgagtc

SEQ ID NO: 45507 - DNA, 416 bp, Zea mays
  Clone ID: LIB3066-031-Q1-E1-E10
ggcttggaacctttgggctgatttatgtgcttgtttatgtgcttggtggtggtgtcggcggcgatggtgattgattcgcgtttatttaaggataaggggcgtaagttgttgtaggagtatcctgattctagtacgtttgtgccttcttagactgtgtaggagaaggttggtactgcgtttactcttcactgtagggcggtacgtgtaaagtagggtggtacttggcatattactattgggaataagcatcctaatacggcgatgactattaatgcgggtggtgttggtgatactgtggtggcgctggcgaaggggagtaagtgtgctaagcggatggagacgaagtgtaatcgggggtaagcgcggtagattgaggaggattctattcgtgagctgtcgatgccttgggcgacgat

SEQ ID NO: 45508 - DNA, 455 bp, Zea mays
  Clone ID: LIB3066-031-Q1-E1-E11
cttggaacctttgggctgatttatgtgcttggctcggcatattcttagtcctaagccggaggtggatgatacgttgacttgctgtgatactaagatggcgtctgaggctaatagttatgggtatgttagtgcggtgcccgcgaatattaaacctgcaggacgcgggtatgggattaagacgaataaggtgcctatgtctgagaagtttacggattcgaaaaagggtgcgaattatgctgttgctccggtgctgatgacgggaacgacggatagcggtgtccattcggagtattgctcggttggtgctgatagggcgtagactaagggttctaatgtgggtatgtcggattcgatgaacaatggtcggggttatactgctggttctgctcgtcagtagaagtagactcatattgaccagggtacgggtaaggctatacggaagttagctgcgaatg

SEQ ID NO: 45509 - DNA, 434 bp, Zea mays
  Clone ID: LIB3066-031-Q1-E1-E12
tggcttggaacctttgggctgatttatgtgcttgggtactgttaagtagagtcattagtcgtgtactcggtctagtgttgcgactgtgaatacggagatgcgtgctgatgggccttttgacgatgagcctaaggttaaggcgaaggagctgcctaatgacgggaaggagtctattagtaatgtttcggtgtctactgagaaggggctactgtcttctcttgcgtcaaagggtggtctgaaatgatggccgtctgaggaggagggagaattggtgtaagttgggttcgtatctgataaggatggtactttggagcgggcgtttgatagcgagtggagggcgtctaaaggtggtggtcccaagagtatatctatgttaaacgcggcggcggtgaacgatcgtagtggtaagcctaagattaccaatgaggtgtccg

SEQ ID NO: 45510 - DNA, 448 bp, Zea mays
  unsure at all n locations
  Clone ID: LIB3066-031-Q1-E1-D1
atggttggaacctttgggctgatttatgtgcttgacggtacttatacgggtgatctacttgggactatgactattaatattgctaccggtgctggcgatgatcgtactcttactggttttgggattcttaaggcgaatactattggtgcgattcgtggtttcggttatggtactagtactggtagttcagggtggcataaggatgagaaggatgctatggatactaatgctaaggaccgtatctccaagaagatgacgcctggtgcttgtactaaggtgcatgaggatgttgntcntgcgtctattgctcttaagacttatcatgagaacactaagacggaggatctagttaattttactcctactgatacgaagcatcgttttaataagccgcgcatcgttaatggtgttcntaaggctattgctaaggacgctattcctaagaata

SEQ ID NO: 45511 - DNA, 472 bp, Zea mays
  Clone ID: LIB3066-031-Q1-E1-B7
tggcttggaacctttgggctgatttatgtgcttgttgacttactccgggtgggtgttctgtgctgagggttagttaaagtccgttacggtggttgcgtggcttgatagggcttattattattattgttgtcttgaggtgctgcgcttggtaattcttgtggttgcggtggtggtgagggttgacgatgtttcgtgttagtgtttgtgggggtctgcgtaggcttgggagtgggattagggtttgtcgctgatggggtattagtattcgtattattactattattagtcgtggtggctggtggtgcctttattttgttgcttggggttggggtgttgtttcttctagtgtcgtgaaagtgattctaatactagggagtattgtcttcgtagtgaggcggttggtggtattgtggtgggtcgtgttgtcgcgcgtcgtcgtccttttcgtgctacggcggaggctgtggcgtct

SEQ ID NO: 45512 - DNA, 487 bp, Zea mays
  unsure at all n locations
  Clone ID: LIB3066-031-Q1-E1-B8
tggcttggaacctttgggctgatttatgtgcttggctgttgttgttgttgttgaggagaagaaggcgtaggataatcctcgtctgatgtcgcgtgagggtaggaaggggacggattcggcggcgcgtaaggagcttcgtgattctctatagtgtcttaattcggcgtcgcatggttggacttagcgtaagggtaagcgtattgagtagaagggtactattgtgttgtagacgaaggcgcgttaagaggtgcgtgataaggatcatgcggctaaggtggtcgaggctattaaggttcgtaatattattcgtgttaaggagaagtagttctcgtctagtgagaatcgtaggaggcttcgtattttcttcttccttcgaatgtagagtatgtntgttggctgctgctcctcgttcgtccgtgcgatatcgaactatcgacatactacatacgtacgtacgggacgtgacgatgacccgacgtacgtacgt

SEQ ID NO: 45513 - DNA, 423 bp, Zea mays
  unsure at all n locations
  Clone ID: LIB3066-031-Q1-E1-B9
tggaactttgggctgatttatgtgcatgtggatgtgcgggtggatgtgcgggtggatgtgcggggctgtcgtctgcttcgttcagtcgatggcttggttagtactattcttcgtctgtggttctgtttagtctttcttatttcttagcgagatgtagactcttcgtctgtggttctgtttagtctttcttatttcctggcgagatgtagactccggcgtgatggggtatcatggaggtagggcagcgtagccgcgtgcgcgccggcggttcggcctcagtaattgagaacgtctagagacgaaccatagagagacggtacgttcaataccgaaagaataccgtgataaggaccttagatccggcctagaatttacacntctagaacgtggaacacaaactaagaagaagtcgacgacgactca

SEQ ID NO: 45514 - DNA, 426 bp, Zea mays
  unsure at all n locations
  Clone ID: LIB3066-031-Q1-E1-C1
ggttggaaccttgggctgatttagtgcttggataaagtaagtaaagtatggatggatggcatgggtctcgtatgtgggtgctgtgctgttcgggtttgttggatatacttttggtaacaacgaggttttttggttggtgttgtgcttctgttgttggtgttcgtgtgtcgtcgtcggttgtgattccttcggtggttggttcgccgatgatgcttctttcggtgttgcattcgtcgttgttgtcggtttcgctgtcgttgcgttcgttggtggcgattgtgttggtggngcttgggcatggtgtggtgttgggtgcggtggtgtcggtggaggtggttgcggtgcatgtgattctggagattgcgttatagtagctggctgatgagactctgtcgctgtcggttgcgtcgtggtggtgtgtgttgt

SEQ ID NO: 45515 - DNA, 348 bp, Zea mays
  Clone ID: LIB3066-031-Q1-E1-C10
cttggaactttgggctgatttatgtgcttgtccgcctgtataaaaaaaaaaaaaaaaaaaaaacaaaaaaaaaaaaaaaaataagaaaaaaaaggggagggtggttgactcagaggacttaagtccatgcatgtgcgtacgtgatgctacagtctcctcacagagctattcaaacctaacctatcggttgctggcccataattccggaatcgggaaaatttcggtgcaatttaatccaactgttccgtagtataccttttccctgatagtcggtgcaccattgaagaggtttgtattgactgtttcctttaataggcgtgtatttcgaacggtaaacgggatattttt

SEQ ID NO: 45516 - DNA, 473 bp, Zea mays
  Clone ID: LIB3066-031-Q1-E1-C11
cttggaacctttgggctgatttatgtgcttgaaaaaaaaaaaaaaaaaaaaaaaaaaaaaaaaacaaaaaaaaaaaaaaaaaaaaggggtggttggctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacgggatgtgtttcgcagtggtgtaccaagtgtggtgggcgcggcggccatgtgtagtgcgattgccatatccgttagtgtttccatgtttggcttccctgtccctcctttccttccctcggttatgcctgttgggcccttttgctaagt

SEQ ID NO: 45517 - DNA, 473 bp, Zea mays
  Clone ID: LIB3066-031-Q1-E1-C12
cttggaacctttgggctgatttatgtgcttgtttatgtgcttgtgttcttgatgtcggaactaggtgacgggagatgtggatgttcatgtgaagtgggcgtcatctattgtagtcggtgatattgctctgtgggggactgttctcatttctattaagtatggtcgtagaccggctccgccgggtgatgagggtgtgtcggttgtgatggatgaggaggtgtggtgtcgtggggcagggggtggacgtgctgaaccggctgggtcggatcctaaggtgcgtgtcgaggtcgtcgttgatatggttgcggactgggttcggtgtcgtcctcttggatcggacgttcctgctaatcgtcatcttcatgagggcatgaaggacctgtacatagacatagccttcctccggctgttccgaattcgccgtctaacgtctattcttgagcgaaaactccgaatgatcgggtggacgttcg

SEQ ID NO: 45518 - DNA, 422 bp, Zea mays
  unsure at all n locations
  Clone ID: LIB3066-031-Q1-E1-C2
gttggaacctttgggctgatttatgtgcttggtaagcatggtcttaaggctattccttattccgaaaaggggcgtggttttaatcattcggtgccgtcagctaagcatgctgatggtgatggcgataccgcggtggcggatgctaaggaaaagggtcttgatatgcatgagttttctaagtatcttcggggtgttactcggaggaaggatagtgataaattgtccaagggattttctattgcttgttctatcattgagggaggtattaagattgctcatgatgacgctactttcgttaatcggaaggttaatattgntcatattgntaaacaaccaatcccagcgtcgataacatcccaagctggttcacgtcagtcacatcagaccgggccggactttaagtaacgtaccatatacgtacg

SEQ ID NO: 45519 - DNA, 466 bp, Zea mays
  Clone ID: LIB3066-031-Q1-E1-C3
tggcttggaacctttgggctgatttatgtgcttgtttatgtgcttgtttatgtgcttggagatcgacgctctatacgaataaatcgacgatggtcgtggtgggtagattattcccagtcgtcattgtccggcactaaaggacatcgatgtcgcgaatgggactgatgataggtgtgatagagatacaccaggcggataacgagcctgagattgagcacggtactgattaaagaggagacgcatgagttgctaacgccgaagtacgagccgtggaataagaaagtcgcctccccgcgaatgcatatgtatggtcaggcattatctaaagtttctgtgccgtgtacttatagtcgcagcatagtaactctatcacgtctgccatatggacgtgcgactattagtagtcccacatgcgagccgaacatctctcactcgtatatgacctgagtgtgccacacacaccatc

SEQ ID NO: 45520 - DNA, 487 bp, Zea mays
  unsure at all n locations
  Clone ID: LIB3066-031-Q1-E1-C4
tgcttggaactttgggctgatttatgtgcttgaggagtcggcggatcgggaatataagagttaggagagcgggaaaacgtatgtccgtggatgtgatgcgtatatgataacgtcctcgggggtcgttagaacatcttaggactgtaagagtgattcaacgggtattgcgaagtccgcaccttagttggtagaggagggttagggtggtgtgcatcatgcgtcgtaagaaggtgcctccgatgatgtgctggttacacctggtccgtatgccgatttggtttcttttgctggagctgccctgcttaggttagggtttcctgtggtgatgcttggttggccttcggtgatggctattggtaaaggtgggtatgttgtgacgttttatgaacttactgatttcgccgcagtcgtagttatcatcgctgctagttcttagaagactactcnttgggaaactgacttttcgtagggtgttggcgcgcttgct

SEQ ID NO: 45521 - DNA, 453 bp, Zea mays
  unsure at all n locations
  Clone ID: LIB3066-031-Q1-E1-C6
tggcttggaacctttgggctgatttatgtgcttgtttatgtgcttgtttatgtgcttgggacctttcatagaaccccccttcgcgtcgcgcgtcaccttctgtacgggcggtcggtcagtgtaccggaaagagctatctgacgacttcgatatcaagaccacaaggttttaataggcacatattggtcctcggtccaggtatcacatttttgctagagaatgagcgtcactaagttagagcgaggaatccggctaggccgttattctaaatgtaatcaggtgttgntgcgtcggcctcgtttcgcagaagtcgtagtgcacaaatgtattggtacatctaacaaatactgattatccccgcgtccgaaaaggttataaacgtcccccagtccggccggagccgcaggttccccggcgctgagcacacaggtaacaacgtagcgagaatattat

SEQ ID NO: 45522 - DNA, 468 bp, Zea mays
  Clone ID: LIB3066-031-Q1-E1-C7
tggcttggaacctttgggctgatttatgtgcttggagtgtatatatatataattagactctttttaaacttatttgctggtattcttgtcctaagacgtagactcccgcgaaaatttcgattggtaagatcactatttctgaggcggagctgctcgatattaccgataatgccaaggttaagacttaggataaggagggtacttttttagattagtagtggtctactcctgtcggtaaatagtccgaggatgggtgtatgtccgtcgatcataatacttagaaggagagtatttcttattccgcgtcttgttctaggggaggtacgtagactcccgcgaaaatttcgattggtaagatcactatttctgaggcggagcttctcgatattaccgataatgctaaggttaagacttaggataaggagggtactttcttagattagtagtggtctactcccgtcgggaagt

SEQ ID NO: 45523 - DNA, 486 bp, Zea mays
  Clone ID: LIB3066-031-Q1-E1-C8
tggcttggaacctttgggctgatttatgtgcttgtttatgtgcttgtgtcttcctatccttctgtcggtttacaaacacacactcacggactgttactgagtaaccacaactctatagaacaacaaatactacggggtaagttctatggtctgcttcttctgttgctgcggtgtcgtcgcttgttggttcttctttgtaggtgtcgggcaagggcaggggaggtaggggatatggcggtgttgctaatttgtaggctgttggtactcgtctctgtattttgcctttggaggcgcgtatgcttattgttgggtggtatgtgcttaagcatttggctactgataattcggttgcgtcgaatacgtatgcggatgtgcctgttaagtgtattgtgtaggtgtgtaagtatgctgtgaggctggtttgtattactttgttgtagtagatgtaggtgtctatgcctcgtgatattacgcatacgaatatgt

SEQ ID NO: 45524 - DNA, 486 bp, Zea mays
  unsure at all n locations
  Clone ID: LIB3066-031-Q1-E1-C9
ggcttggaacctttgggctgatttatgtgcttgggattcctagatctacaaatatactttacatagggagaataaaaactcgatcggaatagtatgccacgtcagcgcgaacatctactccggaacagaataaagtaggagagacgactcggagctcgccggtcactcctcgtcacaccccccaagaggaagggttccaaagtcggtatcaagaaataaaagcacgacaaaaccagcgaaaagaaaacgtccattctggtagagacctcgcgtaaactccatttgttggagcctgctctacacccttatcaccgctgtctttcgtgacccgaagataggttagaccatctcctaacgaagaagtctccctgcgacgcacccacatgggaaggacattaacccgaccatgcacccgatcggatcgtatctaagcatttctaaacgggntcttaataatagtccgcctaataattaagcgtaagaacg

SEQ ID NO: 45525 - DNA, 447 bp, Zea mays
  Clone ID: LIB3066-031-Q1-E1-B6
tgcttggaaccttgggctgatttagtgcttgagctagaggagagttcaggggccagtaattaaaatacgtttagtagggtgtcgatgcctaggtagtcgagtgttgtaatggatgggcctagcctgtagaattcgtctggagaaggtggtcccggatgggcgcataaagggtcttctgaggatattggagaggccactgttgcgaagtagtcgaatagggatgggtcttagggtaatggtgagccttctgctgaggcgtcgacgtctagttcgtcgtattatttgaattctgctaagtcgtcgggtcatagtattgatcttaattagtggacttcggctcatgagcatacgtttaggggtctgtcggaggattactcttcggatccgtttttgagtcggaagttttcgttgcggtatatgtggacgtggactgtggcgggtgtggtg

SEQ ID NO: 45526 - DNA, 493 bp, Zea mays
  unsure at all n locations
  Clone ID: LIB3066-031-Q1-E1-A2
ggcttggaacctttgggctgatttatgtgcttgtctaaaaataccctagaagttaagcctaagtacactccaaagttcacagtcgacgttcgtacgagagaggaataaaaggaacacgccgaccctgagttacaccacatatacacagctcgctacgaacgtcgttacggaaccggattctacctcactatttccttaagcggcaaaaaaataatagccagaagggaatcctaagaaccttacctagtaccggaggaggtaaaagtcgacacagccggctctcgggtatcgaacccttccaccaagaagggaccgtccttcaagagttcgctataactcacgcacgctctcccttcggtcggtcgtccttggctaacttgtcccgggtcggaagaagtctatggaaaaggataagtctcgtagcccaatcggccgcacgagaaaggggtccccgcgccgtagctcgatgganaacctctagccgaccccataa

SEQ ID NO: 45527 - DNA, 483 bp, Zea mays
  Clone ID: LIB3066-031-Q1-E1-A3
tggcttggaacctttgggctgatttatgtgcttgtggatgtgcgggtacagataggtgctcctgcatctgttcactcttgtgatttaaagtgcctgtttcctctttacctcctctctaccctctattattgttgttgtcatttttccctgataatattacgagggagcgtactctgacttatactggttaggttggcacttaggctggaaatgtgcgtcgggagtcgcatcgttctgagtacggtacctaggtcgacggctagacgtttggcgataagattaccgggggaggcgacgacgtccctaatattcctcctagcgagatcggtgtcgggaagtatgctttttgcgtcgcccccgccgattccgagtttatcgctactgacgaggcgaggatcggtattcactgttagtctccttacttcgagtagtctactagcggtaaggaggacgtagttaataatcctgtctgcggctatcata

SEQ ID NO: 45528 - DNA, 460 bp, Zea mays
  Clone ID: LIB3066-031-Q1-E1-A4
ggttggaacctttgggctgatttatgtgcttgttgctgctgtgacggtggttcttcgttgttgctgttgctatatgttattgtagagtcagtcgttgatgaagataaggtgggtaacggttaaggtgttttcgttgtccttgctgtcgtctgcttctgttgttcctcctccttattattttcgtcgtatggtgtagggttgtgttgaaaatactctggaggctgaggttgtggcttgtgtttgtgtgcttgagtcgtcttgtgatgttattagttagtctgctgattcgttttctttggttaattctcttggtgtgggtgcttgggttctggtttctagtgcgtgtagtaatgtgtctcgggttggtggtgctaatattattggtcctattgctttgttgtgtgctgcgttggttttgcctgtgtgttgctctgttactgctcctgagtctcctgcggga

SEQ ID NO: 45529 - DNA, 439 bp, Zea mays
  Clone ID: LIB3066-031-Q1-E1-A5
tggcttggaacctttgggctgatttatgtgcttggctgaaacggaataccaatacccctagtgccagaccgccgcccccgcgcgtgcggcacactcacacacatcggccgataaatcagcccggccgaccgagctcgactgccgccgggccacccgaaccgggcccgcgacaaaaaaaaataaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccctgttagtcggtgcaacagtgaacaggtttgtattgactgtgtcctttaatagccgtgtagttcgaacggtgaacgggatgtgtttcgc

SEQ ID NO: 45530 - DNA, 457 bp, Zea mays
  Clone ID: LIB3066-031-Q1-E1-A6
tggcttggaacctttgggctgatttatgtgcttgtatggattcaagttagcataaggactacggcaaccggactgagacctcatgtgcggataattccgctactattggtgagggaaagtctgatgggtaggggttagttgcgcggagtaagaatcttcgtgctaagaagcatgatcgtacgacttcctttaatctgtcggcgacggatcctgcgaataatggggaggcgcttggcactatgtcgtctaatcgtaagcctccttatacgaatacgcataagcgtaaggatacgtcgactaaggatgctaacgcgatggtgtttggggatagttttaatatggatggtacgtatacggctgatctgcttggcgctattactattaatattgctactggtgctggggatgatcgtactcttactgggtttgggattcataaggcgaatactattggtgc

SEQ ID NO: 45531 - DNA, 95 bp, Zea mays
  Clone ID: LIB3066-031-Q1-E1-A7
gacgacgagacttcgaagacgcagtaggagtactcgtccgtttaggcttatatatactagtcgggagaaatcgtacaattatacggtaaagcgtc

SEQ ID NO: 45532 - DNA, 477 bp, Zea mays
  Clone ID: LIB3066-031-Q1-E1-A8
tggacctttgggctgatttagtgcttgaggagtcgcccggagtcgccgttccgataggaacgtctcgagggtcgtactcgtcctcgtcgatcctctggtcaaagcacgggacgtatccatcggcgacgaatcatacctacccgaatacaagtacacagcctgggtacgcgtccctctcgaggatatttattccccatctatcggaggtacggaaaagatcccgtgcgcgcacgacaccaactgcttcgacgtagtcttaagagagtccgataaactattcggcctcgcttgaatcgtcgttcggtcctacagcgattaaatcacaccgagccttcgtatcgatacgggcggagcaaggtcacgggacgcgagaataggcaaaaccgcttaaatctccgaaattaaggtcctcaccatcagcgtagaagcaagttaggacggtaggcctactatcatagtagacggtctaagcgcaaa

SEQ ID NO: 45533 - DNA, 416 bp, Zea mays
  Clone ID: LIB3066-031-Q1-E1-A9
tggaacctttgggctgatttatgtgcatggatttatgtgcgtgcttatgtgcttgtttatgtgcttgtttatgtgcttgtaaatccataatggacggtcacggtgatggtgaagtcgagatcttttggtcattagtccgtctgtcggtggttgtatgtgttgactcgtgtttgtttgtcgtatgatggagacttgtgttggtgtaggtcttcatctggatgagtctactcctattgtgaaactcgccgtccttttcgggtgcggcacctcggtcaccgacgagctaaacgtaatacgcggaaagaggccactactcaccggcccggataatatcgaagcgaattggctagtccataggtagtcccagtcgataatcgccggctccggcgaacacaccctcggtgtcaactcccctg

SEQ ID NO: 45534 - DNA, 378 bp, Zea mays
  Clone ID: LIB3066-031-Q1-E1-B1
tggcttggaacctttgggctgatttatgtgcttgtttatgtgcttgtttatgtgcttgtccccgctagccggataacttgtagtcttcttactctagctccttttttactttacttttaaggccgattggtgaaactagtagcttgagaattgtgagtcctcgttcgacttagttctactttgttacggatgaactcgaggagtatagtaatggtggtgggtatttttatttgtattatgggcatgagcggaagcctttggtggtgtcgagtgtgaatatgatgagtgcgtatgcgatggtgtcggatggtgcggcgaatgcgaatctgtcgcctatggcggttgcgcctgcggggtcgctgtcggtgatattggggt

SEQ ID NO: 45535 - DNA, 492 bp, Zea mays
  Clone ID: LIB3066-031-Q1-E1-B10
tggcttggaacctttgggctgatttatgtgcttgtggatgtgcgggtggatgtgcgggtggatgtgcggggtggttctttatttacatattccgggtgggtgttgtgttgctgagggttacttagagtctgttacggtggttgcttggcttaatagggtttatgtttattagtatcgttgtcttgaggtgctgcgtttgatgattcttgcggttgcggtggtggtgagggttggtgatgttttatgttattgcctgtaggtcttggcgtaggctctgaaagggtactattagacgtggtggctagtggtgcctttattgtgctgtttggcgttagggtgctgtttcttctagtgccgcgatagtgattctaatacttggtagtattgtattcgtagtgaggcggttggtggtatttgtggtggtcgcgtggctgcgcgtcgtcgtccctttcgcgctacggcggaggctgcggcggtctgtatggcgtgtgt

SEQ ID NO: 45536 - DNA, 487 bp, Zea mays
  Clone ID: LIB3066-031-Q1-E1-B11
cttggaacctttgggctgatttatgtgcttgtttatgtgcttgtgttaccggtggtggtgatgtgttaattactactagttagggtaattgtcgtgacagtattattaaatactgttgctaaagcgactattaagtatcatgtggaagaaggtgcgcggaagaatcgggcgcggtatatggaggatgattcgcctacgaatggtgttactcctaacttgcttggtggtgtttttaagtaggctgatattaatgagcgggcaaagtttaagttaggaattcatgccataaggtctatttgtcctcctggtatatcgcttcgtcgtatgggtaagttgcgtcgaaggttggcgggtactaagtcgacctcctcaatctacggttcggttacgttaggctgtgtcggtcgtgccctaccctacggaagaaagtaaggacggactataggccgctgcctcgtcaaccaactcatacatgcccgttcctaag

SEQ ID NO: 45537 - DNA, 180 bp, Zea mays
  Clone ID: LIB3066-031-Q1-E1-B12
ttggaacctttgggctgatttatgtgcatgtgaatcgaaagggtgaggctgcatgcgtcgctgtactaattctccgaggattaccgacagtacagtggcgggactattatacacatgtggatagatctaagattatataccacactgactgtcctatcgatcatccggctaaccattaca

SEQ ID NO: 45538 - DNA, 440 bp, Zea mays
  Clone ID: LIB3066-031-Q1-E1-B2
tggcttggaacctttgggctgatttatgtgcttgtttatgtgcttgtttatgtgcttgtttatgtgcttgtttatgtgcttgtggatgtgcgggacttaagagagaacgttgtagtatactctaatagctgttgtatgtgttgcttttgttgactctgtgtaatagttgttgtatacgttattttgtttctgtatttatggtacttgtgtttagacgccgtgggtggtgttgcttttgttgactttgtgtaatagttgttgtatacgttagttctggttctgtgtttatgatacttgtgtttggtcgccgtggttggtgttgcttctgttgattttctagacacaaagctatctcgccgcctcctaagatcatttgaagtgacctacctcttggcctagtatcgcctcctaagatcaatcgaagtgacctaccgacgacg

SEQ ID NO: 45539 - DNA, 413 bp, Zea mays
  Clone ID: LIB3066-031-Q1-E1-B3
gaacctttgggctgatttatgtgcttgttccccctccgcggcggtaatactactactagcgcgggccgtagaaggagttgacgatccagaagccctccgtgccaaagagcgtatttaaaaccccaatatctttgagggtaagaagactcgcgaaatgacgcgcgttaatttcaaaggaaggttcactgatagagccagagtcgaccgactaacgtctactcccacccgcagtcagtcactacgtacgtgacgacggttcctccgaccaccaccaccctaccttctacgccgcccgtctccgtacgccccccttattatcaacaccgcttcaaccgacgtacataagccgctatctaaagtacccctcacgtcccatccaccggccaaacaaacataaaggtccatccccattc

SEQ ID NO: 45540 - DNA, 431 bp, Zea mays
  Clone ID: LIB3066-031-Q1-E1-B4
tggcttggaacctttgggctgatttatgtgcttggcctcagactgtgagtgttgtttccccccccccccccctctacacacaggccattccccgggggccgtagcaggccagtagagccccgagtcctaaaatatcttactcgacactacaaaattattcgctcccgacactaacacattctctggtaattaaattaaactgagaaaacgggccctaggatattgactccttacagtagacggaagtcaggcataggcctccggattacccgcttcctatacgtcggtcaggaaatgtagacgcctctagggctcttcgcgccctactatcaggtccctcttccggaacgtctaagacaaaggtcgttcggctttacgcggtagttgccgttgcgacgtgacagttaccgctttaatgtacgcggacgttt

SEQ ID NO: 45541 - DNA, 304 bp, Zea mays
  Clone ID: LIB3066-031-Q1-E1-B5
cttggcttggaacattgggctgattgagtgcttgatggtgcttctcatcctcgtcacaagccgattgaggcgtatgctgctcaccgcgctccggaattggcaaagaaaataagcgtagcatgttaagaagcatgcgtaggatacttgagaatatgacggataagatcacggcgtttggtactgagcaacactgggagaagatacggtgcgtgtacaattgttgtaataacaacggccgttagatgtagcgcatttgtgggacgtccatggacattacgacttcgtattgcatgggcataacatc

SEQ ID NO: 45542 - DNA, 188 bp, Zea mays
  Clone ID: LIB3066-031-Q1-E1-A12
cttggaacctttgggctgatttatgtgcatgtgtatgtacaggtctcgactattagtaagtcactggcggtcgtcgagtcacggaatcatattagggcaggtagtgcacctcttggtgcgtcgtcctaagttaatggcatcatttaatagtattcggacggttcgtaatactatgggtagctcattac

SEQ ID NO: 45543 - DNA, 306 bp, Zea mays
  Clone ID: LIB3066-007-Q1-K1-H9
cccacgcgtccgattctgtgtgtatgtcttggtttattaactaataacttaatagaccaagacatgcacacagaatcaaaccaacaatcaaaccttttatttgttccatcatatatctacaggaggaatttaattagtacgtaattaatccccctatgatacaataataataataatgaatacaacacatgcaatggagcaagtggacgacgggcagcatacgcaggaaggcgtgtcgacggagcgcgcgttcgaggcagacccgatcccatccttgtcggagacgatcacggcacgggcgatagc

SEQ ID NO: 45544 - DNA, 442 bp, Zea mays
  Clone ID: LIB3066-008-Q1-K1-A1
accgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtgtccactcgatcgagagatcgatcgatgcttgttattatatttggattccacattatatatgagaaaatccaattaaaattaatttatttc

SEQ ID NO: 45545 - DNA, 391 bp, Zea mays
  Clone ID: LIB3066-008-Q1-K1-A10
cccacgcgtccggcgttcccgtcggaggagagcgggtcctcctcgccgttctactactggttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcg

SEQ ID NO: 45546 - DNA, 420 bp, Zea mays
  unsure at all n locations
  Clone ID: LIB3066-008-Q1-K1-A11
acgcgtacgcagccaagagctatccatacgcacagcgatgcaccagcacgagatactagggatcatgggcctgtcgtccctcctcctcgtcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggngacgccttcgacgccgtggtgcgcgccaagctggccctggagctgga

SEQ ID NO: 45547 - DNA, 416 bp, Zea mays
  Clone ID: LIB3066-008-Q1-K1-A3
cccacgcgtccggcgctgtgcagggcgcgagcgcgttcgttcggcatggaacagaacgcgcggctcgttcctcgccgtgcgtcgcctctccggtggcgccatccaccaccatcgtcaccactcttccccggctgaggtcgtgggcgtgtccactgcgtggctcggtaaggggctttcatgcgtctgcgcgcagaggagggagagcgacgtgcgcctgtccttcgatttgagtcccattcaggaagagtgcttgaataggttgcagaaccggatagaggtgcagtatgatggttcaaatctggagcatcagaaagcactggaagccctttggcgttcttcttttcctggaactgaacttctagggttagtatcagaccagtggaaggagatgggatggcaagggaaagatccatcta

SEQ ID NO: 45548 - DNA, 361 bp, Zea mays
  Clone ID: LIB3066-008-Q1-K1-A4
cccacgcgtccgcccacgcgtccgccgaaggaggccagggctggtatcagggaaatccagttcttgcccttcaaccctgttgataagaggactgctctgacgtacattgatgccgatggcaactggcaccgtgtcagcaagggtgctcctgaacagattcttgacctgtgccactgcaaggaggatctgaggcggaaggtgcactctattatcgacaagtatgccgagcgtggtctccgttcgcttgctgttgccagacaggaagtacctgagaaaaacaaggagtcccctggtggaccatggcagttcgttggtctgttgcccctgtgtgatccgcctaagcatgacagcgctgagacaa

SEQ ID NO: 45549 - DNA, 363 bp, Zea mays
  Clone ID: LIB3066-008-Q1-K1-A5
caaattaaagagggatcggattggaactcgatcggaaggaaggtcctgcaggggggctggccggtcgtcgatcgaggaaccaagctgctgctgctgctaccggacgacaccaaccatgatacggaggacgacggtgtgcctaggcctgctgcttctactactggcggcgtcaactgcgacggcacatttctcgatcggcgacgtggacgagtacttgaacaggcgcacgcaggagtcccgccacaggaaccacggcggcgcgcagatcaatgacctcatctacagtgctgcgcgcttccacgccaacgtggatgcacgcacgtatggtcgtcgttccaacctgcatgtgcatgaagaggaagc

SEQ ID NO: 45550 - DNA, 340 bp, Zea mays
  unsure at all n locations
  Clone ID: LIB3066-008-Q1-K1-A6
cgactccactgcgtctcgtcccactgccgtccgtcccactgcgtctcgtcaactgtcgtgcatactcattnggatcannngtgcagagcagagccaanatgctcctaaagtgatgtngnnattcctaactctgcaatnngggaggaactnnngtggagatacctatggccannggtccnnaatgaactaagatgtcatgccctnctcttggtggacctggagaatctggactagcactagttatcagagtattcggtgactccactcatcctcagcgttcttgctgagggactattgcnnatttgctcgtggcgcgcccttcttcnntccgtgggccggt

SEQ ID NO: 45551 - DNA, 413 bp, Zea mays
  unsure at all n locations
  Clone ID: LIB3066-008-Q1-K1-A7
catccctgcaaattaccgcgatggctcccaagatcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcatcctncccacgctgctctccgtcaccgacaagaaactcggcgtcctcaactacaccagggccgacgacgggcagatgtac

SEQ ID NO: 45552 - DNA, 433 bp, Zea mays
  Clone ID: LIB3066-008-Q1-K1-A9
cggacgcgtgggaccggcgtgacctgcggccccggccacggcatcagcatcggcagcctagggcggtacaaggacgagaaggacgtcacggatatcaacgtcaaggactgcacgcttaagaagacggccaacggcgtccgcatcaaggcgtatgaggacgccgcctccgtgctcaccgcctccaagatccactatgagaatatcaagatggaggactcgggctaccccatcatcatcgacatgaagtactgccccaacaagttatgcaccgccaatggtgcctccaaggtcaccgtcaaggacgtcaccttcaagaacatcaccggcacctcctccaccccggaggccgtcaacctgctctgctctgccaagatcccatgcaccggcgtcaccatggacgacgtcaacatcaagtacagtggcaccaacaaca

SEQ ID NO: 45553 - DNA, 383 bp, Zea mays
  Clone ID: LIB3066-008-Q1-K1-B1
ggaggaggtggaggcggaggcgggggagaggaagacccaggagccgccgcagcaaggggagggcctcagcctctcactcgccaacggcagtggcaggtctggaatgttgccgatgtcaaacatgtcagctaatccttcacagcttacaattttctatggcggatcagtatgtgtgtatgactcagtgccaccggaaaaggctcaagcaatcatgcttatagctgcagctgcagcggcagcggcagctaccaaaagcagtgctgcccctactgttaagcctccaatggtgcctgcagccactgttgccccagcagctgtcgtttctcctgtgcttacacggtctccatcactgcagagcacttctgtagcaactgggcaacctc

SEQ ID NO: 45554 - DNA, 314 bp, Zea mays
  Clone ID: LIB3066-008-Q1-K1-B10
cggacgcgtgggcggacgcgtgggggcgaactttgtgtacccgagtggggtggatcgtgttcaagaggcaattcgttcatctcgaagaaattgctgctaagggtgagaagactagcccacaattgcgacaacatacttccttaccaagaacaggtcgatgtgcacagatccttcttgcttggatgtaccttaaggctctcaggttttgagttgagcaatccttgttggcacaccatcaactggactgctcgcatactcagatatggtctactcatctttatttcgcttcggttttaagactactcactgggaaa

SEQ ID NO: 45555 - DNA, 289 bp, Zea mays
  Clone ID: LIB3066-008-Q1-K1-B11
gcagaagacgcaagactcgcggataacggaggactccgcgatggcgatgatcgagcgggagaaggctcgggcgaaggcggccatggaggcggcggaggcgtcgcagcggatcgcggagatggaggtccagaagcggatcagcgcggagaagaagctgctcaaggaggccgaggagcgcaagaaccgcggcggcagcggcatgtcccacgaggcccggtaccggcgctacagcatcgaggagatcgagcaggcgacggacaacttcaacgacgcgcgcaaggtgagcgag

SEQ ID NO: 45556 - DNA, 294 bp, Zea mays
  Clone ID: LIB3066-008-Q1-K1-B12
tggcggtggagtcggactacttcacggtttacggtgtcgtattcctgaacgacacgcggatgggggaacctggctccaagggcggccagacggtggcggtgcggctgttctggaccaatacgcagatctactactgcaccatcgacagcggacagtacacgctgtacaaccacaatgtcctgcactactttaagggctgcctcatctggttcagaatcgacttcatcttcggcttcagccttaacttctacgaagactgacttatcaagtctgaagttaaagacgtggcggttc

SEQ ID NO: 45557 - DNA, 385 bp, Zea mays
  Clone ID: LIB3066-008-Q1-K1-B3
cccacgcgtccgcccacgcgtccggttccgcgccgacggcgagcagaagccgttcgcgcaggccgagctgcagctgcagagcttccccaccgtgctcctgttccccagccgcaccgcccggcccatcaagtacccgtcggagaagagggacgtcgactcgctcctcgccttcgtcaacagcctccggtgaggcccgtcagtgagcgagaaccatcgttctctgtcagtatgtactgtattacatgttggtatccatctaggtgcgctgtacgtagagagggaggcggagggaactgggatgctagaaaaaacagatgcaggtgttgcttgtaactgcagaatgatggtaggtatgcatgaagtctgagggcctgtgttatttggc

SEQ ID NO: 45558 - DNA, 311 bp, Zea mays
  Clone ID: LIB3066-008-Q1-K1-B4
cccacgcgtccgcccacgcgtccgcccacgcgtccgggagtggctgtcggggctcttgggcgacgcatccatcccgcacgagccggcgttccccggcgcggcgcccatcatcaagagctccgcgctggcggccggcgcgctgctgccgccggacaagatggaggacgcgctgctgttccgcagctccagccccatctcggtgctggagcacggcagcttcaacaacgccaacggcggtggcggcggctgctccgcgtcgtcggagtcgtcctcggcgtcctcgtcctcggagtctttctccggcagcggga

SEQ ID NO: 45559 - DNA, 464 bp, Zea mays
  Clone ID: LIB3066-007-Q1-K1-G4
agcggcactacgtgcgagtcgtcgcatcaggtcccctcgattcgccggcggcggcgccgcggaccaagctcatacatctgaattgactagtccaactcagggatttctttggggaccaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagtacagctacaacaagatccctaaggatctcaaaaaagagttctgctgcaatggtactgtaatccaagatccagagctaggccaggtcattcaactgcaacgtgatcagcgtaaaaatgtcggtacttttctagtacaggccggaatcgtgaaaaaaga

SEQ ID NO: 45560 - DNA, 444 bp, Zea mays
  Clone ID: LIB3066-007-Q1-K1-G5
cggacgcgtgggcgaatccagcctcatcttcgtctccgatctgccccccgctcagccgggggttctttcgctgcgtggtgggacggagccgagtagtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcccagttgcaggaattgattccggaacaacaggatcgcttaaagaagctcaagtcagagcatggaaagacccagcttggaaacataactgtggatatggtccttggtggaatgagagggatgactggaatgctctgggaaacatccctacttgatccagaggagggtattcgttttaggggcctctcaattccagaat

SEQ ID NO: 45561 - DNA, 474 bp, Zea mays
  Clone ID: LIB3066-007-Q1-K1-G7
ggacgagactcgcagctagctgacacggccgagaagcagcttgcattgcaggcgtagtacggacccagcagcagctagcactagcagtccatcggagcgacgatggtgagaaggacggtgctggcggcgctgctggtggccgccgccctcgccggcggcgcgcgggcgcagctcaaggaggggttctacgactactcctgcccacaggcggagaagatcgtcaaggactacgtgaaggcgcacatcccccacgcgcccgacgtcgcctccaccctgctccgcacccacttccacgactgcttcgtcaggggctgcgacgcgtcagtgctgctcaacgcgactggcggcagcgaggcggagaaggacgcggcgcccaacctgacgctgcgcggcttcggcttcatcgaccgcatcaaggcgctgctcgagaaggagtgccccggcgtggtgtcctgcgccgacatcgtcgcgctc

SEQ ID NO: 45562 - DNA, 408 bp, Zea mays
  unsure at all n locations
  Clone ID: LIB3066-007-Q1-K1-G9
cccacgcgtccgcccacgcgtccggcagcttctcccagacgctagacacgccgccgcgtgcgtctgcgccgcgagatcgagaatgtccatctctatgcggctcgcgatccctgctcctgccgtcaccgccgccgcgccgacgcggctgagggtgcgagcggcagcggcggggaaccgcggctctctctccgtcgcgcgcgccgccgtacgggcggagacgggcgcgctcaggggatgcgcctggctgccaccgaagccgctgggagcgggccagccgtaccggagcaggggggccgtcgtcgtgtgtcactcgtcggcgcacctcagcgcgcgcaccatccagtggatctccgncggagccagcgcagtgctattagttgctaaaggcactgccatacacaaatcttt

SEQ ID NO: 45563 - DNA, 402 bp, Zea mays
  Clone ID: LIB3066-007-Q1-K1-H1
cgacaagatggcgtgcacagacaatgcgatgagagccttgttcctcctggtcctcttctgcatggtgcatggtgagaaggaagagtcaaagggcatcgatgcgaaagcgttcgggcctggtgggttcttcgacatcaccaagttgggcagcctccggcaatggcaagacagacagcacgaaggctgtgcatgaggcatgggcatcggcgtgcggaggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtca

SEQ ID NO: 45564 - DNA, 432 bp, Zea mays
  Clone ID: LIB3066-007-Q1-K1-H10
cggacgcgtgggcacacatcgtctatcagtgctcatccaacaatccgtgcgcgaccaaggcaataatggtgtcgtcctcccgtgctgtcgtcgtcgtcgtcggcctcctcgtcgccgcgtcctccctcgccgtcgctgcctccgatggcggtgggccgacgtacgggtacacggcggggagccccgacgggccggagaactggggcaagctgagccccgcgtacaagctgtgcgggcaggggaagcagcagtccccgatcgacatcgtcaccaagcaggccgtccccaacgccaacctcgacaccctcaaccgcacctacgccgccaccgccgccacgctcatcaacgacggccacgacatcacgatgacgttcgagggcaaggtcgggacggtaatggtgaacggcaaggcgtacagcttcgagaagatgc

SEQ ID NO: 45565 - DNA, 420 bp, Zea mays
  Clone ID: LIB3066-007-Q1-K1-H11
cccacgcgtccgtccacgcgtccgcccacgcgtccgcttcgtcgccgctttcgtcctctgcgcctaccaggagtttaatgaattcggtgctgatggtggaccagcagctaaggcccttcggcccaaattcaacgtgtttgtcaaaaatgtatctgctcatctgggagtagctgcgccacacattgagttgaagcatgtgattgctgctacaattggtcttaagggtcttggaagcctcctttttattttgagcagctctctcagtgcttatctcctgctgctgtaccttgcttagatcactcctatcatccatgacttctacaactacgatatggagaaggcagaatctgcaggcctctctgcgaagttcacccatgatttggcgctgatcggagctctgctcttctttctgggcatgaa

SEQ ID NO: 45566 - DNA, 456 bp, Zea mays
  Clone ID: LIB3066-007-Q1-K1-H2
cacggagagcgccagctacaccgggcatgtttattggcctcctgcccctgttcgaccgggcggggcacgacagcgcggagaccatccgccgcgcgctccacctgggcgtcaacgtgaagatgatcaccggcgaccagctcgccatcggctaggagaccggccgccggctcggcatgggcactaacatgtacccatgcaccacgctcctgggcgacacgaacaccacggcgaacggcatgcacatcgacgagctgatcgagaaggcggacggcttcgctggggtcttccccgagcacaagtactagatagtgaaacggcttcagcaccggaaccacatctgcagcatgaccggggactgcgtgaacgacgcgccggcgctgaagaaggcggacatcggcatcgccgtggacgacgcgactgacgcggaccggagcgcgtaggacatcgagctgactg

SEQ ID NO: 45567 - DNA, 427 bp, Zea mays
  Clone ID: LIB3066-007-Q1-K1-H3
ccaacggcaacagttggaattcctgccaaaattcttcatcgaagaacaattgcagttcttgggacgactgggacgacccaggcaagaaagatgagcctgcgaaaccgcaccagagcagtgactcctgggctggctgggatgatgggaaggatgatggtcttgatagccctagttacaacaatcacagcacctccaacaaggggagcaaccaaaacgggacatccggtggcacattttggacagaaggcggcttccgctgaaaccagtctctttttcatagagctatactttcagagtcgttacatgccaggaaacgtgagggtccagtggttggtattatttgggatacttaaacagtcgggtgaaagggtttgtgtgtcttgtaccatgtctacaactgatattatatctagtgagatatatctct

SEQ ID NO: 45568 - DNA, 305 bp, Zea mays
  Clone ID: LIB3066-007-Q1-K1-H4
tccgacgagtcgggaagcaatcgatcacgaacaactacctcgccaccaacaatggcctccaggtggtacattgtactcgccacggtgatgtaggctgctctgatcgcggatggtatctgcaccaccccggtcaccttccatgacggaaagggatccaagcctggtcacctgatcctcaccagtaacgttgccaccatatccgatgtggagatcaaagagcactgtggtgatgacttttgctttacactgaacgagggcccgactgacacgttgactcattgaactatagccccactcaagtaccc

SEQ ID NO: 45569 - DNA, 477 bp, Zea mays
  unsure at all n locations
  Clone ID: LIB3066-007-Q1-K1-H5
cccacgcgtccgcccacgcgtccgtgcagcatcaacagcagcaggcaccacccgtggtgcgaggagcagcagcagcagcagttcttcatccgcgacgacacgccattcatgagccagatgggcgacatcaccagcacggcggagttcaggttcggctctggtttcaacatgtctagcaccgccgccgctgattacccaggcgcggcgcagaagaacgacggggccaattggttctactgaagaataaaacttgtagggctcctcgttataagcttcggattcctccatggctctcccaagttgtcaagtcttataggtcttcgttatataggttttgcagtagctgcaagacggctggaacctgnaactggtttatacttgtatgtccggccagccataaacctctcttatttgcaaacttaatgttattcctagctttaagttgctagtctcagtgctgtccatgtatatggctgt

SEQ ID NO: 45570 - DNA, 482 bp, Zea mays
  unsure at all n locations
  Clone ID: LIB3066-007-Q1-K1-H6
tcgaccgcacgcgtccgaagaaaagcatcgatctctagcagcatcggagatggagctaaatggatggtcaacaaagtgaaagggaagatgcagaaaccgctgccggagttcctcaaggagtacgacctcccagcaggcctgttcccgcaggacgcgacgaactacgagctgaacgaggacaccaagctcctgacggtgtacatcgcgtcgccgtgcgaggtgggctacaacgactcgtcggtgctgcgcttcgccaccaccgtgacggggtacctggagaaggggaggatgacccacgtcgagggcctcaagaccaagatcctcatctggaccaaggtgacggaggtacggaccgaggccaccaaggtgcacttcgccgccggcatgaacaagaccaggaaccgggacgcgtacgaggtcgtcagggacggcatcgncgtagacaagttctagcagaccttgtaattaggcgcgtaatataa

SEQ ID NO: 45571 - DNA, 230 bp, Zea mays
  Clone ID: LIB3066-007-Q1-K1-H7
accacgcgtacgcccacgcatccgcgcattctctagatcgctacatatcgtatgccaggtgcgaattctatcatggtgacggttatatacaccactctaacacttccacgaaccagtcgccaacagatctccactccaatcatccttacacctgatgctctgcgtcgtacatcatatccaccgtaagttcatcttcaactacgcgcaaacccgaacacgcgacacttcta

SEQ ID NO: 45572 - DNA, 447 bp, Zea mays
  Clone ID: LIB3066-007-Q1-K1-G2
cgtaccgcttccgcgtctgcaacgtgggcatcaaggcgtccttcaacatccgcatccagaggggatcatgaagctggtggagatggagggctcccacaccatgcagaacgactacgactcgctggacctccacatcggccagtgcctgtcgttcctcgtcaccgccgaccagaagcccggcgactacctgctggcggtgtccacccggttcatcaaggaggtgaacagcatcacggccgtgatccgctacaagggctccaacgccccgccgacggccaaggtgccggagagtcccagcgggtgggcgtggtccatcaaccagtgcaggtccttccgctggaacctgacggcgagcgcggcgcggcccaacccgcaagggtcgtaccactacggccagatcaacatcacccgcaccatcaagctcgccatgggccgcagcaaggtgga

SEQ ID NO: 45573 - DNA, 398 bp, Zea mays
  unsure at all n locations
  Clone ID: LIB3066-007-Q1-K1-E9
taccctcgtcgtcgtctcactcaccccgccttcacgcctccctcaccaaataaggtccggcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggngtgaccgacgcgaacggcacgtacacgatcgagctcaaggacagccacgaggaggacatctg

SEQ ID NO: 45574 - DNA, 415 bp, Zea mays
  Clone ID: LIB3066-007-Q1-K1-F1
cacacaaacacgagcacacatacaatcactctttagctcacgactaacaacggcctatacgtgaggcatcatccaggcaacaacggcactggctactttctgtgtgatcggttcgctcactatgccactcaccttaaaggtaggcaaaggctgcaatcctgaacacctggtcctcaccccaaacattgccaccatcaccgaaacggagatcatggatcacggtctcgatgacttctcctttgagctcaaagagggccacgtcgacacctgtacgcttgacacaaaggccccactcaagtacacgctctgcatccgctttgccagcaaggttgacggctactcgcatctcgatgatgtcatccctgaaaattttaatgcacacaccagctacaagaccacgctcaaaatctgatca

SEQ ID NO: 45575 - DNA, 429 bp, Zea mays
  Clone ID: LIB3066-007-Q1-K1-F10
cggacgcgtgggcggacgcgtgggcaagcgagtcgtggtgcttggcccccaggtcccgctcaaggagcagctcgagctcgacaaggatgatgagagcctgaggaggtggaaggagcaactccttgggcaggtcgacacagagcagctgggagaaactgcggaaccagaggtcaaggtgctggacctgaccatcctgtcacctggcagaccggacctgatccttccgatcccgttccaggctgacgagaagggctatgcgtttgccctcaaggacggcagcccctacagcttccgcttctccttcatcgtctccaacaacatcgtgtcaggcctcaagtacaccaacactgtctggaaaactggagtcaaagtggagacccagaagatgatgctggggacgttcagcccccaactagagccctatgtcta

SEQ ID NO: 45576 - DNA, 408 bp, Zea mays
  Clone ID: LIB3066-007-Q1-K1-F11
cggacgcgtgggcggacgcgtgggcggacgcgtgggcttctatcgtctatacgcttgggtctcctccatattgtcgtatgaattatgcgatcacgaaagggaggggatactgggtagcaattggtgtggagaggaaaggttcaagttgattttaaccaaggcagcacgacggcagcgacgacgacatacaacaacacgacggtaggggtgatgatggcagcgccatcgggtggtggatgcagtggctgtcttgactgcctgcatgatattgtgcatgcactatcgatgggatcatgcctgacagtagagcagcggcctgccatggctacgggaggtgcgcacaaagggagagatgtaaaagagaggaaggaaaaggtggagggtaggataataggaaatggagtgggt

SEQ ID NO: 45577 - DNA, 421 bp, Zea mays
  Clone ID: LIB3066-007-Q1-K1-F12
cccacgcgtccgcccacgcgtccggcccccgagggccagtaagacggatccgatctcgcgacctgatgcgtgtctgctgatgtcggggagtttaccaggactgtgccgttcttgatttctgatagcttatcttctagtacacctcgtgttgttctcttcgtcacggcgccggtgcgcgtgcgctgaagctgcctgccattgccattgcctttgccgttgtttttaattaagcacacactctagatgttatgcccgcatgctatgtttcgattctcaagttgataaatgatggctggatgctggttttcgtgctccaagcctgctgcttcttccagggaaaaaaagacctgcccttgttgcagcgttgttgtttagaatgacctatatttgactggtattctgttacggtggctttgcaaag

SEQ ID NO: 45578 - DNA, 461 bp, Zea mays
  unsure at all n locations
  Clone ID: LIB3066-007-Q1-K1-F2
ggccgncggggaccttgaggtgctcaccgcgctcgacaccgcgaagacgcaatggtaccagtgcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgctccgtcgcgtcggggctctcgttcggccacaccccggcgtccgtcatggcgacgctgtgcttcttccgcttctggctcgggttcggcatcggccgcgactacccgctgtcggcgaccatcatgtccgagt

SEQ ID NO: 45579 - DNA, 324 bp, Zea mays
  Clone ID: LIB3066-007-Q1-K1-F3
accacacgttcgccctcgcgatctcaccctcctgtgctcaatcaaaagggatagctctacgggggcctactacttggatccgtgccttatcaccattgaactaggatacgactcatatttcctatatatctacgactcgtacctgatacaccaagctagtactgctctgcaatattaatcaatgactctaaacgtatcttggtacatctacatgtacattctacaactaggctctaacctcctgcacacacattatcacatatttgatacccacaattcatgactcgcacataagctactgagaccccatcggttactctacta

SEQ ID NO: 45580 - DNA, 345 bp, Zea mays
  Clone ID: LIB3066-007-Q1-K1-F4
cccacgcgtccggccgaaggcctcgtgccttctcttcctccctggcatggacgaagtagcgtggggcgcctatgatcgatgccgccgtagtgctggacaacaatggcgctgacgcggtctcctgcactgccatccctagcgtaacaataagcctataggagaaagaaaatatcaatggggatgttcccacgatcacctcggccgcaagcaacgaggaggaggcgttgttcacagtcagagaatccaccaaggacgatagccatcgcttgacgatggaatgctccactcccgtctacttcagtagcccttccacccgcgcttcttgcgagcggttactgaagatgt

SEQ ID NO: 45581 - DNA, 350 bp, Zea mays
  Clone ID: LIB3066-007-Q1-K1-F5
cccacgcgtccgcccacgcgtccgcggactcttgggcggacgcgtgggctgcatcgagggtgcgcacccttcttgcgggcctggttcttgaagtcgtgcgtgcaaggactcattgggtctgccatgtactctgctgaccagtcagtggattctgctaaacaaatccagcacatttggcatcattagcctatgtttttccgagatgaactgcaatctaggtcgtagacgcaacctgtgggcattctatcagtccatgtagcagatcgaatgatcaacccatgagatttacaacagaagatggcaaacaatgtggtacatgcgatcagacgcattaaagctatatcgccaca

SEQ ID NO: 45582 - DNA, 272 bp, Zea mays
  Clone ID: LIB3066-007-Q1-K1-F6
attccctcgtcgaccgactcctacgcccactcatccgcacactctttcgctatctttccctatctgaaatactctacttcacgttgaccactattaagggggccggcactagctctctacaactacgcctataacatctcactcttcaatctcatgactcaattactaataccctaatactactacactaacatcaacctctatccatgaactatctccacgtacaactcctactcagaacacacaatattcaatgtccgcacattcactaa

SEQ ID NO: 45583 - DNA, 467 bp, Zea mays
  unsure at all n locations
  Clone ID: LIB3066-007-Q1-K1-F7
aggctccccaaagatagcatagcagcagcactcacaatagcaaaaaccaccatccgtcgtcgcgcaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctcctctaatttctcgaccccgtcgaatntttttcctttctattcttctactatactactactatcntgttgtcgc

SEQ ID NO: 45584 - DNA, 483 bp, Zea mays
  Clone ID: LIB3066-007-Q1-K1-F8
tcggccgacgcgtccgcccacgcgtccggccatctgatcaaccagccagccgatctcagcgatccgccatggccgcggcgtattacgagaggccccgtggcggcgccgtcgaggaggcggacgacttcgatgagttcgaccccacgccgtacggcggtgggtacgacctcgccgtcaccttcggtcgcccgctgccaccgtccgaggaaacctgctacgcgtgctcggcgccctcgacctcctacgacgcaccgcactacgccgcctccgagccgtccccctacggtcaccacgccaagccaaagcccaactacgggttccgcccccagcaggagcaacagccgtcttacggcagcggctacggatccaggcccgagcccgctgcggaggagggcggtggctatggatctggcttcggatccgggtatgggaggaagaagcaggaggaggagagctacggctctggatatgggaggaaaccgc

SEQ ID NO: 45585 - DNA, 397 bp, Zea mays
  Clone ID: LIB3066-007-Q1-K1-F9
ggccgtgcaaatccatttcttgccttgccggcacagctctgcatagctcctggcaagggttaggattaggatttggatttggatttggatttggatcgggtgtgtttcctgcgtaaccatgagcgagatcatgaagctaaagcgtgggatcagcaccaaaccaggagaccacctcgtccaaaatggccaacaacatccatgtcacgaatgggaggagcaacagcgctactggccctcgccgcgggcgccgacggcgagcccgacggagtcggccaggaccccaggcgggagccagaagaaggcggttctgggccaggtgaagagcatggccaagaaatggatgcacatgctgcatcacaagaagaaacccgggccaccggaagagatgatgtggacc

SEQ ID NO: 45586 - DNA, 398 bp, Zea mays
  Clone ID: LIB3066-007-Q1-K1-G1
cccacgcgtccgccttgaaaaggggtgcggccccaactacctggcgctgctggtcaagtacggggatggcgacggtgacattgtggcagtggacgtcaaggagaagggctctgacacgtacgagcccctgaagcactcctggggcgccatctggaggaaggacagcgacaaaccgcttaagggacccctcaccgtccgcctcactaccgagggaggcaccaagtccgtctacgacgatgtcatccctgccaactggaaggccaacaccgtctacaccgacgaataattaactttagtgctgacaatactataagccggcctatgctagctatactagaattggttggatcccaagcaatgcattacacatgcatgcattggaccgtgaaaaatacttt

SEQ ID NO: 45587 - DNA, 185 bp, Zea mays
  Clone ID: LIB3066-007-Q1-K1-G11
cccacgcgtccgcattctttagataaaagaagcagcttgcttcctccctccgtgttcagaaggtcaggaagcaacgccccacatgtcaggtcaggatctaatatgtgtaggggcttgagaaaaaaggcgaataattctgtaatcaggatgtaaccgaaatactacagttttttttttcttgtgac

SEQ ID NO: 45588 - DNA, 369 bp, Zea mays
  Clone ID: LIB3066-007-Q1-K1-G12
gaacataagggggagatgaaggttgtggtcaggacagttatttcactcaccagggaggaggagaaagaactcaaggaaaccttgcaggatatccttggggaaaacaaaactattttggttgaacagaagattgactacagcatcatgggaggattagtgattgaattcgggcagaaggtgcttgatatctcaatcaggaacagggcgaagcaaatggaggcgttcttgaagcaaccacttgacttctaacagccttttggataaaagcatcatcggaatgcagaggctgtccttgtgaaggttttcctgtgtctgcaattttaatctgtcctttttgataaaatgtttcctctaacaagtgaaaggcac

SEQ ID NO: 45589 - DNA, 430 bp, Zea mays
  Clone ID: LIB3066-007-Q1-K1-E8
acaccctcgacgaccgactcctacacgcacgcgaccttgaactcctcaccgagctttacaccgcaaagacgcaatgataccactgggcctccatcgagggggccggcatgacattattcaccgacacctaccacctcttctgcatctccctcgtgactaacctcctcggccgcatctactacaccgtgtaatggtccgatacgccctccaccctcccaccgcacgtgtccacgtccgtcaactgcgtggacttcgctgacacgctgtcacgacagctcttcttcagctggctgggctacaagctctggcacaagaacgtctatggcatgacgctcatgctcatggtcctctgctccgtcacatcccagctctcgttccgccacaccccggcgttcgtcatggcaacactctgcttcttccgcttctggct

SEQ ID NO: 45590 - DNA, 257 bp, Zea mays
  Clone ID: LIB3066-032-Q1-K1-C5
cggacgcgtgggcaaatcttcggcttgttcctccctgttctgaatgaaagttgcagactgttagaatgctcaatgcgccttacattcaaatttcaaggcctgattgaggttgaaataaatacttgaaggccagatctgttccttatgtagcttgcttcccctcgtctaggggcggagggagcttctagttaggaatgctggattagtttgagaagttgcagactgttagaatgctcaatgcctagttctagtcgcga

SEQ ID NO: 45591 - DNA, 318 bp, Zea mays
  Clone ID: LIB3066-032-Q1-K1-C6
ggctgccgtacctggacgacggacccgtttccgacgacacgcctggttccacggacatgggcgccgcggcgggcgacctgaaggcgcgtgagatccgcatgctcggccgcatctctgacatagagctcgcgttgcagaaccaccagatcgggtcgctatgcatctccagcgacttctcatagaaaggcgaagtactcgcggagactaccgagaggaatatggacgtcgtcatgaccgcgctctgcctgccggactataacgagcgccaacagcccgccgagtactatgacccgtaccatcaggagctgcagccgcctg

SEQ ID NO: 45592 - DNA, 426 bp, Zea mays
  Clone ID: LIB3066-032-Q1-K1-C7
cccacgcgtccgcacgcctagcttctctttccaaaagcatggcgttcactgccctctcattgctataccacctctcgatcactgtatcgcttgtcctagctcgtggcattatcatagccggtgttgttgacatagctccacgtcccactcctctacctcttcctccgcagccacttcttgcaccctctccgactcctcgtcctccaggtcttggggcccctactcgcactcctcctcttcctcttcctcttccttcccctaggccaccacgcactccgcctacaacgactcctcttccacgtccatggttgggggcaccttctcctgcccgtgttcctcgtcctccacggctcggagcaccccctcgtactcctgttcttccgtctcctcgagtaggtgctccatcttccgcaccttcttctgttc

SEQ ID NO: 45593 - DNA, 390 bp, Zea mays
  Clone ID: LIB3066-032-Q1-K1-C8
cgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattc

SEQ ID NO: 45594 - DNA, 370 bp, Zea mays
  Clone ID: LIB3066-032-Q1-K1-C9
cccacgcgtccggaaagaactcgaatcaatttacaggcagtatccatttgaacctctgaaggatcgagacaaaaccttgaagctcacttatgaagaaagaattcaaatgtcgaaggaagccggaccagaaatggaccctttgggtgacctaattaccgaacttgaaaaaaaacttggtcggtttgtaagggaaaagtttaccccaaattttttaatccggattaggtatccttgggctgtacgtccgttctacacaatgccttgttatgacaacccatcgtacaccaattctttggatgccttcattcaaggaggggagataatatctgaggcacaagggatacacactccagatctggtggccaagcgc

SEQ ID NO: 45595 - DNA, 246 bp, Zea mays
  Clone ID: LIB3066-032-Q1-K1-D1
ggcggggatgacgtcgtcgtagacagtcttagtgccgaatggaagcccaacactgcctacaccacttgatagaccttttttatttttttattcaataaaaggatataaggtgtgtgacaacaacacaaatattgtattatctatgtatctcctatgcaatcccaattttatcatggacacattttaaaatgaatacatatttttaatgaataatcgaaatatatgatacatatgtatcaattctag

SEQ ID NO: 45596 - DNA, 396 bp, Zea mays
  Clone ID: LIB3066-032-Q1-K1-D10
gcgtcacgcttactgacgtgttgtccatggccattgttcaagccgaccaactcctactggtccagagagatgcaatgtccggctcgcgatacatgacttacccgggcacacaggtcacattcatcttcgtctatgatggccatggttgcccatgagaccttcggttgcatcaatgactacctatgcaaccatctcagaaagtttgcaactgatcgcatgtggatgtcagcaaacctgacccggtaagctttccaagctactgaagatggatgactctctatagtcagcaaggaatggtctgtgaagcatgagattcgacaagacgactgccgatacctcgtaagcataatcagcgatctgacatctgtatgtggtatacgtgttcaactcaaatgc

SEQ ID NO: 45597 - DNA, 428 bp, Zea mays
  Clone ID: LIB3066-032-Q1-K1-D11
caggttgcttttcttaaatcaagaaaaagttttgtcaagatagctatacagtctggatgtgctttagtcccagttttctgctttgggcagagctatgcatacaagtggtggaggcctggtggtaaattgtttatcaagatcgctagagcagttaaatttactcctattatcttctgggatagatttggcacaccattccccttcccaaaacccatgcatgtggtcgtgggtaaaccaattgaagtcaataagattccccatcctacaattgacgagacaattgcaacagtatgcatgttcttggcgggaaaagttgacgaaacacccagacctctgaaggatgtcatacttctttcatatgagatcatccacaaaaaggatcctgctgcagttcaacgaatgatacagaaggaagtatatgaacaaca

SEQ ID NO: 45598 - DNA, 443 bp, Zea mays
  Clone ID: LIB3066-032-Q1-K1-D12
cccacgcgtccggtggggttcttgaggttgtccggatttcaagatctgggtatccaacaagagtgactcaccagaagtttgctcggcggtatggttttcttcttgaggatgttgcatctcaagatccactcagtgtttcagttgcaattcttcatcagttcaacattttacctgagatgtatcaagttggctacacaaagttgttcttccgaactggtcagattggcaaccttgaagatactcggaatcgtactctgcatggtattttaagggttcaaagctgtttcagggggcatcaagcccgtcatcatgcaagagaacgaacaagaggagttttgactcttcaatcattcattcgtggtgagaatgcacggcaaatttactcctctttgttgaggaaacatagagccgcagttgttttgcagagaaatgtgagatgttgg

SEQ ID NO: 45599 - DNA, 395 bp, Zea mays
  Clone ID: LIB3066-032-Q1-K1-D2
ggcgaggaggacagggagccgagcgcaagagctgaggcttcgccgcgaaaccccagacctcgcgccgccccttcccctccgcggcgtcgtcctcgcacgctctccgatccaagatgtataagctggggagaggaaaccgcgacaaggtgcagcagttcatgaccattaccggcgccagtgagaaggttgcccttcaggcactgaaagctagtgattggcacttggaaggagcttttgacttcttctatagccaacctcaggtttctgtggtcaatactcggcatcttgaagatattttcaacagatataaagaacctgatgctgatatgataatggtggaaggaatatctcaattttgcaatgatctacaggttgatcctcaggatattgtcatg

SEQ ID NO: 45600 - DNA, 297 bp, Zea mays
  Clone ID: LIB3066-032-Q1-K1-D3
gccacgctcgaagccgaccatctatgacaggtcgagctcggcgcacgctcgggcagggcaccttcgccaaggggtaccacggccggaaccttgcgttcggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtgcggggcggcgagctcttcgcccgcg

SEQ ID NO: 45601 - DNA, 427 bp, Zea mays
  unsure at all n locations
  Clone ID: LIB3066-032-Q1-K1-D4
agatcacccattggaaatctgtatttctaatttgttgggggatactaggcgtatgaactagtatctatgcagtgggaactatatcagacagttattcaaaaatgtacctgaacaccaatagtacgttggagaacgttgcttcgaccaggattactatcttcgatctgaaactctgataagcagaattgaagacaaacgatcgggtacttggggaatatggaatttatttactgttggtttacctagtacttgcctaccagccaggcgccccaggggacgacggcaaagatacagtctcgggtattaggatggcaaaggcagcgatagataaattctactccaagtatatgttgggatcacgtaagctggtgcttgacccacattcaacgatctttggcaaaaggatgctngtcaaaagtgcgatcat

SEQ ID NO: 45602 - DNA, 436 bp, Zea mays
  unsure at all n locations
  Clone ID: LIB3066-032-Q1-K1-D5
accgttcggaattccggtcgaccagcgtccgcatggcgagctctgggtagtagataatggccgatgccgagntatccagcccctcgtctgcgacaacggaactggcatggtcaaggctgggttcgccggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcctcctcaccgaggcgcccctgaaccccaaggctaacagggagaagatgacccagatcatgttcgag

SEQ ID NO: 45603 - DNA, 82 bp, Zea mays
  Clone ID: LIB3066-032-Q1-K1-D6
attatattgtacctaagtattacttggcgtcccatgaatccgttgtaaatatcaagttgtaatttctactatcttcgttctc

SEQ ID NO: 45604 - DNA, 272 bp, Zea mays
  Clone ID: LIB3066-032-Q1-K1-D7
tcgaagatgccgaaagcatagaaaataccgttacaagttaaaccagcatatgatgctgcctgatcactgctgtctgaaaaggtcagatatcgtgatgatgatggaatggattctattcttgacgtagatgatgtcctaattgatgctgacaggatggataacgatattactatggacattgtgcgataagagatgaacgcttgtggcagacgatgatcaatcagtcagggtgagagacttctacgtgacatatctgaagtttatgttgacac

SEQ ID NO: 45605 - DNA, 425 bp, Zea mays
  Clone ID: LIB3066-032-Q1-K1-D8
cccacgcgtccgcccacgcgtccgcccacgcgtccgcccacgcgtccgatggacaactctttagggcgcttggtgtattcgcacagaggaaaatcaacctcacaaagatcgaaagtcgtccacacaaggagaggcctcttcgagtatctgatgactgttcctcactcttaaagaattttgattacctcttttacgttgaccttgaagcatcaatggctgatccaaagattcagaatgctcttggaaatctgaaggagtttgcaacctttttaagagtcctcggaagctatcctacaaatgtgaatgaaccttagaaaacactgcagattacatgatggattagcaggaatggacgaaatggtttgagttggttctctgagcaagttgacaagtgaggacctctatgaagctgatgctaacattta

SEQ ID NO: 45606 - DNA, 343 bp, Zea mays
  unsure at all n locations
  Clone ID: LIB3066-032-Q1-K1-C4
cccacgcgtccgcccacgcgtccgcccaccaccgcctcgcctcgtctccgctctcttcctcggacaaagccggggccgttcggcgggaggcaggggacgcacgggcaggcagccatgaacggcatcaaccccaacggcgggttcctgtcgtacgggaacatggagagctacgcgatgtgggtggcgaccggcgtggcgtcggccttcttcgcgtccctcgagcgctgctcctgcatccacctncacaccgcggaggacgacggcgtcgaggaggaggaggacctcgaggaggcccgccgctccttctcccgcccgatccctgagtactactacgaccggtccg

SEQ ID NO: 45607 - DNA, 80 bp, Zea mays
  Clone ID: LIB3066-032-Q1-K1-D9
aaaaaaaaaaaaaaaaaaaaaaaaaacaattttaaaaaaaaaaaaaaaaaaaaaaaaaaaaaagaaaatttgtcagacga

SEQ ID NO: 45608 - DNA, 273 bp, Zea mays
  Clone ID: LIB3066-032-Q1-K1-E1
cgtacgcgcgcatggacgacgatggatccgtccaccgttgccattgcagttgcctcgctcgttcttggtgactgttgctgcggtggtcgacttggaagacgtcacctgcaccgctgttcccatatattattgatgtgatctgatatgattatatatgcatggtgacgggtttatgataattccatagacataatttaatttaatttatgtatttgtgtcaagtcgttctgtaatcatgcgatgaaatatatgatttggttttccatttgtttg

SEQ ID NO: 45609 - DNA, 369 bp, Zea mays
  Clone ID: LIB3066-032-Q1-K1-B1
gaagaagagaaatcttgggcccgagcagactgaaatgcccgagggaaaaacccaagacaatccccccttccaagcacgcttatcaaaccatcaaccctaacatattaaggcactgacttaattcacacgcagaaatcaacggtttgcaggaaatcgtccatgccgcggccgaggtcgcagccaggcatctccgggaagacgtcgttgatatcgtcgaggtcgaggtcgatctccagttcctcgtccccgaagtccccaagcagcaggtcctgctcatcgtccaggcagaagggcgcatcggagacgtccagagcgtcaagcccggcacggaagtccatcgggctgatgtctggcagctgcaggccgcgg

SEQ ID NO: 45610 - DNA, 422 bp, Zea mays
  Clone ID: LIB3066-032-Q1-K1-B11
cctctctcccttcgtcaccatcacatccagtcagccaacaaaaatgtcgcgcgtcacagctgcggtgctcttctacatcctcgccgtagctgccctcagcgcggccgaagccccggcagagtcaccgaaggaaggcagtgctgccaaggcacctgagtctgccaagagaactgctgcccccgctgaagcacccgaagccgcatccacccccgtcgccgccgctgccccatcgccgtcgtctaagaagtctggtccagctaccgcgccagccaccgcctctacacccccttcttccacggacgaggagttgagcccttccccgccagcatccaccgccgcggcgtcccctgcggctgaaggaccggctgctgatgactccgccggtgctgctgcccttggaagtggagctgccatcgccggcg

SEQ ID NO: 45611 - DNA, 282 bp, Zea mays
  Clone ID: LIB3066-032-Q1-K1-B12
tgcgacaagaccgtccacttgatcaacctcctcacagccgacggcgttacctaccatatgacatgcttcaagtgcagccactgcaaagggatcctctacatgagcagctactattgcatggacggcgcgctgaactgcacgacccacttcgagcagatcttcgtggacaccgacagcttctccaagatcttcacgccaagtggccagtcttcagacatgggtgtactggcctgaggccccagcatgctatcatctgcgtagtctggtactcacgagaagtgt

SEQ ID NO: 45612 - DNA, 303 bp, Zea mays
  Clone ID: LIB3066-032-Q1-K1-B2
cggacgcgtgggcggacgcgtgggcggacgcgtgggcggacgcgtgggcggacgcgtgggcggacgcgtgggcggacgcgtgggcggacgcgtggggcgcacaccaccgcatggaattgctctcgacgcccgattgagccgagcgatgtgagagattgggagaccatgccctctccccgccaccatggattcccgcctgtgtggccaactgggcactggaggatggctttggcgcttcaccggtcaactgggatcatgcccagggcccgtgggatgatgcgagtttggctgggagaatggagc

SEQ ID NO: 45613 - DNA, 252 bp, Zea mays
  Clone ID: LIB3066-032-Q1-K1-B3
cggacgcgtgggcggacgcgtgggcggtcgcgtgggaaaaaaaaaaaaaaaaaaaaaagaaaagaaaaaaaaaaaaaaaaaaaaaaaaaaaaaaaaaaaaaaataaaaaaaaaaaaaaaaaaaataaaaataaaaaataaaaaaaaaaaaaagaaataaaaaattgatgaagtcgaagtagaatgcatcacatttttgcaaagaaaaagttaaatatatatcttgtcaaaaaagatttaaatgatcttattt

SEQ ID NO: 45614 - DNA, 371 bp, Zea mays
  unsure at all n locations
  Clone ID: LIB3066-032-Q1-K1-B4
aacaactttgcgtcttcccgaatcggggcctccaccatctccaactgcaaccccacccgataccgccgccgcctccgctagggttttggagtgaggatcgccgatgtcgacggctcccaggcgccccttccgaggccgcggcgccccgccccctggcaccggctacgttcgccgcggccccgcccctgccccaggccccgccgacggcgccaagaccctgcgcaagcccgtcttcaccaccgtcgaccagctgcgcccccagacgcacggccacaccctcnaccgccgcgtcatctccgcccgcaccgtcctcgacaagcccttcacgcacatcggccgcacccgcgtcgcagagtgcctcgtcggagaca

SEQ ID NO: 45615 - DNA, 385 bp, Zea mays
  unsure at all n locations
  Clone ID: LIB3066-032-Q1-K1-B5
cggacgcgtgggcaagcgagaagcgaccgactcccgccgccgttgccagccatggacggcggtgacgacctcgccgccctgcacgagcaggtcgccctcgcattctccgccgccatctcggcctccgacctcgaccttgccttccagctccaggtcgccgaggccatccaagcctccctcggcttgcccaatgccgccgccccgtcatcatcgtcgcaagccgccccagagtcatcctccgacgccacctacgccttcgccgtccaggccgccgatctcgcgcgcgcagaggaggaccgccgcgacgccgaggcctgccgagccgncaacgcccgagccgncgncaacgcccgcgtcgtcgcgcacgacgccctcttcgcccgcg

SEQ ID NO: 45616 - DNA, 391 bp, Zea mays
  Clone ID: LIB3066-032-Q1-K1-B6
aggccggggcgtgccggatcgcggcgccgtcgtcgcggcccgccgccgccgccgccgcgccgtcgtcggactcatcgagctcgctgctgacgcagctcatcgcgtcgtcctccttcggcggggccgcgtcgtcgcgccgccgcctcaccggcacgctcttcggctaccgcgacggccgcgtgtcgctgtcgctgcagcagaacgcgcggtgccagcccacgctggtggtcgagctggcgctcccgacgcacgcgctgctccgcgagctcggcgcccacgcgggcgcgcgcatcgtgctggaggtcgagaagcgcgccgagcagggcaccgccgacggcaacgaggccatcgccaccaccgaccacgacgggtgggtgctggaggagctcat

SEQ ID NO: 45617 - DNA, 273 bp, Zea mays
  Clone ID: LIB3066-032-Q1-K1-B7
gcaccgcaagattcagaggaggacaaggcagagctcacggggctgcggaagccatggccaccaccgaggagaaggctctccttgtactcactaggcaaggaggggcgaaggcgccgcaggaagggaacgccgccaccgccatgcccgccgccacttgtaatctccgcgatgctctagctagctacagtacataacaatgcaatgagcgagcgaccggcaattcaaactccaatgccgtatgtaatcggtaagtaaagtacctgatcattaagt

SEQ ID NO: 45618 - DNA, 357 bp, Zea mays
  Clone ID: LIB3066-032-Q1-K1-B8
gtacggtctgttggaatggattaggtgtggctagttttggtttggtgcatcctcgtatgtgcttttgcaggaagattttcgtagggggtgtagcttgggagacaactgaagaaacattcacaaagcattttcagaagtatggagctataactgattctgtgatcatgaaggacaagcatactaggatgcctcgcggatttggatttgttacattttccgatccatctgtgcttgacagggttctagaggatgaacatgtcatagatggaagaacagttgaagtcaaaaggactgttccaaaagaggaaatgtcatcgaaagacggtcctaagacaaaaaagatctttgtgggtggta

SEQ ID NO: 45619 - DNA, 426 bp, Zea mays
  Clone ID: LIB3066-032-Q1-K1-B9
gcaagtaccccgctgggcagaagatcgtgtttcacatcgagaagggctgcaaccccaactacctggccgtgctggcgaagtttgtggcggacgatggcgacatcgtgctgatggaaatccaggacaagttgtcggctgagtggatgcccatgaagctctcttggggctccatgtgcaggatggacactgccaaggcgctcaagggccccttctctatccgcctcaccagcgattccggcaagaacgtcatcgctaaagacatcatcccggcgaactggagacccgatgccgtctacactttctacgtccaattctactagactttgaattgccttcgattcatacggcgcgggggtctatggacctgcagcagcaagctaattaagctggccgatatctatataatatataatggaagccctgggc

SEQ ID NO: 45620 - DNA, 391 bp, Zea mays
  Clone ID: LIB3066-032-Q1-K1-C10
ggactctgcagacagtctgttcggaagcctttcaatccggaacaccccccatcagagtgccggtaggaaatctatggacgtcttgaagagaaggcttaaagattgtaactaaggaataaatcgctggcactatcatatagtatctatctcttagatttcaacttcctcaactgctttactagagttggtcgacttgtctttgtaggagaagtgtctatacatctcgagagagtgacaccacatgaagctagacagagacgacgcctataagctattcaggctgacgatgctttacgcttacattccactggccgactggctcgaccgcttatgcagacttggctaatctgctattcagagctagcgccttcgattcgcttaagacagtgac

SEQ ID NO: 45621 - DNA, 426 bp, Zea mays
  Clone ID: LIB3066-032-Q1-K1-C11
cggacgcgtgggtgaggatatgaagaaaacttgaaagaacttcatgcatgctctgaagtgcctcgtagttgagtcagaacaaggcgcggatgggtgcgacagagctgtgggatctcttggcctccgactcagagcaattcgtggagatgtgcagggtgtatcaacacctcaagctgaagaactggtttgtaaggtcgagactacagtacggggcagactttgttgctcactgtcatcgtccgacacttgcgcactcgtagttcgtggaggttgtggctctagaagggaaagcattcgacaccaggtgtgccctcatgaaagtctggtctgaactattatgtgtgctttgggactcttcaagtgtggccaagacgttacttattcttaccatcagcaccaagagctatgagctaggatacttggatt

SEQ ID NO: 45622 - DNA, 440 bp, Zea mays
  unsure at all n locations
  Clone ID: LIB3066-032-Q1-K1-C12
cccacgcgtccgcacctatggtggtgcctagtgggcctaaggtgccagccttgctcgcgtttggagattcaatcgtggacacaggaaacaacaactacctggtgaccgttgtgaaggccaacttcccgccgtacggcagggagtaccctaaccacaaggctactggcaggttctccgacggcaagatcaccgaggactttctagcgtctgcgcttgggttgaaggagacgctcccgccatacctgaacaagagcctcaccctggaggacctcaagaccggcgtcagcttcgcgtcggcggggagcggctacaacaacgccacgtgccggacgtcgtcgaccatgacgatcgagcggcagctgcagttgttctccgagtacaaggcgaaggtggngggcatccacgagagggccctcttcgtggtctgctccggcagcaac

SEQ ID NO: 45623 - DNA, 382 bp, Zea mays
  Clone ID: LIB3066-032-Q1-K1-C2
cccacgcgtccgcccacgcgtccgcggacgcgtgggatctaaagttcaacgcccgcaccgcaagcgcaacacgccaacacccgagacccgacgcggccttcgccttccctccgcgcgagggagattcgaggggagagaggttctcaccttcgcgcctgcggttgcttggcgcagagtcgtcgcagatggaccggtaccagagggtggagaagccgcgggaggagtcccctatcggcgccaacgagatccgcatcacggcgcagggccggccccgcaactacatcacctatgcgctcgccctgctccaggacaatgcaacagatgacattgtcatcaaggccatgggaaaggcgatcaacaagacagttgccatcgtggagct

SEQ ID NO: 45624 - DNA, 351 bp, Zea mays
  Clone ID: LIB3066-032-Q1-K1-C3
cccacgcgtccggacagacctccggtcagtaaacaggcagatggcataatgacctatgatgtatgtagacaaactcttggatgttactgatgaagaaagaattccaatgttcaccgatgccagcccagaacttgcacctatctgtgacctcggtaccgaaggtgccaacagactgcataaggttgacacgcaaaggtacgacacaccttcgaccatcctgggacctcatgcttcaggtgtgcatgcgatctacagcatgccgagttgtgagaacccagcttacaccggtattatagctgtgttgatgcgctgcgaggtcgatctatctggagcacgacggatacacactcc

SEQ ID NO: 45625 - DNA, 468 bp, Zea mays
  Clone ID: LIB3066-032-Q1-E1-H4
tttgggctgatttatgtgcgtgtataggtaagggtgtcaattaacaacagtaagcgcgactactctgccgacttactccgtcaacgatttcgtgcgtttcctgtctctgctctgactttgatgatgtctttcctggtcttggtaaattatactaagctgtgacggagacgaagaaggctgttcgtgttgcttctgttgctgctgttcatggtattgcggcttctgttgatgaggttttggtgtttgtgtttattagtgttcgtctggtcgtgcctttggatgctggtgttgcgtcgagtgttcctgcgtctcttcctcctgatcatcattcgtagcataaccaatggaggactggagggagaggtcgtcggtcgttaccgttcgcacctggccggactttgcccacacacacacacacacacccaagcatcccaacccgtgctctgatacgctgatcgacttacctac

SEQ ID NO: 45626 - DNA, 452 bp, Zea mays
  Clone ID: LIB3066-032-Q1-E1-H6
ggcttggaacctttgggctgatttatgtgcttgcttatgtgcttgcttatgtgcctgtgctgttaatgttaacaaacatatttgtgggcgtgagtttacagaatgtcgtaggggtgtgtgtcgactattaagtacacatacacagtatactgaccctccaccaccgtacgtatgcccacacaagcgtctaccgctccgtcgccgcaagcgttagtataagtacacacatggtgcccacacacatcatacatcttgactgcctaaaaaaaaaaaaaaaaaaaaaaaaaaaaaaaaaaaaaaaaaagaaaaaaaaaaaaaaaaaaagaaaaaaaacagaaacgaaataaagaaaacacaaaacaaaaaaaaaaaaaaaaaaacaaaccaaacgacaacacaaaaccaaaccaaccgaaagcaaaccgggtggcggcccgacgggaaaaatccgc

SEQ ID NO: 45627 - DNA, 504 bp, Zea mays
  Clone ID: LIB3066-032-Q1-E1-H7
ggcttggaacctttgggctgatttatgtgcttgactaatcctcggatggtgggtactgagggtgggcggggtcggtgtactgggtcggggtctgttgcttagaagccgactaggcctgttgttaggacgttgacggcggctactagtcggaatttgacgccgattagcgtgcgcgtctacttgcgtatgttggtaacggcgcttcttgtttgcgtgtctactggttcttctgctgttgtggttctttctgttgctgtgtctctggacggtggtgggacggtggtgttcgcgcatgggcatgtggtggggagttttaatgggttggagaatcgggggaagtcgagttttgtgcataagtcgcgtggcgaggggaagtagtagcttttgactgatactgctattaagtaggttgcttttgttgctagttctgatatttctaactgtattcatggtgttattaatgttatgtctactaatgacggttatgatactatgtcggtgtcg

SEQ ID NO: 45628 - DNA, 473 bp, Zea mays
  Clone ID: LIB3066-032-Q1-E1-H8
ggcttggaacctttgggctgatttatgtgcctgcttatgtgcttgtgactataacaagacggtgcgcacagataacgtaacgagagttccgccttccccagtgtctcctcgcgctgcgtacggcgagaaggtaaagctaaaggataatgacgtaaaagtgcttgggtttggcgggcttcctgatactattaagccgggtgttcttggtaacggtaagatggacagtatgaaggtcgcgtaggaggtgcgggtactagtgcgtggtggtattgggaagtagatgacttctacttttaagggtgatccttctgctggattatctaatcctataggtttacgtaagggtgatgcgattacttaggcgaacggtaactcgtcggtgattatggattcaagttagcataaggactacggcaaccggactgagacctcatgtgcggataattccgctactattggtaagggaaagtctg

SEQ ID NO: 45629 - DNA, 490 bp, Zea mays
  unsure at all n locations
  Clone ID: LIB3066-032-Q1-E1-H9
tggcttggaacctttgggctgatttatgtgcttgagaatgttatttctgcgcttcttgctactattggttctgctaatgctcctcttattcctgctgtgactgttattgttgataagactggatgttgtgtgtctccttcgtagggtggtatgtagacgactactctttagacttccgcggggatgcctactgggtcgtagcctggtacgagtgggatgggtgatactctggagtagcatgttacgcgtactgcgtcgcctgcgcgtgcgcatgcggttggtcctgtgcggctgcgggggtttacggggcggtcggcttttagtgagactcatttgtcggttgcgtggctggtggtgacgagtgctatggcggttgctaatacgcctcctatggttcctactgggtagactccttctatgtcgtctcgttattcntgtcctggttctcctcatcctcctggtgttcgggcgtcgtctacgatatctccta

SEQ ID NO: 45630 - DNA, 378 bp, Zea mays
  Clone ID: LIB3066-032-Q1-K1-A1
cccacgcgtccgcccacgcgtccgcccacgcgtccgcccacgcgtccgcccacgcgtccgcccacgcgtccgggccggcctcgcctcacactcccgcccgcctccggcgattcatccacccaataaagtatccaaccctaacgatccggatcgccttaccccgcgtcatccacgcgaattgattcgattatcctcggattttccccgtttttttgtgggtttcctatcttcttcgatcggagtgctagggtttgggcgcgctcggtgggcggcgtactccagggtcatcgttagttggacgggctagggtgctttctcaccgggggaagggaagcgaatccaaacgatggagaagaagaaggtggcgatcccgctggt

SEQ ID NO: 45631 - DNA, 441 bp, Zea mays
  Clone ID: LIB3066-032-Q1-K1-A10
caactgggcttgccctctgctgagagacacgatgaggttactgaatgctgccggaccgcgctctgggcgactattacccagtgaaggcactgtaccaggcgcatcgtcgacccgtccatgtgcctgcacgaggacgctgactaccggccggtgatcagcgacgtcgtggcggcgctctccttactagccgacccgaaatactaccctaccggaggcacatgaagctgaacacatgagcacgcatagcaggacagacaacgatagcagacctcctaggacctagaaggtcacgtgagacgacgacatgaagcatagatgaccgtatagggggagctaactaacgggaaacatggcaaagggaggatctgcagagctgtctgaatgatctcttcaatctgaatttcgtataaggcacaccacgtaggcaggatgtaacatcat

SEQ ID NO: 45632 - DNA, 380 bp, Zea mays
  Clone ID: LIB3066-032-Q1-K1-A11
gcgtccgaaccgagctttcagtatgctgaaagacagcttgatttaagaggacctaagacgacccatggggggcgagcaggcacgcagtcaaggcgctataccaggcgctcccctgcgggtacatgtgactacaggatgacgctgccagccggtcggggatcatggacgtcttcgcgagactctcgttgctctccgacctgcaatactacgctcacggaggcacggaagctgaacacaagatcacgcatagcattacacacaatgatagcagtccttctacgaccgatgtggtctgcacttacgacgacattaagcatagatgaccgcagagggggagctaattatctggacacattggacaggtaggatttgcagagctg

SEQ ID NO: 45633 - DNA, 412 bp, Zea mays
  Clone ID: LIB3066-032-Q1-K1-A2
cccacgcgtccgcgcccgtgtaccagggccacggcgacgtggacgtgtggtcgcccgtgctctccggccccggcgtccccttcgcgccctacctcgccgacgcgctccgccaggactgccaggcgggctacctcgtcctccaggtcaaggtcgacggccgcgtgcggtggaaggtcggcagctggatctccggccactaccacctcttcgtcacctgccccgcgttcctcgtcaccgccggcggcaacggcgcccccggcgcttccgggttcaggttccagaccaccacgtactgccacgtcgaggtttaattaggagcgagaggaagcagagaccatggctacctctctagctgctgctcctgcccgtgcctggtgtgggaataactctctctatctctctctctctctct

SEQ ID NO: 45634 - DNA, 308 bp, Zea mays
  Clone ID: LIB3066-032-Q1-K1-A3
ctcacgcgttcgtacccacgatataggtggaaaccatagctcctggtcggatcacgctactaacgtcggtctccgtccgttctgactgcccatccaccgagcactggaccgacgatccgagtccacatgaaatccttctcttctgcaaggttgactgaccgtatgcgtatgctagctcagaacctagagtaccaaatcatggcaagggactgctcagtgcacggagttctgatctgcgatcgcttttgcccgaactggtcgcgctgatgagtgcacatgcgtctgattctgagtcaggaaaacatgat

SEQ ID NO: 45635 - DNA, 344 bp, Zea mays
  Clone ID: LIB3066-032-Q1-K1-A4
cccacgcgtccgcccacgcgtccgcccacgcgtccgcccacgcgtccgcttattttgcgacccatcccattcccacgcaaaggcaccgagcgtgatctccgtccgtgccgccatggcctcgcaccgggcgctgctgctgctgctcctcgccgccgcgctcgtcgctgcgctggccgctgtcgcatacgccgacgacgccaacgccaagcccaccatcctgacccccgtggcgcataccccgctggggtccttcgacggcgacaagccggcctctgacgacgacgccgtcgacgacgacgaggaacgccgccctgtcggcgcgcccaacggggccaccatgactg

SEQ ID NO: 45636 - DNA, 423 bp, Zea mays
  Clone ID: LIB3066-032-Q1-K1-A5
cggacgcgtgggcggacgcgtgggcttggaagcgagggaggagagtggagggagagggaggagcgaggcaccggtgagttcgggaggcggcgtggggcttgcacgccggccctacccccagctcactcaccacgctcttgtctgaccaactctctctctctcttatctccttccaagattcccccatttttttgttgttgtcccccccattcttgctaggatcattccttgatctttcgctcgctccagtacgcctgttttccagctccggagatcccatctcggccacctcctgcggtctccaagctccaagaggccagattccagcacaaatttgaggtcaatttgcccgctgagctcgaatcaatccgctcggcaacaagtgtcatttgttcccccgatccccgggcttcgattcgatcg

SEQ ID NO: 45637 - DNA, 381 bp, Zea mays
  Clone ID: LIB3066-032-Q1-K1-A6
cggacgcgtgggcggacgcgtgggcggacgcgtgggcgaggagcacaagtctatgtgctacagccttcgtgtccatgtgctacccttcttcaggttctacagaggagcacagggacgactctgcagcttcagctgtacaaacgcaactattaagaagttcaaggatgcacttgcgaagcacaagccagatagatgtagctttggcccaacccgggggctagacgaatcggagttattagccttggcagcaaacaaggaactgcagttcacctacaccagggagccagaactgactcccaggggagatacccccggggaggtcattgctcccgagcccgcaaagcttcctgccgctacaaagcctttggtcaagctggggtc

SEQ ID NO: 45638 - DNA, 411 bp, Zea mays
  Clone ID: LIB3066-032-Q1-K1-A7
ctaatcaaattcttgttgggatatattcctccaattcccctcctcctcccaacaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagcgc

SEQ ID NO: 45639 - DNA, 509 bp, Zea mays
  unsure at all n locations
  Clone ID: LIB3066-032-Q1-E1-H3
tggcttggacctttgggctgatttatgtgcttgtttatgtgcttgaagctagtcctagtccgtcaaatagccctacggtgagatccggagtacgaacatcctaggcatccactacgctacactagatctaccccccggtctacccaccatcgaaccaaaccgggacgaaagctgaaacgtaaaatccccagacggaacgtagactcctcgactcctacccggccgtcttcctagcgaagttactatactagataaacggtaactacggtacctaaatccaatccgccagtctcttcgcgagtagtacgaagttggcctcttcccgaccactaatcggtcctcgcctgcaatagacccggtacgtagcggtaatccggctaggtacagacctctccgagcttaattttagcaggaactaaactaagacgtcctatanaacacgaaaaatcggcgatatacgtatgccgacggaagcattacgtcggtttacgaggagaaaacctagaaca

SEQ ID NO: 45640 - DNA, 318 bp, Zea mays
  Clone ID: LIB3066-025-Q1-K1-G5
cccgtgccctgtacctcctcgtcgcggctgtcgcggcgctcttagccacgcctgcgggcgtggacgcggccacgctggcggagatctgcaggggaaccgcgttccccgacatctgcaccagcacggtggtgagcgaggcgcacagcgccgaggtgttggacgccatggctgtatcgcacatgcacgtgcacatgttcaactcgcacatcgacgctgtgacgccccccattttggctgccgcgagctccttgcacgggcgccgcgaggtggtcgtcatgattgactatctggacactgaccgcgacggttttttggacc

SEQ ID NO: 45641 - DNA, 98 bp, Zea mays
  Clone ID: LIB3066-025-Q1-K1-G6
cccactcgtcctaaaaaaaaaaaaaattaaataaaaaaaaaaaaaaaaaaaaaaaaaggaaagaataaataaaaaataaaaaaattaaaaaaaaataa

SEQ ID NO: 45642 - DNA, 320 bp, Zea mays
  Clone ID: LIB3066-025-Q1-K1-G7
cgcgcagcgcgcccgcgcagcgattgccggcgatggcgagcctcaccctgccgccggcgatggcgaacccacggcaggacgccatcgacctccaaaaggccttcaaagggtttggctgtgacagtacaacagtgataaacatacttactcatcgcgattcagtgcagcgtggactcattcaacaggaatacagggctatgtatcatgaggaactctcccatcgcatttcatctgaactcaatggaaaccacaagaaagctatgttgctgtggattcttgatcctgctggacgtgatgcaactgttttgagagaagctcta

SEQ ID NO: 45643 - DNA, 328 bp, Zea mays
  Clone ID: LIB3066-025-Q1-K1-G8
cccacgcgtccgcccacgcgtccgcccacgcgtccgcttgcagatgtcttactcaaggggctcaaggtaagcactatttattttataaccttgaatgacctactttaaaaaccttcttgtttcaatttgtcttcaagtgatcttgctcggtgttctgatagtttttttacaagtgaaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcact

SEQ ID NO: 45644 - DNA, 424 bp, Zea mays
  Clone ID: LIB3066-025-Q1-K1-G9
aaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaggtgaatcaagccc

SEQ ID NO: 45645 - DNA, 320 bp, Zea mays
  Clone ID: LIB3066-025-Q1-K1-H1
gcagtgaggagtgccgcggcgagcagatgcggctcgacgccgtccgcgccaggcaggccgccaggtccgccggacggaggcagcagcagcagcagtactcctctagaacggaatccaggcaccaggagaccatgaaggtatccgtggcgacatgatgaacggccggatcctgcatggtcctcaagaccacgagatgtctacacgatatttctgcgcctgaggaaacgtcgatggagccggcaggacatataggacttcgatttctccgtcactgttgtctcctgcctgagcactgcgccgatgggcgccccgatgctatc

SEQ ID NO: 45646 - DNA, 425 bp, Zea mays
  unsure at all n locations
  Clone ID: LIB3066-025-Q1-K1-H10
cggacgcgtgggttcaacgacatcatccttccacctatcatggccaacaaatacgcatgtccgcctcctcctctattccaaggatattaagctctatggagagatggtcgaccaagaatgaattgaacaacaatatataaggtcgcatgcgcaaccaaacagctacatgtacattgcaggcgtgtgtgaaattgcacactaacgaacgaactcttgctccgatcacgagctagctgaagtcgacgatggcggctgtgctgaacagcaagaagacgccgcangcggtggtggccgtgctggtggcggcggcgctgctggcttcgtccgcttcggcggcgatcacctgcgggcaagtggggtcgtcgctggcgccgtgcatcccgtacgcgacggngagggccagcgcgctccccgcgtcgtgctgc

SEQ ID NO: 45647 - DNA, 441 bp, Zea mays
  unsure at all n locations
  Clone ID: LIB3066-025-Q1-K1-H11
cggacgcgtgggcggacgcgtgggcggacgcgtgggcggacgcgtggggtccccgacggcacggtgatgaagacgatccacacggagaagggcagctgcctcgccaccgacagccacatcacgtgcaaggacggcaaggtctcccaggacatcctgctcaggctcagggacaccgagaccggcgatctcgtcctgcgcctgacctgggtcaacatccccggcgtcgcgcggtgaatcatcccctcgatcggcggggacggggccagggcatgaggcggcggcgacccgactcctgcccagctgattatacatccgtttacctggtattggcataaggagacccttggatgcgtgtaatgtttgtttgcagttctgataaggtgtgcaagaaagctcatgctactgggagcaatgcttgtatctcagttntgcttctgcggg

SEQ ID NO: 45648 - DNA, 380 bp, Zea mays
  Clone ID: LIB3066-025-Q1-K1-H12
tccatgcacccatggactccgtcaccgcaccacattcggccagcaccaacgaaaatgtggcgcgccacagctgcagacctcttctacatcatcgccgtcgctgccctcagagcggccgatgcaccggcagagtcaccgaaggcaggctgtcctgccaaggcacctgccgagtaaccgaaggcacgcagccctgcaggtcctgacaaggcacccgagtctgctgccacgagaactgccccagctaaggcacctcaagccacctgcacacccgacgatgcacgctgacccatcgtcgtcgacgtctaggaagtctggtccagctgccgcgacgaccaccggcgtctctacaccgtcatattacacggacgaagagatgagcc

SEQ ID NO: 45649 - DNA, 328 bp, Zea mays
  Clone ID: LIB3066-025-Q1-K1-H2
cacaaaggaggggacacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcaccccgcgccggctggccgagctgctcgtgtacgtgtcggccgaggtgggcatgaccgtggccgcgttcgcc

SEQ ID NO: 45650 - DNA, 324 bp, Zea mays
  Clone ID: LIB3066-025-Q1-K1-H4
caaaggaggggacacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcaccccgcgccggctggccgagctgctcgtgtacgtgtcggccgaggtgggcatgaccgtggccgcgttcg

SEQ ID NO: 45651 - DNA, 322 bp, Zea mays
  Clone ID: LIB3066-025-Q1-K1-H7
cccacgcgtccgacctcgtcttcttcctggagagaaaaagcagaagacaatacaaagatgtgcaagatggcggaggagaaggcggcggcagtgggcggactcggaggagccggggcggcggacgcggcgcagcagcagcagctggcagcaggggaggccgcggcggcgcgggtgcggcccgtggagacgctgcttcgcgcggcaccgctggggctctgcgtggccgccatgaccgtcatgctccgtaaccagcagagcaacgagtacggcgccgtcgcctactccgacctgggaggcttcaagtacctcgtctacgccaacg

SEQ ID NO: 45652 - DNA, 324 bp, Zea mays; identical to SEQ ID NO: 45650
  Clone ID: LIB3066-025-Q1-K1-H8

SEQ ID NO: 45653 - DNA, 436 bp, Zea mays
  Clone ID: LIB3066-025-Q1-K1-H9
cggacgcgtgggcggacgcgtggggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaa

SEQ ID NO: 45654 - DNA, 468 bp, Zea mays
  Clone ID: LIB3066-026-Q1-K1-A1
aaaaggcactgaagaagccagtcaatagcgagttctactactagtagctagcctgctgatctgttctgttgtttagttcgcaaagccttctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaaggtcacggtgtccgagcccgagaagcacgggcacaaggaggaagagcacgaggtcgtcggcgagaagaaggaaggccttctcgccaagctgcaccgcaccagttccagcttcagctcgtcgagcgacgaggaagaggaggcgatcgatgagaacggcgagattatcaagaggagaagaagaagatgggc

SEQ ID NO: 45655 - DNA, 451 bp, Zea mays
  Clone ID: LIB3066-026-Q1-K1-A10
gtcgcgccgccgcctcaccggcacgctcttcggctaccgcgacggccgcgtgtcgctgtcgctgcagcagaacgcgcggtgccagcccacgctggtggtcgagctggcgctcccgacgcacgcgctgctccgcgagctcggcgcccacgcgggcgcgcgcatcgtgctggaggtcgagaagcgcgccgagcagggcaccgccgacggcaacgaggccatcgccaccaccgaccacgacgggtgggtgctggaggagctcatgtggaccatgttctgcaacggcaagagggtgggctacgcggtgcggcgggaccccaccgaggaggacatcgccgtgctggagacgctgtgggccgtctccatgggcggcggcgtgctccccggcaggtcggacatggacggccccgacggcgagatggcgtacatgcgcgggagcttcgagcacaccgtc

SEQ ID NO: 45656 - DNA, 438 bp, Zea mays
  Clone ID: LIB3066-026-Q1-K1-A11
acgaggcgcaccggtgctgggaggacatcttcgacgccatcagcggcgctaagcacctgatgtacatcacgggttggtcggtgtacacggagatcacgctactcaaggacggcgcccgcccacccaggcccggcagcggcgtcacgctcggcgagctgctcaagaagaaagccggcgagggcgtacgtgtgctcatgctcgtctgggacgaccgcacctgcgtcggggcgctcaagaaggacgggctcatggccacccacgacgaggagacgatgaactacttcgagggcaccgacgtacactgcgtgctatgcccgcgaaaccccgacgacttcgggagcatcgtgcatgacctgcagatctccaccatgttcacgcaccaccagaagatcgtcgtcgtcgaccacgacatgccggtgcagcggtcgcatcggcagc

SEQ ID NO: 45657 - DNA, 327 bp, Zea mays
  Clone ID: LIB3066-025-Q1-K1-G4
cccacgcgtccggacgaggctctggggaactcttcggaagcatcgaagagacaacagggaaacagcgacaagaatgcaggctcgggagtggctctcggaagcaacaggagctggcatccatcgtctggtaaccctagtcggggcggccaggggaatcaccaacatgacagggactctcacagcggtgattcgcggcggggtagctcgaactacccccggaggtccgacaatcgtcatgaccatggcagtggtggttcgtcacgaccctcgtcaagagggcagtcccagagggggctatgtaaacactacgagagtggccactgcggg

SEQ ID NO: 45658 - DNA, 285 bp, Zea mays
  Clone ID: LIB3066-025-Q1-K1-E3
attaactaatgcatgagctagcatggctgggaatgtcagaaccatgtggagttcaatgcgatcacatgttgcgagggctgccgcacatggtgtgaggtggtgagcgccgcatgatgctgaccatcccactgtccttcatacgctaggatgccagtcacactatgagctggactgtttgtgagctgtaccgacatggtatcatatgcctacgtgtgcatgttatgacacgagatttgccactaggaactacatgacctagagcctgtggggctccaataacgtgtg

SEQ ID NO: 45659 - DNA, 325 bp, Zea mays
  Clone ID: LIB3066-025-Q1-K1-E6
gggctcgccgcgatggaattcgagtcagcggcgcggcggcggcagcgcagactctgttcgccgtcgttgaggacccacctcacgccggcttttgacgccgtggccggtggggagggcggcgtgtctgggtactcttcatcgtcgtcttccagcggtctcgaactcgggttcgacgcctctctcctccgcaaccgccgctccggtttcgccgccccctcggacctggacagccgtgtcctcctctactccccgcagtccgtgccgccgcagatgagggcggcgtacctggcagcggatgatggggtcagggcacctggcgtcaacc

SEQ ID NO: 45660 - DNA, 177 bp, Zea mays
  unsure at all n locations
  Clone ID: LIB3066-025-Q1-K1-E7
cggacgcgtgggcggacgcgtgggggcgaactttgtgtacccgagtggggtggatcgtttcaagaggcaattcgttcatctcgaagaaattgctgctaagggtgagaagactagcccacaattgcgacaacatacttccttaccaagaacaggtcgatttgtacngtttcttcttgc

SEQ ID NO: 45661 - DNA, 330 bp, Zea mays
  Clone ID: LIB3066-025-Q1-K1-E8
atcgaccagtacttctgcccgcagaaggtatgccctggcaagcggagcaactcctcgcatgtctccgtcaaggacgtcacgttccgcaacatcaccggcacgtcgtccacgcccgaggccatcagcctgctctgctcggagacgcagccatgcagcggcgtctccctcatcgatgtcaacgtggagtacgccggcaagaacaacaaaaccatggccgtctgcagcaacgccaagggcaccgccaagggaagcatcgaggcactggcttgcctggtctgatgatgaccttccttttgcatgcatgcatggtatctcatccttgatgatgat

SEQ ID NO: 45662 - DNA, 437 bp, Zea mays
  Clone ID: LIB3066-025-Q1-K1-E9
ataacatcagagaatgtctcgcaaaggatatgcgtactttccataaagaaccaagaagtagtacagtcatcaggcaacagatcttggacattcttacggtcgtcgacatattctgggcttgtgttatctatcaacttcaatcaactaattataatggtgtcacaactgttgtcatcggcatcattgaaacgatacaatatgttagcggggtcctgaaatatacagctgttgtttgcaggtacgtattaatgccgctggcagtattggtcttcctagtctataaatactggaaaacaaggataacagtagatgcagtcgagaagttcttgcgaatgcagcagatgctcgttccaatgagatatgcatacacaaacatcattgctatcaccggccatttcagagacaagctcggacaaggtggttacggttctgtatac

SEQ ID NO: 45663 - DNA, 441 bp, Zea mays
  Clone ID: LIB3066-025-Q1-K1-F10
cccacgcgtccggagctacaatggaggatttctatgatgtaaaactaactgaaattgatggacaagctattagcctgttcggtgtttttgacggtcatggtggatcacgtgctgctgagtatttgagggagcacttgtttgagaaccttctcaagcaccctgatttcttgacggatacaaagcttgctataagcgaaacatatcagaaaaccgatacagatttcttggaatcggaagcaagtgctttcagggatgatggttcaacagcttcaactgcaattttggtgggtgaccgtctgtatgttgcaaatgttggtgattctcgtgctgttatttcaaaagctggcaaagctatggcactttcagaagatcacaaacctaacaggattgatgagcgaaagagaatagaaaatgctggtggtattgtcatttgggctggta

SEQ ID NO: 45664 - DNA, 433 bp, Zea mays
  Clone ID: LIB3066-025-Q1-K1-F11
cccacgcgtccggagctacaatggatgttttctatgatgtaaaactaactgaaattgggggacgggctattagcctgttcggtgtttttgacggtcatggtggatcacgtgctgctgagtatttgagggagcacttgtttgagaaccttctcaagcaccctgatttcttgacatgatacaaatcttgctataaccgaaacatatcataaaaccgatacagatttcttggaatcggaagcaagtgctttcagggatgattgttcaacagcttcaactgcaattttggtgggtgaccgtctgtatgttgcaaatgttggtgattctcgtgctgttatttcaaaagctggcatagctatggcactttcagaagatcacaaacctaacaggattgatgagcgaaagagaattgtaaatgctgatggtattgtcattt

SEQ ID NO: 45665 - DNA, 446 bp, Zea mays
  Clone ID: LIB3066-025-Q1-K1-F12
cgctccctaccacttcgacttgagcggcaaggccttcggctccctggcaaagcccgggctcaacgacaagcttcgccactgcggcatcatggacgtcgagttcagaagggtgcggtgcaagtaccccgctgggcagaagatcgtgttccacatcgagaagggctgcaaccccaactacctggccgtgctggtgaagtttgtggcggacgatggcgacatcgtgctgatggaaatccaggacaagttgtcggctgagtggaagcccatgaagctctcttggggcgccatctggaggatggacactgccaaggcgctcaagggccccttctctatccgcctcaccagcgagtccggcaagaaggtcatcgctaaagacatcatcccggcgaactggagacccgatgccgtctacacttccaacgtccaattctactagactttgaatt

SEQ ID NO: 45666 - DNA, 322 bp, Zea mays
  Clone ID: LIB3066-025-Q1-K1-F2
ctcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgag

SEQ ID NO: 45667 - DNA, 326 bp, Zea mays
  Clone ID: LIB3066-025-Q1-K1-F4
cccacgcgtccgcccacgcgtccggcctcctgagggcgctggtgctgcgtgcggcgtcgtctgcgggcaggcgccgggggcccaggattctgtgtggccgcgcgacggatgtgcgcgtgacgccacggcacggacacggctggcgcgggttccgggcggtcacgggaaggatgatgctggactcctctgagtctgcctcttccgccgccgccgccgccgcggaggcgggagctggggcggtggcaggccaggcgcagccgcagcgccgcgcggtgggggccgtgccccaggcgcacgatggtggctacgccagcggcggatgggaa

SEQ ID NO: 45668 - DNA, 329 bp, Zea mays
  Clone ID: LIB3066-025-Q1-K1-F6
cccacgcgtccggtcgtgtgtgtgcaagtggtttgacgaggttgccaagcaggtgctgtggaaggagttctgtcatgcaagggctccaaagatgatgctggatttgcattcaggtggcagccacattgttgatgggaactggaaggcattggggaagctgctcatctattgcaatggctgcacaaaaggggggctgtttaataacattcacgttccaggccattttgtgttcaggacacgcttttctaggactgcgggcaggagtttcctgcctctgccgtgtaagtctgatgtcctgtatgtgtcagatccatgcgagcatcttgatc

SEQ ID NO: 45669 - DNA, 317 bp, Zea mays
  Clone ID: LIB3066-025-Q1-K1-G1
atcgcactctcctccagcctccaggcttggcaagcgtgcttcacatgaccacatccatgtcgaacagcgccgctagcgagaagcaatcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacggcttcgtggacctc

SEQ ID NO: 45670 - DNA, 447 bp, Zea mays
  Clone ID: LIB3066-025-Q1-K1-G10
cccacgcgtccgcccacgcgtccgtgattgagcaattgtataagtagttcatgttatcgaaatgaaaacaataaaggatcatcatcacggttcttgcaagttgggttgcagggatacgggcaatcaatctgccgagggacctccctatcgtagtaccagtcccccaccgtcttgccagaaccgtgatgatgattgagcaattgtataagtagttcatgttatcgaaatgaaaacaataaaggatcacaacgcgcgcccgtagttgtagatgatgaattataaacacatatgactgagctcaaagttgtttaatcatcatctgttgcgaaatgaggaagacaattggtgtcttgaagctgtgttttcgactgtgtctaaagcgtaaatgtaacgtatattgtgtcttcgcctatgcttaagacattggactagttgattggtcaattt

SEQ ID NO: 45671 - DNA, 440 bp, Zea mays
  Clone ID: LIB3066-025-Q1-K1-G11
cccacgcgtccgccagaaagcaaacgcaaacaagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgccgccgacgctcccgctcctgctcctggccccgactcctcctcgaccccgtcgccggcaccctccagcagcagctcttccgactagccgcccggcagagatatctacggcgtccgatcagtctttggcgccacctataacctatcggatcctgcaaagctatatatgattctatggtataatgtgtggttgcggcaaacgcgcggaaataatgtgcttgcgtgattgtttttctctctctttttttggttaataatgtaaaac

SEQ ID NO: 45672 - DNA, 442 bp, Zea mays
  Clone ID: LIB3066-025-Q1-K1-G12
ccaaactttcactcgaaggaaactctagcgaacaaggagttagctcctttcttaccagattcatctcgcatggctgctctcgattttatcgtatgtgataggagcgatgtctttgtgacaaacaacaatggcaacatggccagaatgttggctggtcgaaggagatattttgggcacaggaggaccataagacccaacactaagaaactttactcattatttctgaatcggaccagcatgagttgggacacatttgcatctaaagtccagacctttcaaaagggattcatgggggagcccaatgagattaaactaggaagaggcgaattccatgagcatcctgtagattgcatttgtgcaaaatcgaagggaaaaagcgtacagagcaggcctcacctagttaaaggcgcctgagaagctgtggagaaccattctattgatg

SEQ ID NO: 45673 - DNA, 324 bp, Zea mays
  Clone ID: LIB3066-025-Q1-K1-G2
caccctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttc

SEQ ID NO: 45674 - DNA, 319 bp, Zea mays
  Clone ID: LIB3066-025-Q1-K1-G3
cggacgcgtgggctagttctagatcgcgagcggcaagatcaaagagggtgtcgtcatggcgataatgcatccaggcattgctgcaggctccgcaacccttgcagggattatccttttcaaaaggccaaggagctaccttattcaacgagtacgacacatgtttggtagcaaggaagtaaccaccctatgcccgtttgattagcacataattcctgtaacttgatagattcacgctcttcaaagttaaccatctttcttgattcatactcttccaaataaattctccattttgcttatactaggtggctatctattcacc

SEQ ID NO: 45675 - DNA, 324 bp, Zea mays
  Clone ID: LIB3066-025-Q1-K1-E2
caatggcgcgcaacctgtctgtcacattgttcattctgacggcctatgtcgccgcgacggcggcaccgaccgtctgtgcggtcaaatctccggcgagcacaacgaccacaaggaaacacgaagcagccaaagaagagacggatgcgcctgccaaggcaccagctgctgcagccaccgaggggcctgctgcgggagcgcccatgacatggccggatggcgggcctgagttcgtcaagatggtcatcaagaaccccttctttaaaagcgcacctccatctggtagcgaagacggcctacccattgaccccactccagaaggcagca

SEQ ID NO: 45676 - DNA, 321 bp, Zea mays
  Clone ID: LIB3066-025-Q1-K1-C4
cccacgcgtccggttcacagtccccactccacctccttctacaaatacacctcagtggcagtcccccaccatatccgcttccctaccccccgcatcacctaccaacgagacgccggcgccatgggggccttcgcgaaggaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttc

SEQ ID NO: 45677 - DNA, 318 bp, Zea mays
  Clone ID: LIB3066-025-Q1-K1-C5
cggacgcgtgggcggacgcgtgggttttttttggaaaataaaaaataattatatttcgataaatatattatttaatcaaagtttatagaaaccgtagcagtgtatggataactaactaccattttatgtctgaccaagtttgtttaaatgaatcagacacgaccaaatgggagagtgagaagggacatctacatctgtttaacacaaaagttggcactcatcagcctatgcgaattacaggtgcttcgaagacagtgctattagtggcgcagcttgcatttgtatccatcgtttcatcccccagctcaacattttcag

SEQ ID NO: 45678 - DNA, 325 bp, Zea mays
  Clone ID: LIB3066-025-Q1-K1-C6
gttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgc

SEQ ID NO: 45679 - DNA, 327 bp, Zea mays
  Clone ID: LIB3066-025-Q1-K1-C8
atcacgacaagatggcgtgcacaaacaatgcgatgagagccttgttcctcctggtcgtcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcatgcggcggcactgggaagcagacaatcctcatacccaagggtgacttccttgtcggacaactcaacttcacaggcccttgcaagggcgacgtgaccatccaggtggatggcaatc

SEQ ID NO: 45680 - DNA, 444 bp, Zea mays
  unsure at all n locations
  Clone ID: LIB3066-025-Q1-K1-C9
cccacgcgtccggacgagttcgacaagcagggcttcaacgtcgaggagatggtcgcgatgctgggcggcggccacagcatcggcgtctgcaggtgcttcttcatcgagaccgacgcggcgcccatcgaccccaagtacaagaagacgatcagcgacgcgtgcgacggcaaggactcgggctccgtccccatggactccacctcgcccaacgacctggacgggagctacttcggcctggtgctggagaagaagatgccgctcaccatcgaccgcctgatggggatggacaagaagacggagcccatagtgaaggccatgtccgacaagaccaccgacttcgtcccgctcttcgccaaggccatggagaagctcagcgtgctcaaggtgctcacggngaaggaaagcgagatcaggaagacgtgctccgagttcaacaacccgcag

SEQ ID NO: 45681 - DNA, 316 bp, Zea mays
  Clone ID: LIB3066-025-Q1-K1-D1
cggacgcgtgggcctcgacctcaagaaaggcggcaacgggcgctacctcaagacggcggcctacgggcactttgggagggacgaccccgacttcacctgggaggtggtgaagcccctcaaggcggagaagccgtcttctgcatgaggcgcctcctctgtttcggaagaagcttttggtctggtctgcctgcgctctatcatgcttttttatggctcctacgtgttgtgattcttgatctgccccttgcttatcatttgtattgtactgtcactgtcctaataagtggtacgtgtgcggggtcgtattgtgtctgct

SEQ ID NO: 45682 - DNA, 390 bp, Zea mays
  Clone ID: LIB3066-025-Q1-K1-D10
ccctgcccatcagcacaaccaccaccaccgccgcctggccgtaacgtcacacgctcgcgtccttccatggcgcccaggaacgctgtccccgccgccagcgccgtggccaacggcatggtgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggccaagaccaacttccccgtcgcgttcgccgcgcttccgccgccgccgcccaagaagccggccgccgtgaccgtgagccccagcagcagcagcaccgtggagtcc

SEQ ID NO: 45683 - DNA, 352 bp, Zea mays
  unsure at all n locations
  Clone ID: LIB3066-025-Q1-K1-D11
gccagaaattgtcaagaagacatactgtttgaagatcaggcaagagctgatgcatcggcttccagctgtgacgagtcgagtggtgtagcaagccttaaaattcagatttctctgttgaatataagactgagggcacttgaagaggatcaggagttcctcaatcaggtattgagttcgctccaatgtggtagtgatgggctgcagtgtatacaggagataagcaggcacttagcagagttgcgaagagttgtggctcactaaaatgaaaatggttttgccccgagttcacactttttggccgtcatgaggntctnctttgtnacggcaaacctatttgcagcctgctatctag

SEQ ID NO: 45684 - DNA, 323 bp, Zea mays
  Clone ID: LIB3066-025-Q1-K1-D2
cccacgcgtccggggttgcaaagcgtgccccatggctcagttggagctgttgcaggtcgtcgtgctatagctcagggaaaccctgatgaagttgctgcagcattgtgtagatattcagcaccagaagaggttgatactttaccatcaacatgtggagcctgtggaacagaatgcgtcacacgtttctttgctacaaaaatcccatatttccgggaggtgattgttatggcaacaacatgtgacatgtgtggttatcgcaattcagagctgaagcctggcggtgaaattccagctaagggaaagaaaattacactgcgtgttca

SEQ ID NO: 45685 - DNA, 316 bp, Zea mays
  Clone ID: LIB3066-025-Q1-K1-D3
tgtaaatgggggagcaagtgccactttgctcatggagagagggagcttggaaagccgctgcagatggacaacccgatgggacctcctccaatggggccagggcccaacgggcacttcatgccaccgccaatgcctttcccagacatggttcctccctccacattcggtgcttccgccacagccaagatcagcgtcgatgcatcccttgctggtgccatcattgggaagggtggtaccaacacaaagcatatatcccgagtgactggggccaagttagccatccgggacaacgaggctgatcccaaccataaaaaca

SEQ ID NO: 45686 - DNA, 324 bp, Zea mays
  Clone ID: LIB3066-025-Q1-K1-D4
cccacgcgtccgcccacgcgtccgcccacgcgtccgccagataccaaggcacggaggtccatgaccatagcagcaatgacatggctgtggtgatggggctccggcgagcaattcccattacccagccacatctcccgttgaattgagagttgttgaactacaacatgcgctcaaaaacctcttagccccttcccctgagcccgaacaacgccgagggcgtgatacattggcggcgacaacctctctttctctcactacctctgacctatctgcatgcatcaagcgggatgctcatgggtttcatcaggtgaccatggtttgagg

SEQ ID NO: 45687 - DNA, 327 bp, Zea mays
  Clone ID: LIB3066-025-Q1-K1-D6
gtgttggggggttccatggggagccaccgctgtcgccgttcctcgcctctgtcgacggccggaatccatggaattgatgcggagcttcgactggacacggggaagctatcccgaccgccaatttgatgaacggccagtcggaactcgggcaatggctcaccggaggagtggcgtccgtcgcgggccgcgttccatcgtgggcgttcgtctccgtgcccgaatccgtggtcaagaacatgtaccacatgatgagacgcatggaagatgttgcgatgtgttcgtgagaggtctaggccgtcgtctcccagtcaacttcgggttgctgga

SEQ ID NO: 45688 - DNA, 317 bp, Zea mays
  Clone ID: LIB3066-025-Q1-K1-D7
atcctcgtcttctccaattccaaagtaagaaagccacacgcgaggccgaccgaggaagtccaatctcatggcgctctcctgcatgaggtgccccgcgggcgccggcgccgcctccgcccgacgcgccgcagcgcagccgttggccgcggaggctgcggtctccttcgccagatgccgcggcttcgggaggtccgccaccgctgcgacttccgcctggttttggcgcaaccatgccgttgcctcacagggagtgaaagctcccatggatgctgatgtcaagaatgctgtcatacctcctacctcaccaaaggtggaaa

SEQ ID NO: 45689 - DNA, 326 bp, Zea mays
  Clone ID: LIB3066-025-Q1-K1-D8
ggcaaaaatggcaaaggctctcctaggtggcctatcggcgatcctcgtcgtggcggtggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggcca

SEQ ID NO: 45690 - DNA, 330 bp, Zea mays
  Clone ID: LIB3066-025-Q1-K1-D9
aatagaagcataatgatcattactcttaatggtcaagacacactactgactcttcaaggttccgggctcgaaacgagggagcaagtcgcaattgacgatcaaatcttagatgttacacgtgactttgacctttcacatgttaaaaattaagaagtcgacacgctacactctgaaatgttatatattatggacctaggacctaaaatcttcaatatgtgatatatcatgcaatatgcggtctacatagatcattgatcctttaatgcatcacacatgacaatatgatctaagatcttataccagattctactgattactcatacttgatag

SEQ ID NO: 45691 - DNA, 316 bp, Zea mays
  Clone ID: LIB3066-025-Q1-K1-E1
gttctgtcttcagtggtgcaaacaaaattggtgatggtggttttggttctgtcttcagtgacgcaaataacgactttgtgctactatgctgaggaacaagctttgtgacttattttggatttgagcagcacggtcataacattgctgatgccaagaaagatgatcctctatgttcactacatcttgcactatgtcctgcgtgttaccggccaaacaaaacaccttggagtgcagcgacgacaggaactacctctacaggaaccggtttaacgagtaatttgacgacgcgtgggtggagcagacctggtgggaagta

SEQ ID NO: 45692 - DNA, 343 bp, Zea mays
  unsure at all n locations
  Clone ID: LIB3066-025-Q1-K1-E12
cccacgcgtccgcggacgcgtgggcgaacgatcagtctgagatgcatgcacgacgatcgatctacagctagcgttgcattgcatgacgatatggacctacactcgcgggcaaagcccatggacaccgncgtcgccgtcgcggtggcttgtcggcgccgccgccttcttcggccgggtgggcaaccccgccttaacaacaagcccaatggggtccaagccaaggccaacattctttttgaagaagtcgggtttaccaaccggcggaaaggcccgggcttcattagccgggccacgtggcaacttccggccgggtcaacgcttttccagcgtggattccagccta

SEQ ID NO: 45693 - DNA, 317 bp, Zea mays
  Clone ID: LIB3066-025-Q1-K1-C3
ccgcctccgtgtccgtgccctacagctggtcatgagcgcccgcccaaccatggcggcggcggcgcccgtgcgcgcctgggtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgccgtcgcgcccg

SEQ ID NO: 45694 - DNA, 384 bp, Zea mays
  unsure at all n locations
  Clone ID: LIB3066-019-Q1-K1-A5
cccacgcgtccgcctcttcatagagcgcgtcggggtcgggggaggacctgtcgatttggcatgagctgccgattcaatcatcctccggataggaatctggctattgcctctgccagaatgaagggagaatatcctgagagagcgggacagccagagtgtcagtattatctgaagactggaacatgcaagtttggccctacatgcaaatttcaccatcccagggaaaaggctggaattgcagggagggtgcagctaaacacatcaggatatccactccgcccgaatgaaaaggagtgtgcatattatntaaaaacaggacactgtaaatatgcanatactngtanattcaccatccggacttttcaatgtggtgctttcgtcacg

SEQ ID NO: 45695 - DNA, 243 bp, Zea mays
  Clone ID: LIB3066-019-Q1-K1-A6
attccctgtcgaccgcacgcgtacccccacgcttccgcctcttcatagagcgcgtctttttctacagatgacctctctatgtgccagtatctttcaatgcaatcatcctccatataagaatcttgctattgtctcttccataatcaaaccagaatatccttaaaaatctttacaaccaaaatttcactcatatttcaagactctaacattccatttttaccctacattcaaatttcaccattc

SEQ ID NO: 45696 - DNA, 156 bp, Zea mays
  Clone ID: LIB3066-019-Q1-K1-A7
aacctaactcttaactctgccacaactatactttaaaattctaatacatcttcacttacataaacacctttttatatactaaccaaaacattcattcatctacctacattcaaattccaccatattcccctacaatctctaatcacatactcacaa

SEQ ID NO: 45697 - DNA, 283 bp, Zea mays
  Clone ID: LIB3066-019-Q1-K1-A8
ctctctcctgtcctacctgttcgctctcggctcccctccatctctttcgccacgcgcgcgggaggatggagaggaaacagctagcagcgagcgaggaacgaagagggtgcttcgcacgtgcatgtgagatctgtcgatcccgatcgtcggacggcgcgaattgaactatacgacgacttacgtgctaccaccgcggtcgttggatcattccaggctgagcaatgggcaagatcaagtaccacgtggtggcacgctgatcactggtagtagcggagcactacgg

SEQ ID NO: 45698 - DNA, 454 bp, Zea mays
  Clone ID: LIB3066-019-Q1-K1-A9
ccagcgcggaggatgactcgcttccaaaagaagctcagatttccatcatccccgatcaggatgagctacatgatttcccagcctatgctacttgatttgcctccaataattatgtttgatgtagaaaaaaacaccattttggaagcgcaggggcaactgagcaacactatgtattaactatctcgtagatactacagcagaggctccttgtaaagcaggttgagacgatcattctgcagttcttattatataggatgattacgaaggtaacatgtttgggacagtaacatttgcttgaaatgtatatagtctacaacaagaataatgccagcattcttgaaatgtatcgcctaggagaatgctagcacttacgggtgtgacgaacgatctgctgtcggttgagatgaaaaggcgttcgccttctattaaggatgtaaatggtacaaaaagatgt

SEQ ID NO: 45699 - DNA, 286 bp, Zea mays
  Clone ID: LIB3066-019-Q1-K1-B1
tacataattcttcatcatctacactgtttgagatatacttcctcctcataacatcaagcatgttgatacatttaagccaacatactcccatcacatttaatatattcaacatccttatcaacttaatccttatcgatattattcaattcctaaatagatacctgatcccaaagacataaatcctcaatcatcatatcactattattatcctacatctaatcctacaatgatacctaatccataatacaacctaccatttaatcttaacaaaattcacaatcctaac

SEQ ID NO: 45700 - DNA, 113 bp, Zea mays
  Clone ID: LIB3066-019-Q1-K1-B10
cgaacttggacatgtttgtctcacaacgttagatcactctttgtgttctgttgattgatatcttaaatttgcgcaacgtgttgagtccttttgagattttttagatctgtgct

SEQ ID NO: 45701 - DNA, 448 bp, Zea mays
  Clone ID: LIB3066-019-Q1-K1-B11
cacattcaagcacctcctcttcccccgccgggcaacaactcagccgccgcaaccgccacatgagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaagaggagaagccagcggcagcagcccatgcagaggaaaaggtcgccaccgtcgccgagaccacgacgacggtggaggcgaagaagaacgccgaggaggcccggaaggagaagc

SEQ ID NO: 45702 - DNA, 276 bp, Zea mays
  Clone ID: LIB3066-019-Q1-K1-B12
ccttctaggggcctccctttttttttttttttttttttttttttattttttttattttttcatcgttttgtttcaatttatagtccttacatcttaccctttattttcattaaccatctgaccttacctatccacatacaatatctcaccttaacaattttaaaatcaaaaaaacatctattttataatcacatatataatcaattcattttccatcatccaaatcttacttaactcgcaaaaccttacattcctaatcattaactccctccaaaa

SEQ ID NO: 45703 - DNA, 442 bp, Zea mays
  unsure at all n locations
  Clone ID: LIB3066-019-Q1-K1-B2
gatactgccgagctcaccgccgtgctccaccacttggcgttctgccgccaggctaccacgacaaccgccgtgatggcaccgcaacagcaaggcggtggcatggctgacctcgacgtcacgtcctccaaccagccgcttctccccaacgagcagcaagaagtcgttgacgcactctacgtgaatcacgaagctcacaccgccatccttcaaaccgacgaggtcgtccaccgccacggtggaggccacagccccaccgatgatcatcacggtgagcagcaacagcagcagctcttcgactacttctattacgatgccaccgncagcgacgatgcaagtagcaagcctaccatagacatcaacctcgacaacatgcaacaattcgatnttgacgatagttgtgcccgcggcgagaaagtggatctggctccggcagctgggggat

SEQ ID NO: 45704 - DNA, 475 bp, Zea mays
  unsure at all n locations
  Clone ID: LIB3066-019-Q1-K1-B3
cccacgcgtccgcccacgcgtccgcccacgcgtccgcaaaacatcacctccatctcgctcaggtcgaggttctcaaagagcagctgctgtagctgctctatcctctgtgctgactgctgagcaatctggatcttcagaatttctacgatccaaagctagcaacacagcatataagactgatgtcgaccggattgtcataactccagctggcccatcaggcccatcttctcctcagtctgaagctggggagtccaatgtgtttcaccaggaaaaagatactgcagcagatggggcaccgcctgacactgatggagcagtggctgaggccggataggaagaaacaacggaaaatgttggtgaagcgacatttagctatgaccgcttgatatccaaatccaccgatccagttcgtgggatagattacanacgcagagaggcatacttatcagatagtgaattcaaactgttttggcat

SEQ ID NO: 45705 - DNA, 450 bp, Zea mays
  unsure at all n locations
  Clone ID: LIB3066-019-Q1-K1-B4
gtgatttgaaataattgggaataaatagttcgtgaatccctgaagcgtgcatatatatatgcctgcgaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgncgctgcatctgcactaggcagtgctaaacaagatcgctcgatcgctcgccatgcatcgacaacctattcttaataacgttcattatctcgttcttaattatgacgaatgtcatgtatgttctggtgactgtcatgtatattctgatgactgtcatgtatcttggtcatgtatgctc

SEQ ID NO: 45706 - DNA, 315 bp, Zea mays
  Clone ID: LIB3066-019-Q1-K1-B5
tccaggcacgcgttcgcccacgcgtccgctcaacatcacctccatctctctcaggtctacgtgtctcaaacagcagctgctgtagctgctctatcctctgtgctgactgctgagcaatctggatcttcagaatttctacgatccaaagctagcaacacagcatataagactgatgtcgaccgcattgtcataactccagctggcccatcaggcccatcttctcctcagtctgaagctggggagtccaatgtgtttcaccaggaaaaagatactgcagcagatggggcacctcctgacactcattgagcactggct

SEQ ID NO: 45707 - DNA, 441 bp, Zea mays
  Clone ID: LIB3066-019-Q1-K1-B6
cccacgcgtccgcccacgcgtccgaccacaccgttcctccgagcccaggagcaggcccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaat

SEQ ID NO: 45708 - DNA, 424 bp, Zea mays
  Clone ID: LIB3066-019-Q1-K1-B7
tccacctccgcccgcgtcgagcgagggacacaccgcctccggccgcgcggcacgatctccggtccccaacatgagcacgacagaggatgagaggtccggcgccgccgcagaagcgggaggaggggaggaggagagacgggagaggagcgtcggcctgatggccggcctcgtggacagggccaagggcttcgtggtggagaaggtggcgcagattcccaagcccgaggcggcgctggatcgagtctccttccagagcataagccgcgagggcgtcgagctgcacagccacgtcgacgttagcaacccctactcgcaccgcatccccatctgcgagatcacctacaccttcaagagcgccggcaaggtgatagcgtcgggcatgatgcccgaccccgggtggattgcggcgagcggcagcacccag

SEQ ID NO: 45709 - DNA, 446 bp, Zea mays
  Clone ID: LIB3066-019-Q1-K1-B8
cccacgcgtccgcccacgcgtccggcacgcgctcaaggacaacccagagtgccaggcggaggcggctgtcaccccgcgccggctggccgagctgctcgtgtacgtgtcggccgaggtgggcatgaccgtggccgcgttcgcgcaccacgagctcaacgccatcaaggacgacgacgtcctgtacaagtgcatcgacacctgctccgaggacatcgaggaggccgtggcgcacctcagcgccctctcccgcgacttctccgacgccaggttcctcgaggtcaagtcctggctcacctccacgctcggcggcaccgccacctgcgaggacgcctgcaaggacgcccccgtcagcgacatcaagaacgtctgcataaccaagagcttcgagttcgagaagctgctgcgcgtcacgctggacctcatcaccgaggctttcggctccatgt

SEQ ID NO: 45710 - DNA, 456 bp, Zea mays
  Clone ID: LIB3066-019-Q1-K1-B9
cggacgcgtgggcggacgcgtggggactcatatgtcctttctgagtcaagcttgtttatctgtcctgtgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgaaatgtgcatgactggtctggacaagaagaaagcttctgtctttttcaagactaatgctgatgggaacacaacatgtgcc

SEQ ID NO: 45711 - DNA, 403 bp, Zea mays
  Clone ID: LIB3066-019-Q1-K1-A4
atgtgattggggctcgccgtgcttcatggcgcattgcttcttccattgaacataaggaggagtcccgtaagaacgaagagcatgtgaaccttatcaaggaatatcgtggcaagatcgaggctgaactgagcaatatctgtgatggcatcttgaagctgcttgactaccacctagtgccttcttctactgctgctgaatcaaaggtcttctacctcaagatgaatggtgactatcacaggtatcttgcggaatttaagactggtgctgacaggaaggaatctgctgagagcacaatggtggcctataatgctgctcacgacattgctctggctgaactggcacctacccatccgataaagctgggacttgctcttaatttttcagtgctctattatgagaatct

SEQ ID NO: 45712 - DNA, 335 bp, Zea mays
  Clone ID: LIB3066-018-Q1-K1-G4
cggacgcgtgggcaaagggccatccgctgcggtcagtgtaggtttctgaatcatagcttggcgatgcctgaggctagacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaataagcaaggtttagagaagaggcaacatgggcacaaagatgaagaaggggatcctg

SEQ ID NO: 45713 - DNA, 293 bp, Zea mays
  Clone ID: LIB3066-018-Q1-K1-G5
agcaaatcgaacgaacccagccgaagcgcgagctgagcaaggcggaggcggcgatggagcggctgcagcggatctttggcgcctccggcatggggcagccgccgacggactcgccgcttctcgactcctccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcaaagcgggactggggtc

SEQ ID NO: 45714 - DNA, 391 bp, Zea mays
  Clone ID: LIB3066-018-Q1-K1-G6
cttgaatgatatagcactagcaagtttgttgaatgttaatttgaaggaccagtcacatatcaacaggcaggaacctaccaatgatacatcactaggaggagcaagtttcttgaatgctaatttgaaggaccagtcacatctcaactggcaggaacatatgaatgagacatcaccagtagcaggtttattgaatgctaatttggaggagcagtcacatctcaactggcaggaacctaagaatgagtcatcaccagaagcaggtttcttgaatgctaatttggaggagcagtcacatctcaactggcccttgcaggaatgtgagccatggattgagagacatatgttttgaccaataagttgatccttggtacaagcctgactttccatgttc

SEQ ID NO: 45715 - DNA, 356 bp, Zea mays
  Clone ID: LIB3066-018-Q1-K1-G7
gagacaatggttacggaaattctatgaatatcaagagaaccataaaaggatatatcaatgctggttttgctggaattatgcttgaggatcaggtggcacctaaagcatgtggacatactgaaggaaggaaagtcatatcaagggaggaagctgtcatgcacataaaagctgctgtagatgctaggaaagagagtggctctgacattgttattgtagcaaggacagattctcgccaagctatttctcatgatgaagcattatggagggtgaaagcatttgctgatgctggaacagatgttctatttattgatgcccttgcttcagtagaagagatgaaagcattttgtgcgggtgca

SEQ ID NO: 45716 - DNA, 480 bp, Zea mays
  Clone ID: LIB3066-018-Q1-K1-G9
gcgcacggctcacgttgtccgcctcacgtaaaggtcggtgccttcgtctcctatctcgcctcgcgcagttccacttcccatttcctccttcgtccgcatcagggacacactgcctccgcatgcggcaagatcctccctcattccccaaacatgagaggagcagaggaggagagatctggcgccgccactgatgcgggaggagaggaggagaaacgggagaggagcgtcggcctgatggccggcctcatggacaaggccaagggcttcgtggtggagaaggtgacgcaaatccccaagcccgaggctgcgctggatcacgtctccttccagagcatcagccgcgagggcgtcgagctgcatagccacgtcgacatcagcaacccctactcgcaccgcatccccatctgcgagatcacctacacgttcaagagcgccggcaaggtgatagcgtccggcacgatgcccgacccccggtggatc

SEQ ID NO: 45717 - DNA, 327 bp, Zea mays
  Clone ID: LIB3066-018-Q1-K1-H1
ttacggagacaatggttacggaaattctaggtatattatgagaaccatataaggatatatcggggcgggttttgctgtaattatgcttgatgatcatgaggcacctaaagcatgtggacatactgaaggaaggaaagtcatatcaagggaggaagctgtcatgcacataaaagctgctgtagatgctatgaaagagagtggctctgacattgttattgtaacaaggacagattctcgccaagctatatctcatgatgaagcattatggagggtcgaaagcatttgctgatgctggagcatatgttctatttattgatgcccttgctt

SEQ ID NO: 45718 - DNA, 317 bp, Zea mays
  Clone ID: LIB3066-018-Q1-K1-H10
tctgactcgtttgaaaaaaaaaaagatttaaaaaaaaaaacaacaaaaaaaaaaaaatactaacatacaaacacatacatacaacaacaatatctattctataatctcacctactttcaattctcttctcctctttttacaacatcttaactaataaaaccctactgtcacccaacttaataatctttcaccacataaaccttttttcacctaacctaatatccaatacaccccctcctattttccttcctaacattttctcatcctaattaattacttatactccccctcttccttctcattattcacttctcttt

SEQ ID NO: 45719 - DNA, 442 bp, Zea mays
  Clone ID: LIB3066-018-Q1-K1-H11
cccacgcgtccgcccacgcgtccgcaaaccgacgatggcgtcgaataagacggtcctgatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtgtccactcgatcgagagatcgatcgatgcctggtattatatttgtattccacattatatatagg

SEQ ID NO: 45720 - DNA, 496 bp, Zea mays
  unsure at all n locations
  Clone ID: LIB3066-018-Q1-K1-H12
cccacgcgtccgtataaagcgcggggtctcagtctcaccggcacctcttcaatcccaggcccacacaaagtttctgctcgatcctcatctcctccctctctcgagtcaagagcagagcagctaccaaacaagctctcctttcgcttccgatccatggagctcgacgccgacaacctgagcgccaccgagctccgcctcggcctgcctgggaccagcagcagcagcagcgacgactggcagaagaagccgtcgccctccgtcggggccaagcgcgctctggacgacggcaccaagagcgaggcctcggggaccagcccggccgncagagacctcgacttcgaccacgaccacgacaccgnncgcgcctccaaagcgcaagtggtcgggtggccgncggtgagggcgtacaggaagaacacctttcaggcggcggcggcggccaagaaggtcgagcagaagcagaagcagcagcagcagggaggcctgtacgtgaagg

SEQ ID NO: 45721 - DNA, 316 bp, Zea mays
  Clone ID: LIB3066-018-Q1-K1-H2
cgtcctgcgccaggtacctggacgagcacggcaacgtcgccgccctcgacggcgccaccgcggaccacctgagggccaccatcgacagcttcgccaacgaggcgctccggacgctgtgcctcgcctacgtcgacgtcggcgacgggttctccccgagcgaccagatcccgacggacgggtacacgtgcatcggcgtcgtggggatcaaggatcccgtccgtcccggcgtcaaggagtcggtggcgatctgcaggtccgctggcatcaccgtcaggatggtcacgggccgacacatcaacacggccaaggcgatcgc

SEQ ID NO: 45722 - DNA, 337 bp, Zea mays
  Clone ID: LIB3066-018-Q1-K1-H3
cccacgcgtccgatcacgacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaatgctgtgcaggaggcatgggcatcggcgtgcggcggcactgggaagcagacaatcctcatacccaagggcgacttccttgtcggacaactcaacttcacaggctccttgcaagggcgacgtgactcatccaggggatggca

SEQ ID NO: 45723 - DNA, 209 bp, Zea mays
  Clone ID: LIB3066-018-Q1-K1-H7
aattgaactatccagctacaactaaaaagaaacggatggagtatttgttaggcgtaccaggcgcagactgcttcctatttgttcgtggggctgtaactgtaagccttgtttgtgacccctaagcagtctgcgtcttgtgcctgctgctgtagcggtagagcagagagagatcaaatgtaaattacatttttttagctcaaattcacgac

SEQ ID NO: 45724 - DNA, 342 bp, Zea mays
  unsure at all n locations
  Clone ID: LIB3066-018-Q1-K1-H8
cccacgcgtccggtcgtcgtcgcccacggcgcccgacgtggagctgccgcacgccaacttcaccgtggaccgcctcatccagatgttcggcgccaaggggttcacggtgcaggagctggtggcgctgtccggcgcccacacgctgggcttctcccactgcaaggagttcgccgaccgcctctacaacttccgcaaccagggcgggaagccggagcagttcgaccccagcatgaacccgtcctacgccagggggctgcaggacgtgtgcagggactacctcagggaccccaccatcgncgcgttcaacgacatcatgacgcccgggcaagtcgacacatgtac

SEQ ID NO: 45725 - DNA, 380 bp, Zea mays
  Clone ID: LIB3066-019-Q1-K1-A1
gggagagagaattcgggagcatgtacactgactgggatatccttcctcctcgtaagatcagagatgttaatgcaaaaaagccaaaagactgggatgacagggaatatattgaagatcctgatcaagttaagccagagggatatgattcaattcctaaagagatacctgatcccaaggacaaaaagcctgagtcatgggatgacgatgatgatggtacatggaagcctagaatgatacctaatccagaatacaagggaccatggaagcggaagaaaattaagaatcctaactacaaaggaaaatggaagaccccatggattgtcaatccagagtttgaggatgacccagacctatatgttctgaaacctttgcagtatgtg

SEQ ID NO: 45726 - DNA, 72 bp, Zea mays
  Clone ID: LIB3066-019-Q1-K1-A10
ctcctaccgtgggcttcgatgagtcgattatatatatgagtatcatgtttataatagttcgagttattgcat

SEQ ID NO: 45727 - DNA, 195 bp, Zea mays
  Clone ID: LIB3066-018-Q1-K1-G3
ggcggtgcaaccggcaaggcttcctcaggcggcggcggactggaccccgacggcgacccagaggttgggctgaacgggaaggcgatcgaagagatcgtgaacgagcacaacgtgttccgcgccaaagagcacgtgccttcgcttgtgtggaacgcgacgcttgccaaggtcttgcaacaataccccgagaacctt

SEQ ID NO: 45728 - DNA, 412 bp, Zea mays
  unsure at all n locations
  Clone ID: LIB3066-019-Q1-K1-A2
ggaatccggcggnggtggggtgcgagcagggggagggagaagagcagccgcccgccccgcgagggggcaacagctgcccaagaacctgaccggaagagttgtgggagcggcggcggaaagatggggcaggccctgcgcaggctcttcgactccttcttctccaccagggagatgagggttgtgatgcttggtctggatgcagctggtaaaacaacaatactgtacaggcttcacatgggagaggttctttcaacagtccctacagtcggttttaatgtcgagaaggttcagtataagaatgtggcattcactgtgtgggatgtgggtggacaagaaaaactcaggtcactgtggaagatgtacctgagtaattctgatgcactgatctatgtcngtgattctctggacagag

SEQ ID NO: 45729 - DNA, 420 bp, Zea mays
  unsure at all n locations
  Clone ID: LIB3066-019-Q1-K1-A3
gaaaaagatctatttgagaaatattacaagcaacacttggcaaagcgtcttctttctgggaaggctgcttctgatgattctgagagaagcatgcttgtgaagctgaagacagaatgtggctaccagtttacttcaaagttggagggcatgttcactgatttgaagacctctcaggatactacacaagggttttatgcatctacttcctcggagctgccggcagatgcccctacaatgtctgtccagatactcacaactgggtcatggccaacgcaaacctgcaatacctgcaacctcccccctgaaattgtctctgtctcagagaagtttcggtcttattaccttggcacacataatggcangaggctaacatggcaaacaaacatggggacggctgacatcaaaagtacatttggaaat

SEQ ID NO: 45730 - DNA, 126 bp, Zea mays
  unsure at all n locations
  Clone ID: LIB3066-018-Q1-K1-E5
cccacgcgtccgccgagagcctgcgccggttcggctggatcgtgccggcctacaccatgccggncgacgcggaacacgtggccgtcatgcgcgtggtcatccgcgaggactttagccgcggctcgc

SEQ ID NO: 45731 - DNA, 323 bp, Zea mays
  Clone ID: LIB3066-018-Q1-K1-E6
attggaagaggcagacgtgtccaaagccattctaggttacatcactgcaaacaagatccagagcattgcgctcggcggagccaacagaaatgcgttcaccaagaaattcaagaacgcggacgtgccgtcgaccctgatgaagtgcgctccagactactgcaacatctacgtcgtggccaagggcaagtccgtcaatgtcaggctcgccaagtgcggcgtcccgccgatgcacactggcgccgacatcgcttcggacaccgactccctccgggaatcggtgctctacatgcgacgcggctccagggggcacctgccgcgggtga

SEQ ID NO: 45732 - DNA, 140 bp, Zea mays
  Clone ID: LIB3066-018-Q1-K1-E7
tggaaatttgtcgtatgtttgacagtatctacaaagagcatctggacggagtgcgccctgtcgtagaaaaagtttaccacgtcttcgacaatcaatttcctgtagctattaaacggttgcagtttgatatgcatcttttt

SEQ ID NO: 45733 - DNA, 398 bp, Zea mays
  Clone ID: LIB3066-018-Q1-K1-E8
caacttattgagaggcttgtatttgctgaaggtgcagaaaatggccttgatttcacaatcgggagacctttcaattggattggaccaaggatggacttcattcctggtgttgatggtcctagtgaaggtctgcctcgggttttggcttgcttcagtaacaatctgctccggagagagcccttgaagcttgttgatgggggtcagtctcagagaacctttgtctacatcaaggatgccatcgaagctgtagtgctgatgattgaaaatcctgctcgagccaactgccacatcttcaatgttgggaatccgaacaatgaagttaccgttagggagttggcccaaatgatgacagaggtctaccacaaatgtctcaggagaggcaccggtggatgagccca

SEQ ID NO: 45734 - DNA, 459 bp, Zea mays
  unsure at all n locations
  Clone ID: LIB3066-018-Q1-K1-E9
gacaggtgaaatttgtcttgatatattgaagaatgcatggagccctgcatggaccctgcagtctgtttgtagagcgataattgctctgatggcccatcctgaaccagacagcccacttaactgtgattcaggcaatctcctgcggtcgggtgacatcagaggctatcaatcaatggcccgcatgtatacaaggctggctgccatgccaaagaaaggttagatgtagaacatgtgccaagccaagagcctatgtcagtccatatgttgtcaggtttgctgtgtgctgtctgtctgtgaacttggtggttcttgtttcctaataagtcctaaccattcatgtgtgtgtattctgtattctgtatcccggattcccgatgcttggtctgtgatgtaataaatcctggaattcaacagttgntacttctgatctatttatttaagtgctcagtatttcccgtc

SEQ ID NO: 45735 - DNA, 447 bp, Zea mays
  Clone ID: LIB3066-018-Q1-K1-F1
cggacgcgtgggcggacgcgtgggcggacgcgtgggcggacgcgtgggctacagttcagggaagctgcaatgtccaaagatgatacggaattactaaaggtcatggctaactacggtgaggatgtagttgaagctctgggatatgaaatggatcggcttgagtctgagatcaaaaaacttgtgcctgggattaaacatgtttacaatcaaggacacaatccagaaaggcttacttttaaaacaaaaattttgtagattaactatgtacattgcatttgatttaaacaacttacacatagaacatctggatactactaaacagaaaccacaccactagagagcatgcattaacaacattagaaagcgggtacacaagttgcattaaatccacacgactttacatatacatatacattacacaatcagttaatatacagatgactggat

SEQ ID NO: 45736 - DNA, 479 bp, Zea mays
  Clone ID: LIB3066-018-Q1-K1-F12
cccacgcgtccgccaaaacatagagtgtcgacttttctattggtgtgattgggggcactaaatacctaacacattgcactcagactacatatactgtgtttgtgtgttgtatgccgtatgcgtgtgtgagcttgcgcaaattggacatctaggccgtgcgtatcctgcgatgaaaggcgccgtcatcggcgcatcgaccgtcctggtcgtggcggtggtggccaccatctgcgtcgtttccttcaaaggcagcggcgatggcgggagggccgaggagggcgagatgtccacgtcggtgaagtccatcaagtccttctgccagcccgtggactacagggagacgtgcgagaaggcgctggaggcggcggccgggaacgccaccagccccacggagctggccaaggccatcttcaaggtgacgtccgaccggatcgcgaaggccgtgcgcgagtctcgcctgctcaacgagctcaagcacg

SEQ ID NO: 45737 - DNA, 298 bp, Zea mays
  Clone ID: LIB3066-018-Q1-K1-F2
tgctgatgtaccaccaaatactggagcataattggcctgaccaggatctgtgcccttcttgatgcgtctattgatgaagtctggtaactccgaaacaggttacagtcttgctacatggaatgacgcatccactacaaatggcttatctgggaagactaccatgttctcaaggctaaatgtgctacattaccgatctgcataccatgctgttctataacggggtattgtcactacagtgactacggatagtcagatggctaaagagtaaccgatttgatgcttgaaagctcaatgtctg

SEQ ID NO: 45738 - DNA, 361 bp, Zea mays
  unsure at all n locations
  Clone ID: LIB3066-018-Q1-K1-F3
gccctacgcgnntccgcggaccgccgtgggtctggacgtcgtggggtgggacttactcatnaaaagcactctaaattggggcagaatnnaagcatgcgttcgagagcgccttaatnntgaacnntgcgacaanntatgacntnnggcacntnntttgctttagngaacccatntcangnntacttatntnnttcagaaatcangnaatcttgcangnnttgtgcnntgaatacntnnttgaaaggctatntnntattctccattttatgaaacnnctttnnnaagcaagggtatnngggcagaatgganngcgtgctatacnntctctgctgagaatgacaaagtattcgacatcccgtgg

SEQ ID NO: 45739 - DNA, 357 bp, Zea mays
  Clone ID: LIB3066-018-Q1-K1-F4
cgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatc

SEQ ID NO: 45740 - DNA, 245 bp, Zea mays
  Clone ID: LIB3066-018-Q1-K1-F5
caatccttgcacccctcccctccgtcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgct

SEQ ID NO: 45741 - DNA, 252 bp, Zea mays
  unsure at all n locations
  Clone ID: LIB3066-018-Q1-K1-F7
cccacgcgtccgtttttttttgatcataacaattaattaattaattaaggcgaagacacgaagcgtggaggatcgatgcgtccccgccgccgcagtatgttttaagctgacttgcggtagatgtgttgtggcctgccggcggcggcgtccttctgggtgtctatgacagtctcgaaggcgccgacgagcgccttgaccctgctgcactggcgcttctgcatcagcttggtgcgtgccgnctcgatcacgtcg

SEQ ID NO: 45742 - DNA, 366 bp, Zea mays
  unsure at all n locations
  Clone ID: LIB3066-018-Q1-K1-F8
cccacgcgtccggtcgctgggtctgccggttgccgcgacggtgaactgcgcggacaacacgggcgccaagaacctctacatcatctccgtcaagggcatcaagggccgcctcaaccgcctcccgtccgcctgcgttggcgacatggtcatggccaccgtcaagaaggggaagcccgacctcaggaagaaggtgatgcccgccgtcatcgtccgccagcgcaagccgtggcgccgcaaggacggtgtctacatgtacttcgaagataatgctggagtgattgtgaatcccaagggtgagatgaaaggttccgctatcactggacctatcggcaaggagtgtgctgatctttggcctangattgctag

SEQ ID NO: 45743 - DNA, 339 bp, Zea mays
  Clone ID: LIB3066-018-Q1-K1-F9
tgccagtcccgcgagcaccattcacgcacaccagcgcagccgccatggccgacgtcgagggggccacccccgtggccgcaccggccgagggcgcgggcggcgacgtggccgccgggagaaccggcgcggtggccgccctgctgcggcggtggcggacccaggacctgctggaccggtcggggtccgcgctgcgcgccgcggcgtgggcgttctccctgctggcgttcctcgtcatggcctgcaacgagcatggggactggaggcagttcgaccgctacgaggagtacaggtacatcgttgccatcggcctgctggccttcgtctacacgacgctgcagc

SEQ ID NO: 45744 - DNA, 255 bp, Zea mays
  Clone ID: LIB3066-018-Q1-K1-G1
cggacgcgtggggccgtgtacgccaactgggagttctgcaagatgcagggcatcggctggggctggggtggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgagaggcgcagtgggccacggcacagaggacgctgcac

SEQ ID NO: 45745 - DNA, 430 bp, Zea mays
  unsure at all n locations
  Clone ID: LIB3066-018-Q1-K1-G10
gaaggggaagagtcagcaatggaggcgaggattgcaggagtgcccgaagatgaagagtgcggcctcctcccccgcccgtccgcagccggccgacggccgtcctcccgcggcccccgcttcccgcctccaccggcagcctgggcgacggtggacggccccctcgggcttccgctggaggacgcggagggccacgcccgccgcttcttcatgtggggtttcgcgtgcctccccttcctctgggccatcaactgctgctacttctggcccgtcctccgctcgtcggtcgcctcctcgcccgccgccttcgcccccatccgcccctatgttgtgcggtcggcaattggcttcaccatcttctccgttgttctggtcacctgggccacgaccttcgtcgtcngaggcgagccggtatttgggccagtgtggaatg

SEQ ID NO: 45746 - DNA, 393 bp, Zea mays
  unsure at all n locations
  Clone ID: LIB3066-018-Q1-K1-G11
gccgccctttttttttttttttttggtaaaactgtaagaacatgattattcttcactttcagctttcgactcaggttgtccggtgagggtgactgctgaagctcctcgacctcaactaggactaggaatctctgacgacggcggcacgacacatgctcgccgggccacctcgtccacgaacgcttggatatgcgcgtccgaggacccgccgagcgccacggcctcccgcgccgccgcgctccacctcctggcgttggcgagcatcgcgtcggcctcgggccccgccacggcggcgtctaccgnctcccgcacggcgtcccgccgcagcggcccgcggaagcggaccccaatcctgagttccttcaccaagaacttggcgtcagtgcactggtc

SEQ ID NO: 45747 - DNA, 125 bp, Zea mays
  Clone ID: LIB3066-018-Q1-K1-G12
cccacgcgtccgaaacttttgcactcgtaaagtggattagcagagggccgttaatttgtttttcagttgtaaactgtttacgtgaatgctgtaccgataccgtgataccgtctgactttttcatc

SEQ ID NO: 45748 - DNA, 333 bp, Zea mays
  unsure at all n locations
  Clone ID: LIB3066-018-Q1-K1-G2
cccacgcgtccgcgtacttgtattctagcagcaaagcaaagaggatcggatcagaagaaaagaatagttaggtcccggtggtcgatcgaacgaagctgctgctgctaccggccggccgggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctncagtgcggcgcgcttncacgccaacgtggatgcacgcgccta

SEQ ID NO: 45749 - DNA, 414 bp, Zea mays
  unsure at all n locations
  Clone ID: LIB3066-018-Q1-K1-E4
ccgtccgtgcctcnngtcccttccgcaccccgctcggctcggcccgnngtcctcttnctccggcccactttccgttccgatgcgaccgatggcggcnntaccgcccccaatgggtncaatcccacctggtcagctccctttcgcggcaacctcgttccggtccaaggccggttctgttcgacatnctgacgggaccctgtgcgaaactcggatcccctccaccaacgtcgctttccaagagatgcttctcgagatcgggtacaacaatggcgtgccgatagacgaggagttcttcatcaagaacatcgctgggaggagtgacgtcgaaactgcccagaaccttgtcccggactgggagcttgagaggggctcanattnctagaggacaaggaagcaaaatacaggagtctggca

SEQ ID NO: 45750 - DNA, 106 bp, Zea mays
  Clone ID: LIB3066-020-Q1-K1-C9
gcctcacctgtgtcactaatcatcggcctgttcctcctgctcaattcagacacaggggattgtgtttgctcccgagctgtctacctgcactgcacgtttgagtccg

SEQ ID NO: 45751 - DNA, 272 bp, Zea mays
  unsure at all n locations
  Clone ID: LIB3066-020-Q1-K1-D1
cccacgcgtncggcacgcaagtgtcaagagacgaaacggtcgacatggctcgcacgcaatctgccgtagcggtcgccgtggtggccgcggtgctgctgctggcagcggcggcgacgacctcggaggccggcatcacctgcgggcaggtgagctccgncatcgcgccctgcctctcctacgcccgcggcacggggtccggcccctccgcgtcctgctgtagcggcgtcaggaacctcaagagcgccgncagcaccgncgncgacaggcgcgcc

SEQ ID NO: 45752 - DNA, 320 bp, Zea mays
  Clone ID: LIB3066-020-Q1-K1-D10
tccacatctactcatacctctgttttaaagttcacgcttcaacactcaacaaccgggcgtggtatatatgtaaagggtctacacttacaatctattgcatatttgattattatacataacttttatcatttgatgattccatcttaatctctatatacatctgaaatgtatgcataacccaataacgaacgatttgaaagtgtactcgatcattctaccattagacaataagatcttctttctaaaaatattctattttgaactcttatatgttcaaaatttatattgaaattcttttataaatttttccttactttttc

SEQ ID NO: 45753 - DNA, 464 bp, Zea mays
  Clone ID: LIB3066-020-Q1-K1-D11
cccacgcgtccgagcgctgctgcctcgcccccgccgcgtcgtcgcgggtccccggggtcggttgctgctgcgctgccagcgtcatggacgggggatccggcaatgcctccagcggcggagcggcggtgtgctgctactacgcgctcctcggcgtccgcaagagcgcctccgccaccgacatacgcaccgcgtaccggaggctcgcgatgaagtggcacccggaccggtgggccagcgaccccggcgcggccggcgaggccaagcggcggttccagcggatccaggaggcatactcagttttatcggacaaagggaagaaggccatgtacgacgccgggctcttcgatcccctcgacgacgacgacgaccaggatttctccgacttcatgcaggagatgctggtgatgatggataacgtgaaaaacgagaagccggacacgctagaggacctgcagaagatgctg

SEQ ID NO: 45754 - DNA, 420 bp, Zea mays
  Clone ID: LIB3066-020-Q1-K1-D12
cggacgcgtgggcggacgcgtgggtgcgagtgaagccttccctggttaacatttgggtacgcttgcagggttgtgcagttgtattggtgcattcaacttgcaggagctacaagtccataccagaagctgaaagaagggggcaggatcaggtccctcacagccacacaggagaagacgaggatcggccatgcctcttgctgctccaggtgggcgatctcgagaagttcaagagcgtgtcactggctatggaaaagggccactctgcctccagagtcctggggactggggagggacgccgtccgtggagagagttgtgggtgatgagggaaaccgatggagaatgtgcttgtcttatgtgtgctggaagttgaaagtgtttttgaaaaaaaaaaaataaaaattaaaaaaaaaaatatataa

SEQ ID NO: 45755 - DNA, 355 bp, Zea mays
  unsure at all n locations
  Clone ID: LIB3066-020-Q1-K1-D2
ctacaaccagatgggcgacgtgccccccgccgttaacgggccactccatgtcatccccaacgtcatgaccgccgagttccggaccttcatcgagatcgtcttcgagaaccccgagaagagcatagactcccttcacctcgacggctacgccttcttcggcgtcgggatggggcctgggacgtggtcgccggagatgaggaagacgtacaacctactggacacggtgagccggcacacgatccacgtgtacccgcggtcatggacggcgatcatgctgacattcgacaacgcgggcatgtggagcgntcggtccaacgtctgggagcggtactacctcggggagctagtctacatc

SEQ ID NO: 45756 - DNA, 264 bp, Zea mays
  Clone ID: LIB3066-020-Q1-K1-D3
ctaacgcctgctgcacgccagtctcaacagacgaaacgggccacatggtttgaacgcaatcggccggagcgatcagctcggtggcctcattgctactgcttgcaacaaccgcgacaacctcataggctgccatcacctgcacgcatgcgaactccgccatctcgccatgcctcttctacccccgtggcacgagatccggaccctgcacatcctgctgtacccgcgtcaccaacctaaatagcacctgcagcaccgacgacgaca

SEQ ID NO: 45757 - DNA, 220 bp, Zea mays
  Clone ID: LIB3066-020-Q1-K1-D4
ccgcaaggtcatcatcacgactgccgagaattcgaacatcccgaggagggagatcacgaaggaagtgctggaatctatcctatacgaagttttctacagaatccaagacccaaaccttgtgtacccttactaccatctcaacccgtatcatgcctacgactaacgtaatctatcatggctggctccaacatacgccgagcctgctacaatgtttatcgca

SEQ ID NO: 45758 - DNA, 240 bp, Zea mays
  Clone ID: LIB3066-020-Q1-K1-D5
cccacgcgtacgagaacatatcgatgcttttaaatatcaatcagctccctcttgcaaggtatgtgctcgttgcacaggtgctcagatagctccttctatgcatctgctaccatcacataagatggcttactgagctttatttcatgtagatacatcctatgaacattcctttacttcggctaacgtatcatattacaatcccttatgattacgattttctttgaattatgcacctaacca

SEQ ID NO: 45759 - DNA, 364 bp, Zea mays
  Clone ID: LIB3066-020-Q1-K1-D6
cccacgcgtccggacccacgcgtacgtccactcgtccgcccacgcgtacggcattacgagggcaaaagtaagctgctgctgttcttcgacccgtcccgttcgatcgattcgttctttccgccatggaggctcggaggaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgacagtgcctgttggcggactgccaata

SEQ ID NO: 45760 - DNA, 398 bp, Zea mays
  Clone ID: LIB3066-020-Q1-K1-D7
ctgtcagcatttactatgttgcaacggggggaaatttttgtcttcatgtaacaacgctttacagttacattcatttaccactttcaacccccacaggcaattcttgctgtgcaagcggtactttcaaatttcagttacacccacgtaagcccacatatgcaaaaaaaaaattaaaaaaaataccagaattttacaggaggcatacggttgtaggctcagcagacctcaacgatcaaattgtttgtccagcagagttctaaaggctctgaaagcagtctgctggaaacattttgcctctgttgcaactaaaaagctctgtaaactatttggttgaatatataaacaaataacgactgcactgtcgtgactgtcatgaacctttcacattgatctcaaca

SEQ ID NO: 45761 - DNA, 356 bp, Zea mays
  Clone ID: LIB3066-020-Q1-K1-D8
gcggcagcgcccgacagagcgagacgcagcggcggacgaggggcagaggcgagcgcggcctgcagtccctgctaccatggacactttcttcctgtcgcacggctcgcccacgctctccatcgacgacaacatcccggcgcggcacttcttcaagtcgtgggtgccggcgaaggtcgcgggcgaccaacccccgcgcgccatcctcgtcgagtcgggacactgcgacacgggcacgccggaggtcaacgtcatccaccgcagcaacgacaccatttacgacttctatggcttacccaagcccatgtacaagctcaagtaccccgttccgggcgccgcacacctgttcctgcggacca

SEQ ID NO: 45762 - DNA, 326 bp, Zea mays
  Clone ID: LIB3066-020-Q1-K1-D9
tccacacctcctcatacctctgcttgaaagcacacgcttcaatacccaacaactgcgggaggtatatatgtacagcggttacctttataataaccattaaatattgcgaatgaacctaaatctctacatctaatttacgcaacattcccattgatatataacatatctggaccattgattatgatgtttactagctgaaactcaattcaatttgagctatgcagtttgacactccttttcatgtatacctatttacatatttattagcctattcttctattatatttaaacttaccttcacttgcatgctacgttttaattctttt

SEQ ID NO: 45763 - DNA, 326 bp, Zea mays
  Clone ID: LIB3066-020-Q1-K1-E1
gtgaagcaagcagcacacgagacgatatagagggagggatcatggctctcttccgtgccgccgcgtcaggagggttcgcgctgatccttctcgcgtgctgcagcctcatcatgctggcggcggcgtctggcggcggcggcgtggacgacgacggcgtcggtggtgacaggctgatgatggaccggttcctcagctggcaggcgacgtacaaccggtcgtacccgacggcggaagagaggcagcggcggttccaggtgtaccgccgcaacattgagcacatcgaggccaccaaccgggcgggcaacctgacgtacacgctcggcgag

SEQ ID NO: 45764 - DNA, 399 bp, Zea mays
  Clone ID: LIB3066-020-Q1-K1-E10
gcgatcgaccttactcgaggacgactgaaacatgcgtcaccataccatggcccccagcaagctctgcgaggccctgtgcgcggtcaaggaccatacgagcatcgggctgcccaacgtcgacagcggccgctccctgcacgcggacctggacttggccatcgtcaaggccaccagccacagagtgatcattgcatatgcactgacctccatattctggcttagtcgcatctcttactctgctgtcaatgattcatatctctatatgcatatctctctgctctgccttgctggctggctcttctcatcattccctagcagatcgcatagtattagttgcatgcattatatagatgattcaggtccttcgtttagcaacatggcgttctatctaattgtttt

SEQ ID NO: 45765 - DNA, 378 bp, Zea mays
  Clone ID: LIB3066-020-Q1-K1-E11
cactaatccaagacaaaacatggctgtgaatgtgagaaccatgtggtcgtcgatgcgggcagaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacatggacgtgaacaagccccccttcaatagcatggtcgcatgcggcaacatccctatcttcaaggatggtctgggttgtgggtcctgcttcgagatcaagtgcgataagcctgtgtagtgctccggcaagcccgt

SEQ ID NO: 45766 - DNA, 350 bp, Zea mays
  unsure at all n locations
  Clone ID: LIB3066-020-Q1-K1-E2
cctctctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgnctctacacccccttcttccacggacgaggagttgagcccttccncccagcattccaccgcgcggcgtcccctgc

SEQ ID NO: 45767 - DNA, 360 bp, Zea mays
  Clone ID: LIB3066-020-Q1-K1-E3
cagggatactatggccttccaccgactccacaggagaacctcacctacgaaggcactgagagggcgacgtacgctcaaggtcatcataggaaggctagaagcttatcgagcagcgaacatggagatggtgctgacgatgctgagaagcccataaggcggcgccagaaagccgactctgagctgacgacaggtagggaggacaatggcggttgcctcttgccaagggctgggcaagggctggccctgaggccaaaatctgggagtcgaccagacgggaacggcagccagctagatctctcggccacgtgggtgccctcgtacggggatgggctgcacaccgtgaagaaatcatcgagcacc

SEQ ID NO: 45768 - DNA, 466 bp, Zea mays
  unsure at all n locations
  Clone ID: LIB3066-020-Q1-K1-C7
ctctcgtttcgccctccccctcgagcaccccgccggctagggttacggccaccgccttccaggcctcccccacttcccgtaggcggaggctggtcggcgtgcacgcgaccgcggcggcggagatggacccggacttctcgcccgggggcggggggcccagctttgaattcgccttcaacgaggtcaacttctccgaccgggaattgcgtatcgaggtcgtcgccggggatgactacgctccggggtccagcggcgccggtgccggaggaggtggcctcgccgactgggcgcgccaccgcaagcgtcgccgtgaggagctcctcaaggagaaagaatctacaactcacatgtcagaccaaacaaattgcaatgaagttgaagcagaagagtgtgatgcgtatgaagaanatcaagaggaacctgtagcaatggtagaagaatctncacccgatgttggccaagatgg

SEQ ID NO: 45769 - DNA, 461 bp, Zea mays
  Clone ID: LIB3066-020-Q1-K1-B11
cggacgcgtgggttcaaatggagaatatgtgaaatctgggctttgtgtgctggagaaatggattgtggacactgaagagcatgcaggtgcagcttgggatgagctgcagttcattaggcaagcggttgactttctgatcattccacagaaaagcaaaaagaccattgagcagattaagaaaaatatttgcccggcattaagtgtgagacagatatatcgcttatgtacgatgtactgggacgacaaatatggtactcatagtgtatcagctgaggttgttgccagaatgagggacatggtgagtaatgacatgcaaaatcctgtctctaattcatttcttttagatgatgacttaagcattcctttcacaaccgaggaaattgcagagcaagtaccagatgttgacatgtcaaacatcgaaactcccgcatctcttcgtcatgttcattctgctcagttct

SEQ ID NO: 45770 - DNA, 463 bp, Zea mays
  Clone ID: LIB3066-020-Q1-K1-B12
ctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgcctcagctgcttcctagctgggggtgctctctaccgtttcgagtacgcagtcaacccggcgctcttcctcgccaaagcgcgaggagggacgtgcacgctcgctccctctgaccctgacgacacggtggctcgccgcgccagatacctgctgagcaacggtttcaagtgctacaacctgttcaagagcaact

SEQ ID NO: 45771 - DNA, 181 bp, Zea mays
  Clone ID: LIB3066-020-Q1-K1-B2
acgcccacgcgtacgcccacgcgttcgcggacgcgtgggcacggctctcctctcggatgtctgagctgcgacccaataatggcagaagttctatcaggatctcatgaacaccgtctaagctctgccttagatggacactacgacgagaagaggacatgcaatgtggaacacacataggacg

SEQ ID NO: 45772 - DNA, 156 bp, Zea mays
  Clone ID: LIB3066-020-Q1-K1-B3
acgcccacgcgtccggaaggccctgcccatgcctttgctacaggctctcttgttgcttaactgggcagggtgccattgatgctgtgagagatatgagcatctgacaacctgtgtgctatcgctgtgtcatattgatactcagactccacttagact

SEQ ID NO: 45773 - DNA, 388 bp, Zea mays
  Clone ID: LIB3066-020-Q1-K1-B4
accccatcttgcaacagactatcgatggcaaagtactactgtaacatctgtaaattttttgatgatgaaaggactgtgtaccactgtccgttttgtaatttgtgtcgtcttgggaaaggtcttggtgttgatttcttccattgcatgaaatgcaactgctgccttggaatgaaattaactgagcacaaatgtcgggaaaaagggctagagacaaattgtccaatatgctgtgacttcctatttacatcaagtgccgcagtcagagccctcccttgtggccacttcatgcattcagcttgctttcaagcatacacttgtagtcactacacttgccctatctgctgcaaatccttgggagatatggcggtttattttggcatgcttgatg

SEQ ID NO: 45774 - DNA, 436 bp, Zea mays
  unsure at all n locations
  Clone ID: LIB3066-020-Q1-K1-B5
acttctccgcacgtcgcgccgtccgcgtttgcgaccaacccggcggtgggggcggcgtcaccgccactcctcgagccgctcccgctcctccgcgacgtcgccgccgcagaccgtccgggcctcatcctccgcaagctccgcctcgtcgcggcgctcttcgacctctcggactcgctcaagcacccgcgagagaaggaggccaaacgccaggcgctcctcgagctcgtagattacgtgcaggctccagctcaggccgcgggcgccaacgcgcccacgcgccttccggaccacgtccaggaggcgctagtccttgccatctctgccaacatctntccgccgctgccacccgcgctgcacgagtccgccgtcgcgatcgaccccggcgccgcgcccgacgacgacgaggagccatacctggacccctcctggccacacc

SEQ ID NO: 45775 - DNA, 357 bp, Zea mays
  Clone ID: LIB3066-020-Q1-K1-B6
cccacgcgtccgggttgacggcaaagcaagtccttgagcacccttggctcaagaatgctgagaaggcttcaaatgtgtcactcggagaggttgttcggtcgaggctgaagcagttgtcgtctatgaacaagcttaataagaaggcacttggagtcgtcgccatgaatttaccgatggaagagattggcacattcaaagagatgttccatacaatggacaaaaacaaggacggtagtttgtcacttgaagagctgaaggagggttttcggatgaacgatcatcctgcttcagaggaagagataaagatgctgttacaagcggtcgatatacattgaactgacacattacattgtgagg

SEQ ID NO: 45776 - DNA, 132 bp, Zea mays
  Clone ID: LIB3066-020-Q1-K1-B7
cccggtcgacccacgctccgccacctccgttaccctaaatcacgtttagacaccattgctcaataatgctaggggcttcaaatgtgtcactcgatagcaagtacgtcaatgcttaaacagttgacatctaaa

SEQ ID NO: 45777 - DNA, 423 bp, Zea mays
  Clone ID: LIB3066-020-Q1-K1-B8
gttcacgccacaggcaaggcacagaggcttgtgagggagagcgaggagcggaggaggacatggtgcacgtgacgctggaggtgctgctcgttggggccaagggcctcgagaacaccgattacctgtgtaacatggatccgtatgcaattctcaagtgccgttcacaggagcagaatagcagtattgcaactggaaaaggaactacccctgagtggaatgaaaactttatcttcactgtgtctgaccggacaacagacttggtaatcaagattatggacagtgatacaggcacagcatatgactctgttggtgaagcaacgattccattggaagcaatgtatactgaaaggagcattctcccaacactctataacgttgtgaaaggcgtgaaatactgcggagaaattaaagttggattcacat

SEQ ID NO: 45778 - DNA, 422 bp, Zea mays
  Clone ID: LIB3066-020-Q1-K1-B9
gttgcttcagttcagaacttcagtgttgtgtctgtggacgaggctcaaatttctgcgaacgggatcaaacatgggccattggcaatcggcatcaatgctgcctacatgcagacatacatcggaggcgtgtcatgcccatacatctgtggcaggcaccttgaccatggtgttctccttgatggatatggtgcttctggtttcgcccccattcgcctgaaggacaagccttactggatcatcaagaactcgtggggcgagaactgtggggagaacggatactacaagatatgcaggggttccaacgttcgcaacaagtgcggcgtcgattccatggtctataccgtgtccgcagtccacgcctcgaaagagtagactctggtcagcggtgataatcgtgattccatatattgtagaactataat

SEQ ID NO: 45779 - DNA, 60 bp, Zea mays
  Clone ID: LIB3066-020-Q1-K1-C1
acgcggacgcgtgggccgcatagacaggcgtgttccgactctcctatctgtgcgacccaa

SEQ ID NO: 45780 - DNA, 331 bp, Zea mays
  Clone ID: LIB3066-020-Q1-K1-C10
gcctcacctgtgtcactcatcctccgcctgttcctccgtctcgattcagacacacgtgattgtgttagctccggagcaggctacgtgcactgtacgtgtgagtgccgcatctgcttaagctgtcgcgccgtcaatggaagccacaacgtcaaacccgcactcctcaacctcacttactcccacgcccgcgccgtcaatggaaggaaagccaaatctccttgcccgcagtcctcggaaggttcgcacattcacctactgtctcgctcgtcatggaagccagatcttcaaacccgtcgaccttgcaacgtctattgaatgtccatcaacttct

SEQ ID NO: 45781 - DNA, 459 bp, Zea mays
  Clone ID: LIB3066-020-Q1-K1-C11
gttcgaggtggaccaagagcagaaggccagcaactcgcggttcatgacccagaaaccggcgtcggcgatagtgtcaaagctggagcagatcgctgagacagagcgcttcatggtgaagaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcacaattggagccatcctcttagaccgtctccgacagtttactcacccctcttagtcgattgttatttaagtgcagtctcttcggagatgcaattacagtcca

SEQ ID NO: 45782 - DNA, 429 bp, Zea mays
  unsure at all n locations
  Clone ID: LIB3066-020-Q1-K1-C12
aaactgatctgccaagcatatttttcttgcccaccatggttttcttctggagcgaagaagtttattaagcgcattctcgatcctaatcctgatacgaggataacaattgcagaaattttggaagatgaatggttcaaaaaagactataaaccaccacgttttgaacaaggtgaaggtgttagccttgacgacattgatgctgcattcaatgattcagaggaccgtcttgtggcagagaaaagagagaaaccagaatccatgaacgcatttgctcttatttcgaggtcgcagggtttcaaccttggaaatttgtttgagaaggagatgatgggaatggtaaagagggaaacatctttcacgtctcaatgcacagcacaggagatcatgacaaanatagaggatgcatgtgggccacttcgtttcaacgtg

SEQ ID NO: 45783 - DNA, 284 bp, Zea mays
  Clone ID: LIB3066-020-Q1-K1-C2
acgcaggcggacgccccgagaaggaactagcgacagctcagaggcgccgagcacttatgccacagacagggcttgtaccaccatgaactaaagccctagaacctcctgagccacgagcacaggaacctgaaggtgtgcgacttccatctgagcgcgctcagggagtgccagaagcaggacggaatgctgcacaccagctgcgggagccccgcgtacgttgcgcctgagatcatcaacaggaagggctacgacagtgccaaggccgacatatggtcctgcggcgt

SEQ ID NO: 45784 - DNA, 270 bp, Zea mays
  Clone ID: LIB3066-020-Q1-K1-C3
cacacgcatgcgcctagaacgagcttgcactaaatcatcaacctcgactacttcttccacaggcgggcataataccaccatgacttaaatacctacaacctcctcagccacgaacacagacacctcaaggtctccgacttccatctaagcgcgctcattgactgtcagaaacatgacagactgctgcacaccacctgcaggacctctcactacattgcacctgagatcattaacaataaggtctactaaagagccaaggccgacatatgc

SEQ ID NO: 45785 - DNA, 242 bp, Zea mays
  Clone ID: LIB3066-020-Q1-K1-C5
ggtcaatcctcatacacatcaacttaagatttgcgattttgggagcgctaagaaattggggcgtggtgagcctaacatatcgtacattagctcgcggtattatagggctcctgaactaatatttggagctacggagtataccactgcaatcgatatctggtctgttggctgtgtagtggctgagcttctgattggtcagtctcagtttcctggtgaaagtggtgttgatcatctggtcgaga

SEQ ID NO: 45786 - DNA, 334 bp, Zea mays
  Clone ID: LIB3066-020-Q1-K1-C6
gggggatgccgccatcgtcgctagggacagaaacaccgaggagagcagagatggagccgcgggccaaacggaggaagggccatcatttagattgagcgtatggccagggatattcgctgaaacctcaggaatacgctcatggtccctatggacgaggagccccaccgggctcactgggatttctcgccggtgttggcagacaacgccgacccgccgtgcgccgtggccaagcttcactgctgcctccatcttgggttgtcagcattgcaactactgttcaggcgataatgaacctttgtaaggagacttttaggagttccaggattacgacaag

SEQ ID NO: 45787 - DNA, 336 bp, Zea mays
  Clone ID: LIB3066-020-Q1-K1-B10
gatgctacagtccacaacttcactactctttatgtagactacgctcaaattactgctaactgtatcaatcatgggccattatcaatctgcctcaatactgactacatgcatacatacattgaaagcgtgtcatgcacatacatatgagatacgcaccttgaccattgtgctctcattgctggatacggagactctgatttcgccaccattcatctgaatgacaagccttactgtatcatcaagaactcatgaggccagaactgatgcgagaacggatactacaacatatgcaggagttccaacattctcaacaagtgctgcatctattacatggtc

SEQ ID NO: 45788 - DNA, 242 bp, Zea mays
  Clone ID: LIB3066-019-Q1-K1-H11
ctgacgcgtggtcaatggcgctcaccgccgtcctaccttcatatacctagcagcgtctctggataaaaagataaaaggtaggaggaggcgcagtgcgtggtgggattatttgtgaggagatattggaggtatcatatatatatatatatagggagacgatcgattgacagctagatctatagatgcatagtctatgggttccgatggatcacaccggtctctgtcgtactgtacttggactt

SEQ ID NO: 45789 - DNA, 341 bp, Zea mays
  unsure at all n locations
  Clone ID: LIB3066-019-Q1-K1-H12
gggcacgcgtccgggaggggagccccggacggagaagagaacagaagaaaccccgcggccaccccttcctgcctatattgctctctctgtcttgcgcgacagggagagaccagcgccaacacctccggtttcttgattgggtggtgatcggtgaaggaaggagaaattaagatgagcctcttcgggcttgggagcaagaatcagaagacgttcaggcctaagaagaatgcaccgtctggcaacaagggtgtgcagctgaagaaacacatcgatgcaaccttaggaagcggngaattgagggatgctgtccgattgccaccagggggaggatctcaatgaat

SEQ ID NO: 45790 - DNA, 328 bp, Zea mays
  Clone ID: LIB3066-019-Q1-K1-H2
gttctagatcgcgacggccgaccttttttttttttttttcttttttttttttttttttttgtttttgttttttttttatttttttttttttaaggcccaacacaatcaagcaaaccgatttctgcattaccattaattattacatggcaaacagcccatacatgctagctatttttgaaactgttttttaatcattacatcagcaccgatatcccgggaatatcctccaagccatgcatacctgtgaatccaacatcgacttcgttttttaaatccatccatttcaagccaacccccccgacttggcccatttcattacactcttacg

SEQ ID NO: 45791 - DNA, 421 bp, Zea mays
  Clone ID: LIB3066-019-Q1-K1-H3
cccacgcgtccgcggacgcgtgggctggtccaagtgatcttgccaagttacgagcagcgagcagagatcagatcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcatgcaccgcccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgccgtggccggcgtcacgaacacggtgaccggcgcggcggctggtgtcaaggacaccgtg

SEQ ID NO: 45792 - DNA, 295 bp, Zea mays
  unsure at all n locations
  Clone ID: LIB3066-019-Q1-K1-H6
atgtctgtctagcatgccgagctgactacgtcctagctagcgcaacgacgatggccaccgcgctctccttcaacgccctcgcagtggccgcgctcctgtccgtggtgtccgtcgtcacctacggcgctcgcgcacagcagcagcccagccacaacgccttcgagtcgtcgcaggacaggtnccttgtgtcctacagcagtggctggctgcccgccaaggccacctggtacggcgcgcccaccggcgcccggcccgacgacaacggtggtgcgtgcgggttcagggcccaaccagt

SEQ ID NO: 45793 - DNA, 311 bp, Zea mays
  unsure at all n locations
  Clone ID: LIB3066-019-Q1-K1-H7
gtctattggaatcagcaacaaatcttcaggtgctttgcctgcactattgtcttggaagtttgacttcatttagtttccaaacaaaggcacctgcattaagagtattgcggcttcattgggtaacttcatggcttacaaatgatgacttgacaatccttacagagaattgcaatttggctgaactttcactttctggttgcaaacttcttgactccagctctcaagacattatctcatctgggtggccaaacttggcacttttacaccttgangaatgtggtaaagtaactggtgaaggggtttctcttttt

SEQ ID NO: 45794 - DNA, 389 bp, Zea mays
  Clone ID: LIB3066-019-Q1-K1-H8
gcgcgatgcactcgatcagtctctatagttcccccggcgtactacgcacacctggcggccttccgtgcgcgccactacatggacgatgacctctccgaccaggggtcgtcttcagtggcgagctctcgcatgaaagatggcgctgttccggtgaagcagctgccgaaagtgatggagagcgtcaagcagttcatgttctactgctgaaggtggcctttgcaggaaggaccgtcatcgacacttttgttgccatgaaatgaatcgagtaattctgggttggtgtaactatggtgaagtaaccctgaagggcgggccgcacgacctccaaatcatattttgggcctggcgagtcttctatccaaaactcgtcagaaaatgccttttatttt

SEQ ID NO: 45795 - DNA, 385 bp, Zea mays
  Clone ID: LIB3066-019-Q1-K1-H9
ctaaaaattatttggacagagacatcacaaatggatctgatcacaaatcacaaatgtgacaagcttgctaaggtgaaactgctaaagaagttgtatgactactatgccgcgggcacatgacatcaattgactcaaggagaaaagagaggcgtcatccaaaattctgagtttgttcgctctattagagcccagaggcggtactgggcgaggagctatgctggatggataaggtttaggagagcacaaccaaatgcagcccattacgatccttcccttctgtctgcgcgccttcactttcatctggcactgggagttcctgtacatagacttgtaaaagctgccgactcagtttcggtatgcctatctaaagggttaggcgcaccca

SEQ ID NO: 45796 - DNA, 363 bp, Zea mays
  Clone ID: LIB3066-020-Q1-K1-A1
cggacgcgtgggcggacgcgtgggcgaccccaagtcccacgagggcctggacctcaacaaggtcaccaccagggaagtcatctccaaatacggattggaggatgatacggtggactttatcgggcatgcgctagcacttcaccgggacgacagctaccttgacgagcctgcaatcgacactgtcaagaggatgaagctctatgcagaatcactcgcacgctttcaaggagggtccccttacatctaccctctatacggtctgggagagctccctcaggcctttgcccgcctgagcgctgtttacggtggcacgtacatgctgaacaagccagaatgctaggtcgagtttgatgagagtggaaa

SEQ ID NO: 45797 - DNA, 240 bp, Zea mays
  Clone ID: LIB3066-020-Q1-K1-A10
gaccgcataggctcggggcatgttacgcgtgcttgcgagtctggtcaaactatgagcgtatggccggaccattggccaccataaactgaccggctgattgtcaatctcgctctgtaccctattaccgaggctgagaggcgaggacagaatgccacgtacgcaccatgcacccagacgaccagacacttacacgaggaggatcacacactgaagaagagactaagccgccttactgaacga

SEQ ID NO: 45798 - DNA, 260 bp, Zea mays
  Clone ID: LIB3066-020-Q1-K1-A11
cccacgcgtccgcccacgcgtccgcccacgcgtccgcccacgcgtccgaattggtcgtctgagaaattttgatagcgccgcctgatgtgttatcatcattatatgtgtaattttactgttttaccaggagattgctacgtcgagttatatgttgtgtcgaattcacgtgtaggctctgaatcttgactgtgttcgttcattttcgcttgtttcacactgaagtgttataagctcaactttactgcttttgttttcttgtg

SEQ ID NO: 45799 - DNA, 453 bp, Zea mays
  unsure at all n locations
  Clone ID: LIB3066-020-Q1-K1-A2
cccacgcgtccgaattgtccttgagatggatacctacagataccatggccactctatgtcagatccaggaagcacttaccgcaccagggatgagatttcaggtgtcaggcaggaacgggatccaattgaaagggttagaaagttgcttttgactcatgacctggcaaatgctgctgagctcaagaatatggagaaagaaatcaggaaacaagtagatgacgctattgctaaagcaaaggaaagttctatgcctgatacttctgaactcttcacaaatgtttataagaagggcttcggcgtggagtcatttgggccagacaggaaggagatgagagcttctcttccgtaggttggcagcatgatgaggcagtcctcattacatggtatgatagccaggaaaaataattnttgatgaaggcctcangcattattggaaatatnntatcggaaatg

SEQ ID NO: 45800 - DNA, 393 bp, Zea mays
  Clone ID: LIB3066-020-Q1-K1-A4
ccgaggaggatcccgacgcctccgctgccgagggatgggtggacgagctccggcgactgcgcgtcgccgagctccgtcgcgacgtcgagcgatgcgatctctctatcgggacgctgcagtcaaaagtgaaacggctgaaagcggagcgggagcagagagcctccggcgaggctgtgagcgaccacgatcgcctctcaagcgaggagcccgggtgctcatgcagggagtcgaactccacagatctgaagccgcccaaacatcccagccagctaggcgacgggtctaaggaggagaaggttgcgaaacaggaagcgtccgttgagtcggcgggcgattccaaagacagcagcgaagtgcggagctcggcgagcttgtgcccgcggcggcgtggaa

SEQ ID NO: 45801 - DNA, 399 bp, Zea mays
  Clone ID: LIB3066-020-Q1-K1-A5
gtgctctagctgctgggcattcgtgacggcggcgacgatcgagagcatcaccaaggtcacgacagggaggctggtgtcgctgtcggagcaggagctgatcgactgcgacccctacgacggcggctgcaacctgggctacttcgtgaacggctacaggtgggtgatccagaacggcgggctcaccaccgaggccaactacccgtaccaggcgcggcggtacgcgtgcagccgctccagggccgcccagcacgccgtcaccatcttcgactacgtgcagctgccggcgggcgagggccagctgcagcaggcggtggcgcagcagcccgtggccgcggccatcgagatgggcggcagcctgcagttctacagcggccgcgtcttctcggggcagtgcgggac

SEQ ID NO: 45802 - DNA, 177 bp, Zea mays
  Clone ID: LIB3066-020-Q1-K1-A7
acgcttatgcatccgctacacatcaagctcagattcaactatacataaacactatacatcgccacggcaaatttgcacagtattatcaatactatctatactataatacctcatactttataacgtatgtactatcctactatatatactaaatctatactaatgcatcatacatat

SEQ ID NO: 45803 - DNA, 240 bp, Zea mays
  Clone ID: LIB3066-020-Q1-K1-A9
gaccgcacaggctcggtgcatgtgacgcgtgcttgcgagtctggccatactaagagcggatggccggacaatggcctaccatagactgaacggctgattgtcaatctcggtctgtaccctaatagggagcctgagaggcgactacagcatgccacgtacgcaccatgcacgcagacgaccagacactgacacgaggaggatcacacactgaagaacagtatcagccgcctgactgaacga

SEQ ID NO: 45804 - DNA, 331 bp, Zea mays
  Clone ID: LIB3066-020-Q1-K1-B1
cccacgcgtccggaaggcccggccgatgccacggccacggccacgctggctgcttaacggaccattgtgccattgttgctgtgagagagatgtgcgtcagccaacatgtgtgctattgctttggcttatttgtgttcagaatccacttaaactcggtcgaagtgagctttccgttcggcaacgtctgtactcttacgaatctcgatcgtgtatgtctttaagtattgtgttgtgtttcaaagataaaaaaaggtgacctttgtgtatgattttttatacacgttgtctcttagctgcattgatagtctaaggtctcagatttgtaccatgc

SEQ ID NO: 45805 - DNA, 412 bp, Zea mays
  unsure at all n locations
  Clone ID: LIB3066-033-Q1-K1-G12
cccacgcgtccgcccacgcgtccgcggacgcgtgggcaaaacatggctgtgaatgtgagcaccatgtggtcgttgatgcaggcacaagttgcgatggttgtggcgttgtccttcttggtgagcggcgcatggtgcggtcctnccaaagtcccccctggcaagaacatcacggccacctatggcaaggactggttagacgctaaagcaacatggtatggcaagccgacgggtgccggtcccgacgacaatggtggcggctgcgggtacaaggacgtgaacaagccccccttcaatagcatgggcgcgtgcggcaacatccccatcttcaaagatggtctgggttgtgggtcctgcttcgagatcaagtgcgataagcttgtggagtgcttcggcaagccccgtgtggtgcaca

SEQ ID NO: 45806 - DNA, 309 bp, Zea mays
  Clone ID: LIB3066-033-Q1-K1-G2
cggacgcgtgggcgacgctcgcatacactccaattccccacctcacctttgacatcagggtaggctgcagcggcagtggcctagcgccttcaatgccggcacctgcgagaaactactactcgtacccacctaccgttacaccgactatcgacgttcaccatgactagctagacctcacgcacgcactacccatgcaagactgctacaccgacacctactgtcaatggacactcgattactcgacgtttattcctgacatatccagactcatcatcatcactgcgccgttcgtcgacgctaccctcatct

SEQ ID NO: 45807 - DNA, 387 bp, Zea mays
  Clone ID: LIB3066-033-Q1-K1-G3
cgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcatgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgt

SEQ ID NO: 45808 - DNA, 371 bp, Zea mays
  Clone ID: LIB3066-033-Q1-K1-G4
cccacgcgtgcgcccacgcgtccgcgtatattctgacgactgccatgtatcttgctcatgtatgctcaaggctcattatcttgttcatgtattaagcatgtcatgaataactcaatacttattaaaaactgacttcattaatatttacaacaatcaagatgagcacgtggcggtagcgcaagtggtggtcaaagttcatctgggttacctctttggaagcggtgagccccccaaaccagcagtggcaccagctgtaaatgctccacctgctgctgcaagtgctccacctgctgagaaaccacctgctgcaaagcctgatggtaccagtcagatagctgctggagttaccagccattccaataactaccaca

SEQ ID NO: 45809 - DNA, 432 bp, Zea mays
  Clone ID: LIB3066-033-Q1-K1-G5
ccagtttccggtagcataccaccatgggcctctgcatatccgtgtctctctggaaggagaagctctacggcgccgacggcagcagccggtcggtgcagtgtcgcgtcgtccatgaggttgccggcgtggagagtggtgactgcgagtgcgggaacttgggaagcgacgccgacgcgctgggggtagagcagaaggcggcggctccggcggccatggacgtgaaaaccggtggagtggagggaactgccgctgccgtgtcgggtggcactcctgtgcggccgatatggcagatgagggtgctgatgggcgtcaagtgccagctgccgcggttcagcgtgatggtactctacgacgagagcggccggccggtgtgcactggcgtccgggacagagctcgtgaccaggagaaacatgctgcagcgatttcagtgc

SEQ ID NO: 45810 - DNA, 404 bp, Zea mays
  Clone ID: LIB3066-033-Q1-K1-G6
gtagataaaaagaacacccatttaccagggttgctcttcttcatcctgctaatccaaaccaactgacacctccttgccattgctaacgcaccatcagaagctgtcaacaaacaaaaacatcatcatctgacgattagcagccaaaagcatgtcctgctcgtctcttggtgtcagacgcggctttgttcaccgtccgtcgtggacgctctgctcagtgggcgatccaggggagaagggcacgaacccgcggccgccaaacatgggccgcatgagcgcgtcgtcgaacttgcgccagtagtagtgcaccgtgtgggttggcttgcttaggagcatccggaggctggacgggctcacaatctgtgccgaccccgtctcgatgtccgagccctggttctagatcgcga

SEQ ID NO: 45811 - DNA, 270 bp, Zea mays
  Clone ID: LIB3066-033-Q1-K1-G7
ctacaagatggcgtgcacaaacaatgcgatgagagccttggtcctcctggtcctcttgtgcatcgtgcatggtgagacggaagagtcacagggcatagatgcgaaagcgttcgggcctgctgggtccttcgacatcaccaagctgggcgccttcggcaatggcaagacagactgcacgaaagctgtgcatgatgcattggcatcggcatgcggcggcactgggaagcagacaatcgtcatacccaagggagacttccttgtcggacaact

SEQ ID NO: 45812 - DNA, 295 bp, Zea mays
  Clone ID: LIB3066-033-Q1-K1-G8
cggacgcgtgggcggacgcgtgggtgaacatgtaccggtgcaaggacatgctgatcaaggacgtgaccgtgacggcgcccggggacagccccaacacggatggcatccacatgggcgactcatccgggatcaccatcaccaacaccgtcattggcgtcggcgacgactgcatctccatcggccccgggacctccaaggtgaacatcaccggcgtgacctgcggccctggccacggcatcagcatcggaagcctagggcggtacaaggacgagaaggacgtcacggacatcaacgt

SEQ ID NO: 45813 - DNA, 370 bp, Zea mays
  unsure at all n locations
  Clone ID: LIB3066-033-Q1-K1-G9
cccacgcgtccgccccaaaccccgggccactgctccgctcctcctccttgccgccgtgcggttgagcgccgacgagcaagcccgacgccaccctatggctatggaggtccgccgcagggttccgccgccgcacgggagcgccccacggcgccagcaggcgaccggcggcgaggggcagcgggtgcgtgtgcaggcggnggacgcgctgccgctgccgatccggcacacgaacctcatcttctcggcgctgttcgccgcgtcgctggtgtacctgatgcggcggtggcgggagaagatccgctcctccacgccgctccacgtggtctccctcgccgagatcttcgccatctgcggcctcgtggcgtcgctc

SEQ ID NO: 45814 - DNA, 276 bp, Zea mays
  Clone ID: LIB3066-033-Q1-K1-H1
cggacgcgtggaccggtgccaggccttgccttattgcggtggtgcttagtccctcttggacacgtatcgacacaagccagcgcacgcgcggacatgaatgatggcggtgccatgaggccatcgactatgttctacgagcaataggcagacgtatgtacatatccaacagtgtgctcaggagtgctcgctctgtgccagatagctctgacgctacatcgtcatgtgctgatgtcacacgccgttatgaagagagtagtgcacggagcagccgatgag

SEQ ID NO: 45815 - DNA, 431 bp, Zea mays
  Clone ID: LIB3066-033-Q1-K1-H10
cccacgcgtccgcccacgcgtccgcggacgcgtggggttttgggatggcagaacaacagagagaatgtggatgacatatctgcaactttggctggtatttcaactgagatagacattagcatattctaccgtggcctagatcaaggaagcaaacacaccctggtgtcagtggtttgttactatggccagcattatcattgttttgccttcaaggatggacgatgggtcatgtatgatgaccagacagtcaaggtaacccaataaccatactactttgagcatcctttttactgttcgtactaatgtggcccaattttggttccatgttatttgtgcaggttgtaagtagttggggtgatgtgctcgtgatgtgtgaaaagggtcacttgcaaccccaagtgcttttctttgagtctgcaaattaatcattc

SEQ ID NO: 45816 - DNA, 399 bp, Zea mays
  Clone ID: LIB3066-033-Q1-K1-H12
cggacgcgtgggcggacgcgtgggatccttcccaactcgctggtgatggacttcgtgagcaacggggaggtgtacggggtcacgctgctcaactccaagttcttccacatgaacatgtaccggtgcaaggacatgctgatcaaggacgtgaccgtgacggtgcccggggacagccccaacacggatggcatccacatgggcgactcatccgggatcacgatcaccaacaccgtcattggcgtcggtgacgactgcatcttcatcggccccgggacctccaaggtgaacatcaccggcgtgacctgcggacctggccacggcatcagcatcggcagcctagggcggtacaaggacgagaaggacgtcacggacatcaacgtcaaggattgcactcttaag

SEQ ID NO: 45817 - DNA, 297 bp, Zea mays
  Clone ID: LIB3066-033-Q1-K1-H2
tctacacgtacggcggcgtgctcaagcggccgggcctgatacaggccgacgccggactgatcatcgacgctgactacaaggtcgacatcctcagcgcgatcaacgcgccgaccgaggtggcgctacatgtcttcgcgagctctgatggtcaagatgggcgccctcgaggtcaaaaccggatacgaggcgagatcaggaaacgctgcgccctcgacaacaggcactaagccgccgaatgcatgcgcgagatggctgcattgctcggaggaaatccttgtgagacacacaacatgctct

SEQ ID NO: 45818 - DNA, 447 bp, Zea mays
  unsure at all n locations
  Clone ID: LIB3066-033-Q1-K1-H3
aacgaaatccagcagaccgacgcgaaccgagaaaaatcccacgaaatctcgtggccgcggcgaccggaagaagaggacgacgacggacggagcggcgatggcgtgccgcgcacttgccctccgctccctgctcctccccgacccgctacaccgcctcccggccgcggcgccacctgtttggagagcgtcccgcggtggccgccgtccgcacctccgctgctgctccggcggcgggggcggggagcccgggcagccgccgcaagaagctgtgctcgaggccatatccaagatagcaaggtctaaaggaagggttgcactcacaacaaatatggtcatgggtggtactgtgactgacgatgcangtgatgaatggcttgttctggatcagaaggtaaattcctaccccacagatagaggatttacagcaattggcactggaggtgatga

SEQ ID NO: 45819 - DNA, 378 bp, Zea mays
  Clone ID: LIB3066-033-Q1-K1-H4
cccacgcgtccgatcacaggctaccccagtgatggggttgctgctccagcagatccctgaatgggagaaactagctaaaggcatttcacacatgcaattgtgatactgactgtgaaacttacgcaccttcactatatgtgttagcaccttctagacgaatctgtcctgagaatgaatccactaatcatggattaaagacaaggaccatctgcctgttttacgatcacggtggtcctaaatattgatatgccaccattctgttgtatgttgatgatgccttattaacttacctacgaagcttcgtttagacgattttgcacctgatctacatatgctgctgcgtttctggtactgatcgcattgttttcataactttgc

SEQ ID NO: 45820 - DNA, 435 bp, Zea mays
  Clone ID: LIB3066-033-Q1-K1-H5
gcgacagcaccatgaccttcgcgctccgctccgcgcgagagctcggcctacggtgcgctacactctggaccgccagcgcctgcggctccatcggctacttccactaccgccacctcttctagcgtggcatggtccacctcaagaacgaggagcagctcacggacgggtacctagacaccatcgtcgactggatcccgggcgcgcccaaggacctgcggatcgaggacttaccgagctacgtgcgcaccacggatccgaacgacgtcatgctcgacttcttcatacacgagacggtgggcatgtcgcaagcgtcggcagaggtcatcaacaccgtcgaccagctcgacgcgacgctgctcgctgccatggtgaatctcctgccgacgatctacaccgtgagcccgatccagctgacagtgcagaacaacgtgcagg

SEQ ID NO: 45821 - DNA, 375 bp, Zea mays
  Clone ID: LIB3066-033-Q1-K1-G11
ctcgtcgtcgactcactcaccccgccttcacgcctccctcaccaaataaggtcccgcccttttccgacattcacaggggggacaggaaatcagcggccatggcctcgatttcggcgacgaccttcggcgtcatcttatccgtcctgttctgtgccgcggctggcaccgtcgtcgacaacgaccttcccgactacgtcatctaagggcgcgtctactgcgacacctgccgcgccgggttcgtgaccaatgtcaccgagtacatcgcgggcgccaaggtgaggctggagtgcaagcacttcggcaccggcaagctcgagcgctacatcgacggggtgaccgacgcgaacggcacgtacacgatcgagctcaatgaca

SEQ ID NO: 45822 - DNA, 309 bp, Zea mays
  Clone ID: LIB3066-033-Q1-K1-H6
acgcctacacgtacgacgtcgcgctcaagctgccgttcctgatccaatccgacgtcgcactgatcagcgacgctaactacacggccgacatcctcagcgcgatcaacgcgccgaccgaggtggccttacaggtcttcctgagctccatggtcaatatgggcgccatcgaggtcaaaaccgactaccgaggcgataccaggaaacactgctccctcgacaacaggcactaagccgccgaattcatgcgcgacatggctccattgctcgcatacaatccttgtgagacacacaacatgctctgcatctgca

SEQ ID NO: 45823 - DNA, 436 bp, Zea mays
  unsure at all n locations
  Clone ID: LIB3066-033-Q1-K1-E6
cggacgcgtgggcggacgcgtgggctcgatctgacccctccctccaaatcctgtttgagtccctctccaaatcatgctagccgaaacgcccctcctcaaatctgagcatcaaatcgactcctcatcttcctgaaaccatccactcctccctaaatcctctcagatcaaatgccccttctcaaatatggagggctggaggacgagtgaatcgaaagaagaggccgagggggtgattgggatttttcttcttattttgccaaatacaaatcagctacttgctaaacgatatttgctctggataatctaaagtaacgacgagcaaatataagatcggtggatctcagaaaaaggaaataattgatgagaaggatcttccacaacaaacanaaaatcaaaagggtccaatctcaagggaaatgtanaaaacgatgaatga

SEQ ID NO: 45824 - DNA, 431 bp, Zea mays
  unsure at all n locations
  Clone ID: LIB3066-033-Q1-K1-E8
gtaagaagtcgtctaattcgattggatcgaattagacgccttcttcgtccctcgcttgattagcacgctaaccagcttgtaatctgcaggatctaagcaaagacttgattcagttatggacggattggtaggcctcttgaaagttcgtgtggtccggggtatcaaccttgcctaccgcgacgcaagaggcagcgatccgtatgtcgtcctacggcttggcaagaagaaactgaagacaagcgtgaagaagagatccgtgaaccccatatggcaagaggagctaactctgaccgtcacagatcccagccaaccactgaagctggaggtgttcgacaaggacaccttcagcagagacgaccccatgggagacgcggaagtggacgtggcgccactgatggangcggtgagcatgaacccgcgggaagagagtc

SEQ ID NO: 45825 - DNA, 404 bp, Zea mays
  Clone ID: LIB3066-033-Q1-K1-E9
gttcttcttccctcaatccattgcaagcaacaggaggagaaaaaacaaggagcgagacctcgcagctgacgcgcacaaggcaaaacccaatcggagccgtggaccgggccggagatagggctcgaggccatggcaagcggaggcgagggcgcagggagcggcgagtccccacccgctgcctcagtggaggcggcagcgggggaggcgacgctgcacatccggtgcgcgaacggctctaagttcacggtgcagacggacctgggcgccacggtgggcgggttcaaggaggtcgtagccgggagctgcgacgtgccggcgccgcagcagcgtctgatctacaaaggccgcatcctcaaggacgagcaaaccctagaaagctacggcgttgagacagatcacacaat

SEQ ID NO: 45826 - DNA, 386 bp, Zea mays
  Clone ID: LIB3066-033-Q1-K1-F1
ccacgcgtccgcgtcgccggagacacctcgggatccgtacatgaagtacgtctcgccggaggttgtcgagacacctccgtcgggggaaggggtggcgttgagggacaaggggaagaagaaagccgtgaagctcaggattaaggttgtgaatcatcacctcaagaggctgatcagtggagcactcgcaggcacagtgtcaagaactgctgttgcacctttggagacgatcagaacgcatttgatggttgggagtaatgggaattcgtcgacggaggtgttccagtctatcatgaagcatgagggatggactgggttgttccgtggtaactttgttaatgtcatccgggtagccccaagcaaggcaatcgagctttttgctttcgata

SEQ ID NO: 45827 - DNA, 385 bp, Zea mays
  Clone ID: LIB3066-033-Q1-K1-F10
cggacgcgtgggcggacgcgtgggtttggccgccccccacaaggccactcacccaaaaaatctccactcctcgaccgcaccgagcagaggatcacatggcatccgccgtttcgcttctcctctcgcccccgcgcctgctccaccgcgacggcacatcccgcctcctcagcatcccgcatcggcgggtcctcctcgccggccccaacaacgcgacccctcgtcggctcctggcccccgcgccgcgcgccttcaacaacaacgacaacagcggggccgtggaggcgcccgaccgcctcgtggccgcggtcgcctacctatacccgttcctcgacggcgcgcaccacgggcgcttacttctcacgcagttccccttcttcggcgcgct

SEQ ID NO: 45828 - DNA, 451 bp, Zea mays
  Clone ID: LIB3066-033-Q1-K1-F11
cgcagatccccacctgctccgccgccggccaccgcgttgctcccctcggcagccaggatgacagaagcaccatttctgccgcgtgagaggctcttcaagcagcaacattacttccagaacttgaccaagcacacctacctgaaagggcgcttcgacgtgatcacctccgtcgccatcccccttgcactcgctgcctccagcatgttcatgattgggcgtggagtttacaacatgtctcatggggttgggaagaaagagtgatcttccactggttaactattgtttctgcttggcatggaagtcataccgtcgagactgcgaagtcctcttcgcttgcaaaataatacggccaaataacaattcgactacattttcgcatcaaatttctgtttgtatttgtgggtgtgaagtggcagtaacttgaaaatcagcactgtcactgttttggtta

SEQ ID NO: 45829 - DNA, 441 bp, Zea mays
  Clone ID: LIB3066-033-Q1-K1-F12
accacgcgtccggcgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgacgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgaagactgtcat

SEQ ID NO: 45830 - DNA, 436 bp, Zea mays
  Clone ID: LIB3066-033-Q1-K1-F2
cgtaattaaaccatgatgatgaccgggcgaagggaacctctttaacccgaatagctgtcttccctctgcatatatacaaccgtgtttcaaacttttcctcttcaggctttttgaacccagaggcaaaaccaccctccaaaggtataatgcaaggcttgaagtatgacaagaatttgtcagattcgtaaccttggagttccctatgttgaattgcacgacccccaaggatggcatcaagttcaactgtcttgatggctgcagtcccagcttcatcttgactcgaatctttcccaatccagaagtggatatcgcatagataggcaccacctttagtacaggtcgtctgcagaactatgtatgaatctacacagtagaatttaccataatcagattttggcaatgcaactggcttaaaatcttcaatccgccatatttc

SEQ ID NO: 45831 - DNA, 404 bp, Zea mays
  unsure at all n locations
  Clone ID: LIB3066-033-Q1-K1-F3
cccacgcgtccgcggacgcgtggggtggcggagcacctagctggatgaaggattaccactcggcaccgcttgactcgtcctcttttaggagtgagagtgggggcacggctgctgcaaatccctgggcttctcaagagatagtcatggatggagcaagcgtcggagaaacctccttcagggacacgaaaagcgaggcaggcgtcgacgtcggcgggggcgactccccaccgtcccccgccacccgccggtcgagacggcaccgctctcggngctccggcaactcatccatggacgccaccggcggcgagggcgaggagaagactaaggagaagagcangaaaggcacccganaagaaccgcangaagcangacaagtcggccggcgacgacgccctcggcacatg

SEQ ID NO: 45832 - DNA, 451 bp, Zea mays
  unsure at all n locations
  Clone ID: LIB3066-033-Q1-K1-F4
cccacgcgtccgcccacgcgtccgcggacgcgtgggcctgtcccacctgccgcgggtgtacgagctggacggcttcgagtactgctacaggtggaccttcgccggcgacggcgtggacctgacgcacaacgtgacggtgcccaggttgacggtggagatggccggtggcgcgaggctagagccggaagccaagagcgtggtgatgccggaggtagtgcccggggtggcgtgcctggcctttaggaagctgccgcggggagggcctgggatcttgggcaacgtgctcatgcaggagtacatctgggagatcgaccacggaaaggggaagatgaggttcaggaaggacaagtgcaacacccatcatcttcacaacagcaaaggcggaaaggtctataataataataatggcaaattctnctctactgtggtgcatcgcgtcaattaattcgtt

SEQ ID NO: 45833 - DNA, 290 bp, Zea mays
  Clone ID: LIB3066-033-Q1-K1-F5
cgtacgcgtacgcgtgacgtgtcggaacacctacctggatgacggattaccggtcggggccgcttgactcgtcctcttttaagagtgagagtgggggcacggctgctgcaaatccctgggcttctcaagagatagtcatggatggagcaagcgtcagagaaacctccttcagggacacgaaaagccaggcaggcgtacacgtcagcggccgcgactccccaccgtaccccgtcacccgcctgtcgagactgcaccgttctcggggctccggcaactcatccatggacgcc

SEQ ID NO: 45834 - DNA, 350 bp, Zea mays
  Clone ID: LIB3066-033-Q1-K1-F7
cccacgcgtccgcggacgcgtggggtggcggatcacctagctggatgaaggattaccagtcgggaccgcttgactcgtcctcttttaggagtgagagtgggggcacggctgctgcaaatccctgggcttctcaagagatagtcatggatggagcaagcgtcggagaaacctccttcagggacacgaaaagcgaggcaggcgtcgacgtcggcgggggcgactccccaccgtcccccgccacccgccggtcgagacggcaccgctctcggggctccggcaactcatccatggacgccaccggcggcgagggcgaggagaagactaaggagaagagcaagaagggcaccccg

SEQ ID NO: 45835 - DNA, 218 bp, Zea mays
  Clone ID: LIB3066-033-Q1-K1-F8
cgacgaggctcggactcgaatttggggcggaacagcgcaaatctggtaggcacatgaggatgatgcggaagaggcgtaacgagagcatatgctgtgcttcaagaaagggcttgactcgacctgcgaatgtgattctggaggaagtggctgtggatgccgaggcaaatggggatgctgcaagagggatggaagacttcggtgctttagtgaaatgactc

SEQ ID NO: 45836 - DNA, 430 bp, Zea mays
  Clone ID: LIB3066-033-Q1-K1-F9
cccacgcgtccgggcgagggcgacggggcggcgccgacgcagtggagcatggacatgtacgcgttcatggagccgtacgtcagcaagaaccctaggcaggcgtacgccaactacagggacctcgaccttggcgtcaacgaggtggtcggcgacgtctccacctacgacagcggcagggtctggggcgagaagtactacaatggcaacttcgagaggctcgccaggaccaaggccaaggtggacccctgcgactacttcaggaacgagcagagcatcccgccattgctcaagtgatcgatgatacccggtcccatccagatcctttcgaccgcgccaagcaaaaggacgacgagtcgtacatgattctgctgattatattaattagatggatccttgcttgcatgcgttgaagccagtgctttgcatggcg

SEQ ID NO: 45837 - DNA, 350 bp, Zea mays
  Clone ID: LIB3066-033-Q1-K1-G1
cccgaacctcccagccgcgccgccctgatggcctacaccacctcgccgtcgacatcgacgtcgacggcagcggcggtggcctgggccttcgctgccgccacctgcgtgaaactcctcctcgtccccacctaccgttccaccgacttcgacgttcaccggtactggctcgccctcacgcacgcgctccccgtgcggcagtggtacaccgacacctgctctcagtggacgctcgattacccgcccttcttcgcttacttctcccgcctcctctccctccctgcgccgctcgtcgacgctaccctcatctcaatccccgtgcgtgacgcgacgcccttcgctcatctcatcta

SEQ ID NO: 45838 - DNA, 273 bp, Zea mays
  unsure at all n locations
  Clone ID: LIB3066-033-Q1-K1-E5
cctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctncatcggccccg

SEQ ID NO: 45839 - DNA, 275 bp, Zea mays
  Clone ID: LIB3066-033-Q1-K1-D1
ttcattctttctatttctattttttacttttattctatcttttccttctcttcggacagttttttttctttctttatcaacaacgttaaaccccacccttcaatataatgaccccttacaaaaactaccccatttcaatgactgcaaattcttttgcttatactactaaggtaaatccacggatatacctgaattctcaaacaatcctatcactttgaacatacataccttaactaccaacctataaaatcctaccacttcgacttcaacaacaa

SEQ ID NO: 45840 - DNA, 304 bp, Zea mays
  Clone ID: LIB3066-033-Q1-K1-D10
ccgacgcgtgcgcagacgcctcggtctatacctaacaaggcaacccggagacatcggcgagctctatgtcatgaatcagtctaaatagtgagctgctcactggccgacctactgaacaatacaatatgacgactgatacagaatgaacattggcgtgcttgcacacttagctacgatccagttcactcagcgtgctccctgaaccactagactctgattatgtgctatagactatgtacatcatactgacagtacgctagctgcatacagtgctgaccactgtatatgactacagcgcatattc

SEQ ID NO: 45841 - DNA, 401 bp, Zea mays
  unsure at all n locations
  Clone ID: LIB3066-033-Q1-K1-D11
gcgagcggccgctcgcgatctagaaccggacgcgtggggcagatgcagccaggcatgacgtctacgcacggggtttcattcgtttcacatgatgagacctggaatcctgtgaccgtgatggcgacgcgagacggctaggcgaggcgccctccaatccaagaacgggaaacccgtgtcgcctgttggtacgcgggcagaagatcgggttcgccatttccaagcttggtgcctcgccgcctgggtctctcgtctcgggctccgaagccgcccgcgctggtctattagggtaatttggttcagtctattcggatttatgaaatntcggggtctgaaaaatgagaaccgaaatttccaaaaatattttaggaaccgaaccccgataaactcacaattttggttcg

SEQ ID NO: 45842 - DNA, 446 bp, Zea mays
  Clone ID: LIB3066-033-Q1-K1-D12
cccacgcgtccggtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgaagactgtcatgtatc

SEQ ID NO: 45843 - DNA, 369 bp, Zea mays
  Clone ID: LIB3066-033-Q1-K1-D2
cccacgcgtccgggagagaccgccacccccacgcccgcacggcccactcagcgctctccacccccgtcccctcgcggcggcggcggagcccgagcctgagtcctgcccccccgggctaggttggtctccgcctccgccctccagtctctttggcacaacctgcagccgctggcgcaggtggacatggatctgccaagcctcgccgtcgtgctgcgcgccgcgctcagtcacgttcctgaggagcgcaaagctgcagaggagagtctcaaccagttccagttcacaccacagcatttggtgagattgttacagatcattgtcgatggaagttgtgatatggctgtaagacaggttgcaagcattcatttc

SEQ ID NO: 45844 - DNA, 440 bp, Zea mays
  unsure at all n locations
  Clone ID: LIB3066-033-Q1-K1-D3
cccacgcgtccgggcctggccacaattgcaagcgccgtccgttgccccctggggtgtcggatacggtccccagggcaccggatccagcggcccaggctggcaccgctgccgccgtcatggatgtggaggaagaagcaagatgaaggagctctcccgctatctccttgcctaagccctaagcatgggcattggccgtcgctgctgccgcccaagcagacgaccccgctgagccccacgcagatgacgcgagagcacgacccgtcgcccccctaccgcctgcaccacataaacacgaggaagagccccgtcgtcatcccggctagctgcatggccatgccgacggcctncaacagcagcatgccagcatggtgggagcaaactcagggctcaaggccgtgtatttatgctacgcataaaaaggtttgctatgtttcattttg

SEQ ID NO: 45845 - DNA, 268 bp, Zea mays
  Clone ID: LIB3066-033-Q1-K1-D4
cccacgcgttcgaacacgcgtacgaccacgcgtacgtcgcaaaatggtcacttcatgttgagtttagtggatttggatagcaatgctggaacaagtctgcttctgatccactatgccagagggaggtctacccagactatggtcaatgagaaaatggtatcatgtcaagcagcacgtgttctgctggccaagggatcaatgggcttgttactggtaaggattaatgaataggtgccaattactattatatacttgaattgctgttatt

SEQ ID NO: 45846 - DNA, 438 bp, Zea mays
  Clone ID: LIB3066-033-Q1-K1-D5
cccacgcgtccgagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatcctgtcacggtgttcatcacagacatgaactacgagcctatcgctccctaccacttcgacttgagcggcaaggccttcggctccctggcaaagcccgggctcaacgacaagcttcgccactgcggcatcatggacgtcgagttcagaagggtgcggtgcaagtaccccgctgggcagaagatcgtgttccacatcgagaagggctgcaaccgcaactacctggccgtgctg

SEQ ID NO: 45847 - DNA, 327 bp, Zea mays
  Clone ID: LIB3066-033-Q1-K1-D6
ggaatacgaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtg

SEQ ID NO: 45848 - DNA, 212 bp, Zea mays
  unsure at all n locations
  Clone ID: LIB3066-033-Q1-K1-D7
ggcaagaaccggaagcgtggaaagaacgaggctgacgacgacaagcgcgagctcgtcttcaaggaagacgggcaggagtatgcgcaggtgacccggatgctcggcaacgggcggtgcgaggccacctgcgtggacggcacgcgccgtctctgccatatccggggcaagatgcacaagaaggtgtggatcgcggcctntgacatcgtactcgt

SEQ ID NO: 45849 - DNA, 127 bp, Zea mays
  Clone ID: LIB3066-033-Q1-K1-D8
aaaaaaaaacaaacaaacaaaaaaaaattaaaaaaaaaaaaaaaaaaaaaaaacggaaaggaaaaacaatgaaatagtgatcaccaatacttactagtcatgaatccctgtgacaatagtacatcat

SEQ ID NO: 45850 - DNA, 404 bp, Zea mays
  Clone ID: LIB3066-033-Q1-K1-D9
cccacgcgtccgcccacgcgtgcgcccacgcgtccgagcttaattgcgccactgctcgtggtccgtgctcttgcattgcattgcaagtcgtagttgagcagcagcaaccactgcacaggatgtcgtggcagacgtacgtcgatgagcacctcatgtgcgagatcgagggccaccacctgagctctgccgccatagtcgggcacgacggcgccgtttgggcccagagcaccgcattcccacagttcaagccagatgagatgaccaacatcattaaggacttcgacgagcctgagtttctggccccgatcggcctcttccttggacgcaccaagtacatggtcatccaaggcgagcccggcgctgtcatccgcgggaagaaaggatctggaggcataactgtgaag

SEQ ID NO: 45851 - DNA, 424 bp, Zea mays
  unsure at all n locations
  Clone ID: LIB3066-033-Q1-K1-E10
cccacgcgtccgcacagagacaccaagcgttgaactcgcctaagcagctatcaaccaaggctagaaagctagacaccgtacccatggctcgcgctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacgatgatgactccaccaattgaggccacacacgtcggcccggttaaatttggaacaagacatggaagaaaaatgagagcaatgtctctaaaaccatgataatgtgtggtcatccactcatncatggatacatnctngctctccctctttttctttc

SEQ ID NO: 45852 - DNA, 425 bp, Zea mays
  Clone ID: LIB3066-033-Q1-K1-E11
cggacgcgtggccccgactccgggtccttcgctgcgtcacctactagccagagcgccgggtcagagaaggcccccgccggtgcccccaacgactcgtcggccagcccttccgcgtccccgtccgaagatgaagccactgcatcgcacgatagcagcagcggccgtggcagtgccgactcggaagagccgtcgacggccgaggccggccgcgaatccgccgatagtccacccgagccagcccatgcttcggagtcaccagcagagtctcctggcccggccgctgaccacgagagcggcagcccgagcatgggcaccggtgtcgtactggccatgctggccgacgatgtcaccgagacgcttcctttctagatgaccatggtggctttgcgctaacatcatagtcaccgagcagcaattcttctggg

SEQ ID NO: 45853 - DNA, 414 bp, Zea mays
  Clone ID: LIB3066-033-Q1-K1-E12
cttcgacatcgagatcgacggcaagcctgcaggccggatcgtgctgggactgtttggggacaccgttcctaaaactgcagagaacttccgagcactttgcacaggggagaaaggaattgccaagtccggcaagcctctgtggtacaaggggtcgacgttccacaggatcatcccggggttcatgatccagggaggcgacttcaccaacggcaacggcacggggggcgagtccatctacggcagcaccatcttctccgacgagaacttcaagcacacccacgctaaagccggtacgctgtccatggctaactacgggcccgactccaatggctcccagttcttcatcaccaccgtagacgaaaaccggttgcccaagaagctggacgggcgccacgtggtgttcggcaaggtggt

SEQ ID NO: 45854 - DNA, 255 bp, Zea mays
  Clone ID: LIB3066-033-Q1-K1-E2
cccacgcgtccgcccacgcgtccgcgacgcccatcaacttcatgaagctggcccaggcgagttaatggtttctgtatggctgtccacgaatacttactagccacgaatacctgtgaaaacagcaaaacaaaaaatgggcaccgttggccattatacatggaaacttgttaatttcttaggaatgtcacgtggctcgatcgaggccaagccatgtacgtacaagttgttcaattatttatgcatgctgctgcatgt

SEQ ID NO: 45855 - DNA, 360 bp, Zea mays
  Clone ID: LIB3066-033-Q1-K1-C9
agcaggagctacaattatttccaataaatgaagctactcttaagccatttgagaagggtgatttagtagacagccctattgccagactacctgacatagagaccacaacacttggagccacatatgttgctagcttagatgcaggagtttggaccaaggaacaagtatttgcaggttagcacaaggagaacgcgacaatctttcgcccaaaactagatgaggtgcacaagaagagggctgattcatggtacaagacggtttcaagatcattcgatttggctgacctttctctgtaaatgtgtcttgtcggcattgatctatctgtttttggaagatgcaaatgaataaattggtctttgc

SEQ ID NO: 45856 - DNA, 407 bp, Zea mays
  Clone ID: LIB3066-033-Q1-K1-E3
cccacgcgtccgcccacgcgtccgccccgtttccctctccaactccaatccatggcctgcacggatcgctccacgccggcggaggacgagcaacagcagaagcgcccgtctctcttctcgccgtaccagatgccccgcttccgcctcacccaccgggtggtgctggcgccgatgaccaggtgcagggcgcccgacgcgatcccaggccccgcgctcgcggagtactacgcgcagcggtccacggagggcggcttgctcatctccgagggcaccatcatctcgccgtccggccctgggttccctcgtgtccctgggatatacaatcaagaacagactgatgcatggagaaaggtggttgatgctgttcatgccaagggagctatctttttctgccaactatggcatgt

SEQ ID NO: 45857 - DNA, 259 bp, Zea mays
  unsure at all n locations
  Clone ID: LIB3066-033-Q1-K1-E4
aaaaagtatgcctagctgcgactagagaaatacacagtatactgtctnttgtgagaggggtcggtcaatattgtaaacagggtatacgaatcgccgctgcttaaaactcatcatttaatcaactactcatcgtcctgaaaccatccactcctccctaaatcctctcagatcaaatgcctacttcttaaatatgaagcggctcgaggactagtcgaatctaaagaagacgccaaggagctgattacaatctttattatta

SEQ ID NO: 45858 - DNA, 446 bp, Zea mays
  Clone ID: LIB3066-006-Q1-K1-G6
gttgagtataagaacattagcttcactgtttgggatgttggtggccaggacaagatcaggcccctgtggaggcactactttcagaacacacagggacttatttttgttgtagacagcaacgacaggtaacgtgttgttgaggctagagatgagctccacaggatgctgaatgaggatgagctgcgtgacgctgtgctgcttgtatttgcaaacaaacaagatcttcccaatgctatgaatgctgctgaaattactgacaagcttggtctgcattccctgcgacagcggcactggtacatccagagcacttgtgctacatctggtgaagggttgtatgaggggcttgactggctttccagcaacatcttcagcaagtcttgaagcttttcgggagggcttctaacgagaggatgtctgaacaacttatggctgctttttttttacat

SEQ ID NO: 45859 - DNA, 330 bp, Zea mays
  Clone ID: LIB3066-006-Q1-K1-G7
ttttccacagaggaagtagggattgatttaatcattgatttaatcccacacgcgtgtatctacgtatacagtttgtataacatgaaccacctctgtttgcgattggtctaaaaataaatataatacttatataaaaaaaaaaaaaaatttgaccaaactgtactgtgatgtgtaacaatgccacaacacagtacttgaaggcaaacgtatgtagattaattagcagaacgacaacctgtgatccatccttgctttcttccatgaaatgaaacgcagccagcgcgacctggcatggccaggcccccttatggccaagatcaagatcgggat

SEQ ID NO: 45860 - DNA, 430 bp, Zea mays
  Clone ID: LIB3066-006-Q1-K1-G8
ccccggccaaggatgttcttgctgttcaattgggacttgatgtattcaatatctactgatcctgcaattcaatatcctcaagctcataccatgttctggatctttgtaaaacaaataagggttcctggtctggctctgaatcctcagcttccaaaagatcactgccattcctagcacaggattttgaatcagatattgacacaagacttctgaagcttgtaaataagattgcttctggatcttgtggggacatgtttcttgggacctacagtggtgaggaggttgctgttaaagttcttaatcctcagaatttgaacaaaaatgtatggagtgaatttaagcaagaaatcaacatgttaagggaagttgatcatccgaatattgtccgattcattggttcatgcacaaaggcacctcagttttacataat

SEQ ID NO: 45861 - DNA, 438 bp, Zea mays
  Clone ID: LIB3066-006-Q1-K1-G9
agcacagagctagctagccagccagccagcagccagcttgctcgccgcgcccgtccttctgcctcgcctccgttccgttccgttccgtcccgcccgccgtcgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctgcttcttcgcctactacattcagtgagccggccgcggccggtcgcccggaggccgaggaagagacgaagcgggagagagagtgacatggctgcgcgcattccgatgcgtgggcatgtttttgattcgacacaccttttgtcctctttttctttggtccctctttctcctt

SEQ ID NO: 45862 - DNA, 349 bp, Zea mays
  Clone ID: LIB3066-006-Q1-K1-H1
acaggatggacctcctggagacgtccgccgctgtccgcaagagcttctcagatcggcactgcacggcgcggatcgagaacctgaccctcagctgcctggattctcccgggagacccaacgtcgatacccgggaataccgggtgtttgtaggcacatggaatgtgggagggaagcctcctgacagcagcgttaacctcgaagagtttctgcagattgaaggattgcccgatatatacgtcttggggtttcaggagatcgtgcctctgaacgcgggcaacgtgctggtcgtggaggacaacgagccggcgggcaagtggatggagctcatctaccaggccctgaacaggcc

SEQ ID NO: 45863 - DNA, 414 bp, Zea mays
  Clone ID: LIB3066-006-Q1-K1-H10
ctcatgctgggaacggtcggcttccgcgcgtcgctcttcttcgtgcgccacatgtaccgctccatcaagtgcgagtaagcgccggacgtgcgcacgcggtctggcatgctcatggctgttgtttgggtggcttgggatccaattgcagaaaccgtcaccagttgggttgtgcatgaatttatatgctgaagcgccagcagttgccctcagtatggacctcttcgcctttagcctttatatatatacgttggagctcccggagaggaggatctatgtagtgtaggactgtcgccagaggcagtgtctgtattattatctagtacacttgtagtggagccagtgtcaaccttcaattgtgttgctgaaacctgtgtgttgctcagtagtgcataccatgcacagtttcttttggtt

SEQ ID NO: 45864 - DNA, 428 bp, Zea mays
  Clone ID: LIB3066-006-Q1-K1-H11
cattctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgacaacgccgcgcgaactgctgctagcgtcgatgcgcgtcgcggcggagaaggccagggaggccaagagccgggtggacgagttcgcggcgaggaaccacgagggccggccgatggagtcca

SEQ ID NO: 45865 - DNA, 210 bp, Zea mays
  Clone ID: LIB3066-006-Q1-K1-H12
catacgctgtcaactgtctggttcttcgcgtcgtgtcttcttgtgcgccatatgggccggtctatactgttcgaggtaaccatcgacatgcccacccagacaaacatgctcatggctcaccattgggagctttaggatcatatttgcgaaaccgctgctacttgtcgtcctcatgaatctatattctgaagccaccgccgatgccctcat

SEQ ID NO: 45866 - DNA, 347 bp, Zea mays
  Clone ID: LIB3066-006-Q1-K1-H3
tcgcgtccatccgagctaagtaattaggtcgaaaatgacccgtgccagcagcagtagcagggggcggcgtgtgacgctggtactgctcggtctccgcctgctgcttctggttggtgttgcgcatgcggtagtggagttggtgcctgctgatgataatatcgccgtcgccgctgctggcacggcggtggacgatggcgagccgactcagcagtgcgcgaccccggtgagcgtggatgaagcgtgccgcggcgcgttcgatactcacgccggcgtggcctacgaccactgcatggcgtcgctgggcgccgactccgcgcagtaaggatggcgggtacaagaacatgcac

SEQ ID NO: 45867 - DNA, 364 bp, Zea mays
  Clone ID: LIB3066-006-Q1-K1-H5
cccacgcgtccgcccacgcgtccggccatggacaaggtgcccacggaccctaataaggggacgacgacgatataccccaatgcatggcaagaagatatatatatcagcacaacgcatgctgcatgcgatgctgcttgttgctgcaattgatccactatactatactataggagtattattaattccagttgcagcatgcatgatgatatatatatgtgtctctatatgcatgcgttggtctatacaattcagatatgcatggtgtatacaagtggtagctagtacgcacgtacacatccaggcattaattagtacgtcttcgcttgcatttgggctgccagcttattaattaaagcacatactc

SEQ ID NO: 45868 - DNA, 406 bp, Zea mays
  Clone ID: LIB3066-006-Q1-K1-H6
cccacgcgtccgccagccccagctatgcccgccgagccctcacccacggatccgaggagctcctacccctctgtcccattcgtcgctcccggccgcaccagctgtcgatgatgacgagagcccaaggatgactggcacggaatcccccgcaccatcccccatgagcggatcgatattattcgcagaggtggaccgcttcgcgggaggtgcgggctcccctccatcgtcgtcctcgtcggcccaatcgccgatcgggtcgaccccggtttctcaaactattttattacaaggacaacctacccagcgggagcaaggttctatcatgcctatggatattgctactgtgagaaacacaaatgcgaatgtggcagtgccatcatgggacgatactcttgctcaatctctt

SEQ ID NO: 45869 - DNA, 402 bp, Zea mays
  Clone ID: LIB3066-006-Q1-K1-H8
cggacgcgtgggcggacgcgtgggcggacgcgtgggcggatgcaccgcggaattatcgtcttcaactgatcgagaattacaggaccatatcagacagtgggaagggtcctatgggcagggtgtactccgtaggatgccggatggtggcgagaagatgcattcacgtgtcctccggatgaagaaggagctcgagcggcggagggccagacagaggatggatgtcacgcccttgagacagacagtgcaagctaagcgtactggtggcagcagtggagaaatctacaacttaaagtctgatgatgagaccatggacagtacggctagcaaacactatccaaactcaagttgtactacatctacaaagacctatacccaggttaaaggagctgcatatgaagaaca

SEQ ID NO: 45870 - DNA, 376 bp, Zea mays
  Clone ID: LIB3066-006-Q1-K1-H9
cggacgcgtgggcggacgcgtggggtgcggtctaggccaggcacgcgggcgcggcggcgaggcgggctcaaccgcgacagcccgaccacagcagtgcgggggcgcggcccctggtaagcgagcgggcgcgacccccggtccgggcgcgacagctcggcggctcacgggcgcgcggcccagctcggcgtctcggacgcggtcgaccgaccctgctagcgtagacaccggcgcgcggccttcggccagagtgcaggcacgtggcccctgcagcacggacccagcggctcgtgatctctggcgacctatcgagttagcgtggcccgacgcgagtacatcggcttctgcgcgcggacgcgaacacaccgacccgtcgagc

SEQ ID NO: 45871 - DNA, 152 bp, Zea mays
  Clone ID: LIB3066-007-Q1-K1-A1
caaaaaaaacacatgaaaatgattactaccgattaccacgaccccgaataatcgcaccaattgtgcggcgtactaaagggggtgcaccggtacttcggatccagacgcgccgatggacgtgcgctagcggatcgcttacctattcgcgatcc

SEQ ID NO: 45872 - DNA, 376 bp, Zea mays
  unsure at all n locations
  Clone ID: LIB3066-007-Q1-K1-A10
cttcgcggaggccatgtcggcgcgcgtcgtcagctcctgcctaggcctgtacgcgccgatgccgccgggctcccccgccgcggcgcgcctccacggccgcgtggccgccgcgttccaggtgttcaacggcatcagccccttcgtcaagttctcgcacttcaccgccaactaggccatccaggaggcgttcgagcgggaggagcgtgtgtgcatcatcgacctcgacatcatgcaggggctgcagtggccgggcctcttccacatccttgtctcccgccccggcggcccgcccagggtcaggctcaccggcctgggggcgtccatggacgcgctcgaggcgacggggaagcgcctttccgacttcgncgacacgctc

SEQ ID NO: 45873 - DNA, 364 bp, Zea mays
  Clone ID: LIB3066-007-Q1-K1-A11
gacggcacgcgtccgagccaatcgactgcgtacctcatttttcttcgatcatgtagcttttgctcagagcagtgtcagggcgcataagacctgcttctgtcgattttttctctgatcatttgccgctcaaaccattcatcaagcttttactcgtcagatagattgttcaagtcaccggagcacggcatggacttcagccctcaaagaaagagcggcgaacgcgatcccgtcagcttcgtcgaacacgatgacagtgatgacgacttcggagctgaatccaccgcctctaataagccgtctgcgcattcgcacgacaggaccaaatccaagcccaagacgagccatggcagttcaacccacgcga

SEQ ID NO: 45874 - DNA, 293 bp, Zea mays
  Clone ID: LIB3066-006-Q1-K1-G5
aaaaaacataaaatcaaaaaaaaacaattaaaaaaaaaaaaaacataaaaaaaaaaagaggaaaaaataaaaaaaaaaaaaagaaaaaaaaaaaaaaaaaaaagggccagccgtttttaagctcccaagtttaattccgcttctttccaattccttaatgtttttatcgtgatctctaaattcaataccttgaccttcttttaacactattcagtctggaaaatcctttgcttgctcgatctaattcgttttgtgtccgatctctttttctccagctggttcaatcttaaaaa

SEQ ID NO: 45875 - DNA, 386 bp, Zea mays
  Clone ID: LIB3066-007-Q1-K1-A12
cccacgcgtccgcgtccccgtcccccgcgtctaccatgctcctcgcccctccgaacgtggtcctctccatctagcgccacaaccaatgcacgcctccgggctcacgccgcgccaagcccgtggggaggcggatctcgcccacaggccgcagatctccttccaaactaggaggcaacagcctggcaaggggcgaccttgcatggtaggcggcccctttccacaaaggacacaatttcacccccttccatatttggcggtcatggcatgcactacgcccccttcctcgccctcattccaaattcagccctcaactgtgcatgcacccacctcaatcgactgctattgtctgaatcgacagtgctattggtctggttggttgggacttg

SEQ ID NO: 45876 - DNA, 372 bp, Zea mays
  Clone ID: LIB3066-006-Q1-K1-F1
accgtcgtttctcggtatatattggtgtctatcttctgtgccatggttaaccgacaactgcataaggaaggcatgatgtgcacatagtgttttttgctgtgcatgtatgtgcctgtcaccggagtccggtgggcagcagccattgcaattgtttcttgtgtagaggaaagctacatattatgaagtgattgtgagaactcaattaaagatgtgaacttaacataaaaagtgcttcttgtgggtttggctatgaccttgtaggtctatgagaattcggtgtttggattggtgtttatttgtggctattcttgtgtcttgacatgaattcagttacgacgagtattttatggctatgctaatgtaatattcttg

SEQ ID NO: 45877 - DNA, 439 bp, Zea mays
  Clone ID: LIB3066-006-Q1-K1-F10
catcatcgtcgagatcatcgtcatgttcccgatccagcaccgcaggtaccgcagcgggatcgagaacctgctggtgctcctgatcggcggcatcccgatcgccatgcccaccgtgctctcggtcaccatggccatcggctcgcacaagctgtcgcagcagggcgccatcaccaagaggatgaccgccatcgaggagatggccgggatggacgtgctctgcagcgacaagaccggcacgctcaccctcaacaagctcagcgtcgacaagaacctcgtcgaggtgttctgcaagggcgtcgacaaggaccacgtgctgctgctggccgcgagggcgtcgaggaccgagaaccaggacgccatcgacgccgccatggttggcatgcttgctgaccctaaggaggccagggctggtatcagggagatccacttcttgcccttc

SEQ ID NO: 45878 - DNA, 352 bp, Zea mays
  Clone ID: LIB3066-006-Q1-K1-F12
cccacgcgtccgcggacgcgtggggttctagatcgcgagcggccgcccgcgatgtggaacgtgctaatagaacgcgagtgaccatcagccggactacgatcctagcgctcatggatacactaactgccacggacgtcgattgccacaactcatctcacgatcgactatgtagatcaatacttgtccaaacgcacgccagattcccgacacacgaacatctgtagcacgctcattgatcacctaatctccaatgcctcgcgctttcacaccaacgtgcatgcacacgcctataggcgatgatccctcctgccggacgaggcatcagctaccggtattaccaaagcgcaagctc

SEQ ID NO: 45879 - DNA, 366 bp, Zea mays
  Clone ID: LIB3066-006-Q1-K1-F2
gttcggagcgcacacacacacaaccagatctcccccaaatccacccgtcggcacctccggttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcacccttgaggtggagtcctctgacaccattgac

SEQ ID NO: 45880 - DNA, 230 bp, Zea mays
  Clone ID: LIB3066-006-Q1-K1-F3
gccaccgtcgcgaccgtatcggaccggggatcacttatcagcatactcggcttgaggcacccatacgtaccctagatgttatctcattaccttgtaacccctgaatcacttgggtagtcgctatgctttacatggttttgggaaatcatttatcacctctatgttccattcttgtatttattctgttgagttcatgttgttatcataatgttaattggaacatatagctt

SEQ ID NO: 45881 - DNA, 77 bp, Zea mays
  Clone ID: LIB3066-006-Q1-K1-F4
aagaactatgtgttcgtacatgttactgaccttatcattatttgtacatctaaatttggatttagaatgctgatgat

SEQ ID NO: 45882 - DNA, 370 bp, Zea mays
  Clone ID: LIB3066-006-Q1-K1-F5
caatacggcaaagaggagtcgacaccgtccgccccatgtactcggtgtcggtgtggggctgtgggcgcggcgctgcgtgtgggcgctcctctgttcggcaggaatcctcgttgcctcctcactactccaatctccatcgccattgtcggcgcaagcaaaggggcggagcagcatggcggggcgctatgacggcaaccccttcgaggaggaagacgtgaaccctttctcgcaacaaacgcgcggcaaggctggcgggcaatccaactttggcggtggcgcgttttatatgcctaacccccaaaacgtgcctccgacatccaattcacgcctttcgccgctccctactgaaccggcagactttagtgctaca

SEQ ID NO: 45883 - DNA, 400 bp, Zea mays
  Clone ID: LIB3066-006-Q1-K1-F6
cggacgcgtgggccgtcgcccgccggggagccgtcgtgggggagaggtaccgccacgggggcgccgccgaggagctgccggagagcgtcgactggagggagaagggcgccgtcgcgcccgtcaagaaccaggggcaatgcggaagttgctgggctttctctgcagtaagctcagtggaaagcgttaaccagatcgtcaccggtgagatggtgacactgtctgaacaggagctcgtagagtgctcgactgacggagggaacagcggctgcaacggcgggctcatggacgccgctttcgatttcatcataaagaacgggggcatcgataccgaagatgactacccttacagagccgtggacgggaagtgcgacatgaacaggaaaaatgcccaggttgtgag

SEQ ID NO: 45884 - DNA, 430 bp, Zea mays
  Clone ID: LIB3066-006-Q1-K1-F9
aaaaaaaacaaatttagcgtcggctgggcagacggtggcggcgcgcggggggagcgagctggcacgcgcccttctccctgccttcatctgctccatctgttcaagaacacgccagagaattcaagtgtcgcattgcacttgcactccgtcgagccccgatccatgcctgcgcctgcccctgccatcgccgtcgtcgtgccgccgccgccgtcgccatcgcttactggctgcgacggctgctactgactgatcgctctggatgtagctataggtacctctcgattggcatgctgttctgataacttctaacgagcctcgaacacaaaacaaagccgctctgccaccggctgccactggcgctggaagcaacgacctctcgttagccaggatggcaatcgcggtcggccatttccatggacctaagcccccc

SEQ ID NO: 45885 - DNA, 361 bp, Zea mays
  Clone ID: LIB3066-006-Q1-K1-G1
cccacgcgtccgaactccagcttgcgttggggaagggcgcgtccctgagagacgaagggagagagcctaggactgactcactgacccgaacccgttcccggcgggacttcctctcgaatcgtcccagtcgagaccctagttgccccacgaaccgaggatccaagatgagtttcctgttcgggaagaggaagacgcccgccgagctgttaagagaaaacaagagaatgctagatcgatccatcagggaaattgagcgagagagacaaggattgcaggcccaggagaaaaagctcatcactgagatcaagaaaacagcttaagaaggccagatgggagctgtcaaagtaatggccaaagatct

SEQ ID NO: 45886 - DNA, 432 bp, Zea mays
  Clone ID: LIB3066-006-Q1-K1-G10
cccacgcgtccgcggacgcgtggtcggacgcgtgggcggggcggcaatggccgggggtgagcttgaggtgctcaccgcgctggacaccgcgaagacgcaatggtaccacttcaccgccatcgtggtcgccggcatggggttcttcaccgacgcctacgacctgttctgcatctccctcgtgactaagctgctcggccgcatctactacaccgtggaggggtccgcgacgcccggcaccctcccgccgcacgtgtccgcgtccgtcaacggcgtggccttagtgggcacgctgtcagggcagctcttcttcggctggctgggcgacaagctcgggcgcaagaaggtctatggcatgacgctcatgctcatggtcctctgctccgtcgcgtcagggctctcgttcggccacaccccggcgttcgtcatggcgac

SEQ ID NO: 45887 - DNA, 424 bp, Zea mays
  Clone ID: LIB3066-006-Q1-K1-G11
gcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaagagaagccagcggcagcagcccatgcagaggaaaaggtcgccaccgtcgacgagaccacgacgacggtggaggcgaaaaagaacgccgaggaag

SEQ ID NO: 45888 - DNA, 383 bp, Zea mays
  Clone ID: LIB3066-006-Q1-K1-G2
gtgctctccaggaggaacagccacgcgtctatcaaggcacccagagacagctccggtgcggccacaccgatgtcgcatagtgcttcatcaagtggcatcaagtggtgcgagaacaatgtgatatggagctcactctcctcaagcttggtgcgtcatggaaaggaagcaatgaagcagagagacatggagctgcaagctgtgcttgatggactgctagaagcatctgcctctgagaagttgataaaatgcctgagcaaatactccgaactacattctgacaaggacgacgacccaaaggaggtcatcagcaggttcttgaaattctctcaagaactggatcatgccatcttcattgctcagtcacaggccagactcaagcaccc

SEQ ID NO: 45889 - DNA, 345 bp, Zea mays
  Clone ID: LIB3066-006-Q1-K1-G3
ccaagacgtggaagcccaagaagacgaggcagatcaagggaccagcgcaggtgtcacgagatgactccttcaagaagaaggccagccgcatggagcagagggacaagctgggcctgagcccgcgagggaagcgcgaccctcgccactacgctgaggccaccgacgccatggacaaagtccagatcgagaagaagaagcaggacgacgccctcgacgacctcagcggcgtgctgggccagctcaagggcatggccgtcgacatgggctccgagcttgacaggcaaaacgaagcgctggatcatctgcaaggcgacgtggaagagctcaacttcagggtgaaaggag

SEQ ID NO: 45890 - DNA, 290 bp, Zea mays
  Clone ID: LIB3066-006-Q1-K1-G4
cccacgcgtccgaccacacgtagacgagttacatcaacggacgcgtgcacgtactccgagaggactccatgatgaacaaggccatccgcatggacgcacatgacaagctagacctgagccccatagggaagcgcgaccctcgccactactctgaagtcaccaacaccatggacaaagtccagatctgataacaatattctggacgactccctttacaacactcagtgttatgctgggccagcttaatgtcttggtcattgacatggtctacgagctttacatgcaacact

SEQ ID NO: 45891 - DNA, 359 bp, Zea mays
  Clone ID: LIB3066-006-Q1-K1-D3
gctgctttacgaacatcatttaagactgttgttgctgtttggcataagctcagccacgcgaatgttacaaagtttgttggtgcatctatggggaccacagaccttaagattccatcaaacaattccaatggtgctgcacgtacaaatttgccagcaagagcatgttgtgttgtggtagagtatcttgctggaggaactttgaagcaatatttgataaagaatagccgacggaagcttgcttataaagttgtggtccagcttgcattggatttggccagaggattgagctatctgcactccagaaagattgtacatcgggatgtgaaaagcgaaaacatgctgcttactccacagagaaa

SEQ ID NO: 45892 - DNA, 442 bp, Zea mays
  Clone ID: LIB3066-006-Q1-K1-D4
cccacgcgtccgaaatacttcagaatctctgtggaggtccaaacattgtgaaattgcgtgatattgtcagggatcagcattcaaagactcccagtttgatatttgaattcgtcaacaacacagacttcaaagttttgtaccccacattgacggattatgacatccgctactacatatatgagctactcaaggcccttgattactgtcattctcaaggcatcatgcatcgagatgtcaagccccataatgtaatgatagatcatgagcttcgaaaacttcggttgatagactggggcttagctgagttctaccatccaggcaaggaatacaatgtccgtgttgcatcgaggtatttcaagggacctgaactccttgttgatttacaagactatgattattctttagacatgtggaagcttggttgcatgtttgctggaatgat

SEQ ID NO: 45893 - DNA, 383 bp, Zea mays
  Clone ID: LIB3066-006-Q1-K1-D5
cggacgcgtgggccagagagagccgggtagaacttggctgtctgccctgtctgcaagggcctcgtcttcttcctggagagaaaaagcagaagacaatacaaagatgtccaagatggcggaggagaaggcggcggcagtgggcggactcggaggagccggggcggcggacgcggcgcagcagcagcagctggcagcaggggaggccgcggcggcgcgggtgcggcccgtggagacgctgcttcgcgcggcaccgctggggctctgcgtggccgccatgaccgtcatgctccgtaaccagcagagcaacgagtacggcgccgtcgcctacttcgacctgggaggcttcaagtaccttgtctacgccaacgggctctgcgctggct

SEQ ID NO: 45894 - DNA, 438 bp, Zea mays
  Clone ID: LIB3066-006-Q1-K1-D6
cccacgcgtccggctgctgctcgtggtggtggctgtgcaggtgcggagatcgtcgatcgatcgctgcggttcgtcggcggcggtgtcgagatgtcgatggacttcggtgccccggcggatgaccccaaggctttccgcaacatctgccgcgaccgtacgtctgcaccacgcgcgcgactttgattgatctccgctcttcctcacgtcgtctgctttacgaattgacgacccgactgctcggttccgctgttgctcgtttgtgctctcctcagggatactgaaggacctgcttaagcctgacaaggataaggagaccaaaagctcatggaaggtacataggcgtaatatttttgtcgtccgtgcgcatgcagcttgatctatgcacattctggtggtactgcttcatgtgctcagattcctactatctttcattttttg

SEQ ID NO: 45895 - DNA, 369 bp, Zea mays
  Clone ID: LIB3066-006-Q1-K1-D7
cccgtctttggtcccggagggaaaaggacaaatcactcacacagagggaagaaaagggcgcaggaatcgcgacagcgtgggaggcgtacggcgcaccgcccggccgccggatctgcgccggcgacgcgcccggacgtcggatctacgccgccgcaggaggagggaggcggcgctctggccgttccttgcccgcgagcgcccagatccgtcccgccgccggatatatatatcaatcaatgcccctgtgatatcgatgttcagttgatgcagtggtgaaaacatcttctccaaaaactgctggctgcaagttgcaaaaatttgtctttcccttgttgtgttgttgcttccttctctggtggagtacacggg

SEQ ID NO: 45896 - DNA, 374 bp, Zea mays
  Clone ID: LIB3066-006-Q1-K1-D8
caaaccacctcggccggtcggcccacgggccacgactcaaaaaaggatcaaggtgggggaaacaaaacacaaggcggcgtccgcagcttccccactccacgttccgtgtttccgactccggtgactccaccaccagcaacccgtgcagcgagcgcactccgaccatcgccatgtcgaggcgcggcgactgggtctacgagaacaacggcgggacctgcgtggccatcgccggcgctgattactgtgtcgtctctgcggacacccgcctctctgtaggatacagtatcctcacgcgtgatcactccaagatctgcgacctggctgacaaatgtgtactggcatcttctggctttcaaggtgatattaaggctctg

SEQ ID NO: 45897 - DNA, 433 bp, Zea mays
  Clone ID: LIB3066-006-Q1-K1-D9
cgtcggtcgaggagtagggttctagcgcctatctggtttctccctgcgccgccggcgccggcgtggacaaccggagcgtagtgggaggggatgatggagggaggtagccgcgcggatgggcggaatccgaaccagctccggccgttcacctgcaccgggaacccgctccaccgcgcccacggctccgcgcggtgggcgcagggcgacaccgtcgtgctggccgctgtgtacgggcccaagccgggaacccggaagggcgagaaccccgagaaggcctccatcgaggtcgtgtggaagcccaagaccggccagatcggaaggcaagaaagggaatatgagatgacactcaagaggacgttgcagagcatctgcttgctcacagttcatcctaacaccaccacctctgtcgtgcttcaggttgtgggtgatgatg

SEQ ID NO: 45898 - DNA, 351 bp, Zea mays
  Clone ID: LIB3066-006-Q1-K1-E1
tgaacgtcttgggcggggaggaggacgacagggacgaggggtggcggcggtggtcggtgctggtggcgacggtgtggatccaggcgctgacggggaccaacttcgacttctcggcctactcgtcggcgctcaagtcgtcgctgggcgtctcgcaggaggcgctcaactgcctggccacggcgtcggacctgggcaaggcgctggggtggtcgtcgggcctggcgctgctccacatgccgctccacgccgtgctcatgctgtccgccgcgatggggctcgccgcctacgccgcgcagtactactgcctcgtgttcgccggcggcgctgatgcgggagcgggagcgtcgtcgt

SEQ ID NO: 45899 - DNA, 438 bp, Zea mays
  Clone ID: LIB3066-006-Q1-K1-E10
cccacgcgtccggacgaggaagatggtgaatggactgcccctaccattcccaaccgagaggacaaaggaccatggaaacaaaagaaaatcaagaaccctaactaccagggtaaatggaaggcacctatgattgacaacccagatttcaaggatgatccgtacatttatgcatttgacagcctgaaatacattggcattgagctgtggcaggttaaatcaggcactttgtttgacaacatcatcatcactgatgatcctgcgttggccaagacttttgcagaggagacatggggcaagcacaaggaggcagagaagactgctttcgatgaggctgagaaaaagaaggaagaagaggaagccgccaagggtggcgatgatgacgatgatgacctagaggatgaagcagacgatgacaaggcagacgatgacaaggccgac

SEQ ID NO: 45900 - DNA, 434 bp, Zea mays
  Clone ID: LIB3066-006-Q1-K1-E11
agacaggatgcggccggaggacgtgggcctgagcccggacctgagcttcttcagagctcgagacgccacacgtggcggtggcaccccgaccataacgcacacgacgatatacaaatgcccgaatttctcgatggtcatcctgttactgccgcgaaacgcggtgatcccgctccacaaccaccctgggatgacagtgttcagcaagctgctcctggggtcgatgcacgtcaagtcgtacgactggctcaacactgctgaccccgatccttcttccggcacgagcaccaccagcaccagttcttcgtcctccgatggcccatgcctgaagctagcggaactggtggtggacgacgtcttcacggcgccctgcgacaccttcgtgctgtacccgacggcaggagggaacatgcaccggttcaccgtcatggcgccct

SEQ ID NO: 45901 - DNA, 424 bp, Zea mays
  Clone ID: LIB3066-006-Q1-K1-E12
cgtcgtcgtccctcccgaaacaaaagaagctattttgacaccacacacacacacacagaggagagaagataagagaacgaggggcagggcagccagcgccgctagctgaagcaaggcagggcaagagaatccgtacgtcgaggtgcaggtcgtaggtaggatggacgcggaccagcagggcgtggttgcggcggcggtgaagccggcgctggccaaggggacgccgtcggcgtcgttccggctccgcaacgggagcctgaacgcggtgcgcctccgccgcgtgttcgacctgttcgaccgcaacggggacggcgagatcaccgtggacgagctggcgcaggcgctggatgcgctgggcctggacgccgaccgcgccgggctgtccgccaccgtcggcgcctacgtgcccgacggcgccgtgggc

SEQ ID NO: 45902 - DNA, 374 bp, Zea mays
  Clone ID: LIB3066-006-Q1-K1-E2
cccacgcgtccgcgggaactggaggaactgagcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggcttcagcagacccatgcatcaaccagcatgga

SEQ ID NO: 45903 - DNA, 376 bp, Zea mays
  Clone ID: LIB3066-006-Q1-K1-E3
atgaagggggtgtttgcaactcgcgtttctggttctgcagatctctaccaggtgaacagggggaagccttaccatagtgtgaactttgtaattgctcatgatggatttactttatgtgaccttgtttcatataactccaagcacaatgatgcaaatggagaaggtggtcgtgatgggtgcaatgacaactacagctggaactgtggcattgaaggagaaacaaatgatttgaatgtgctaagtcttcgttcaaggcaaatgaagaacttccatgtggcattaatgatttcccagggtactccaatgatgctgatgggagatgaatatggtcacacacgttatggaaacaacaatagctatggacatgatacttaca

SEQ ID NO: 45904 - DNA, 204 bp, Zea mays
  Clone ID: LIB3066-006-Q1-K1-E6
atccggcgcggcgggctatggacctgcagcagcaagctaattaagttggccgatatagatataatatataatggaagccctgggctttgattattggggaagccccaaccagaatgcggataggccaccaccccgcatgattacgttagcatttatgctggtataaccaaattatataattttcatatactatgcaatgaatct

SEQ ID NO: 45905 - DNA, 382 bp, Zea mays
  Clone ID: LIB3066-006-Q1-K1-E7
cggacgcgtgggcagagatggagccgcgggccaaacggaggaagggccatcatttagggggagcgtatggccagggatattcgctgaaacctcaggaatacgctcatggtccctatggacgaggagccccaccgggctcactgggatttctcgccggtgttggcagacaacgccgacccgccgtgcgccgtggccaagcttcactgccgcctccatcttggagaacgatccggtcgaagagcccgaggaattcgcaggagaagcccctgagcagcagtcgtttggtggaggttgtcagcattgcaaccactgctcaggcgaagatgaagctgtggaaggagacttccaggagttccaagattacgacgagttctaggtgtgg

SEQ ID NO: 45906 - DNA, 405 bp, Zea mays
  unsure at all n locations
  Clone ID: LIB3066-006-Q1-K1-D2
cccggcctncacctgaccgctaccaccacccgggacgtcttccatggcctgctcatagagtaagctctatctcaccgcagcaactcctcattacaatccttcaagagagcagcactacactacactacattagagagaggtcgagcgcccctcctccgatccgccggcccgccgagagctagctgctgatcggtcgaggagagtcatggcgacgtcgacgatgcgcgttgccgccggcgtgctgctggtcgtgtcggcgctggcgaccttggcccgggccgaggacccctacctgttcttcgagtggaaggtgacgtacgggaccaggtccctgctgggagtgccccagaaggtcatcctcatcaacggggaagttccctggccccaggatcaactggttcttca

SEQ ID NO: 45907 - DNA, 463 bp, Zea mays
  Clone ID: LIB3066-017-Q1-K1-F4
cgacaacgacggtagcctagatgactaggcattcagaattggggcttatatatgacactggaatagtgtgcatggtggacatatagtgcagcaccatattggctatgggatgatatcagatgcacgaccctgtctagatgatgcaaccacgacatgagacatggctttaggaacctcctccatgcagggaagaggaatcaccatctccattgattgaggatcactcggtattagtactgggggccacctgtgaagaggagtcaccaaagcctaaaatgttgttattccactggaggatggggaacccaatggtcatgcgctaaggaggggacctaagaagactctaggggtggtgattaatgtgttgttgttcatgatctcagtagggttcaatgttgccgcaacgtaggttcacaactcaactactataactgacaggtttaatttcttactggttttctgt

SEQ ID NO: 45908 - DNA, 455 bp, Zea mays
  Clone ID: LIB3066-017-Q1-K1-F6
ggaaggctagggttagggtcccagctcgccgttgcctgggcgagccgagtgatggccgcgcctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatctttatggaggtcaagtaacatcatggaagaatgacaatggggaagacttgcttttcctcagcagcaaggctattttcaaacctccaaaagctattcgtggtggtataccaatctgctttccccaatttggatcacatggaaatcttgaacaacatggattcgctaggaaccggttttggactattgacaacaatccaccttctttaccattaaaccctgctattaaagcctttgttgatctgattct

SEQ ID NO: 45909 - DNA, 455 bp, Zea mays
  unsure at all n locations
  Clone ID: LIB3066-017-Q1-K1-F7
ggccgccctttttttttttttttgatagaacgaacaatgggtgacaatagcaagagtccaggactcagaatttgggacagccacgcagttacatttttgttttcctttcctttctcagttacatatttgtaatccaggtgaagaggatttgtggtttagtgccagccagtctgcggtcgtcgacgatgtgctattactgatcgtcgtcgtcgtccgagtccaactgcttgagcagcgaggcgcagatgggcagcggcacgtccttgaagtagccgagcgggttggcggggcgcaggttgtcgctgatgccgacgttcctggtgagcaggacgccggcgcggtccctgtccgcctgcacctggtcgcagtccttgcgcgggctctccaccaagaccacctcgcagatgtcctnctcgtggctgtccttgagctcgatcgtgtacgttgccgtcgcg

SEQ ID NO: 45910 - DNA, 472 bp, Zea mays
  unsure at all n locations
  Clone ID: LIB3066-017-Q1-K1-F8
cggacgcgtgggcggacgcgtgggcccctttctccttctcgctcctcaatcacctgcagcgaaaaggaaaagggtgtcagaccgtaactaagagctatttagcaataatacatacatagctataccctctttaggtcaagagggtggagttctccttattcggaggaagagctccatcctcattctacaagaccaaaccaataaatggcctctagcccacagtcctcgccatcatcctccaagaagtcgccgccaccacaagaagcatcagctttggcgccaaaatcatcttcaaagtcaccctcgccaccaaagggtgaatcaaattcatctcccagtcccccatcgaaatcgtccctgtcaccaccgccacgaccaaagaaaagtgctagtacatctagctctaaagatgggaagacgaagaagtcgtcttcatcgtcttcatcgtcggataatacagncgctgtgatca

SEQ ID NO: 45911 - DNA, 349 bp, Zea mays
  Clone ID: LIB3066-017-Q1-K1-F9
cccacgcgtccgcgatccatcaattgcaagatgagcaagataccatcaccgtagcaccacaggcgaggtactaacaaggcgaccaacatctcaaggctgacctacgtagcatcggtagttctgaccctactgctaacgacaggtcctacaagtgccatcatcgccgacgtgatcgcgtcatctgacaatttgatcagctgcaaggtactgcgcaacttcgacaagtactattgccccgaggccatctccccagggaaacccttcaactactacacccgcggcttctacccgatcatcagctgtcaccgctgatcatatatctcttgtcaatgtgcgctcaaatgtaatg

SEQ ID NO: 45912 - DNA, 332 bp, Zea mays
  Clone ID: LIB3066-017-Q1-K1-G1
gcgcgtttccccagggatctggaggcataactgttaagaagaccggacaggcgctggtgatcgggatctgaggacgagcccatgacccctggacagtgcaacatggtggttgagaggctcggtgactacctcttatagcaaggcctgtgattgaatgcatccgaacaacgacaccaactctaacattaattaattagtagtcttcatgccctgggattgtgcgtggacgctactgttacaccacccatgcttcgatcggcattttttcctccttgtatatatcattctattgtatcgtgttcacatataatcttgtgattcgattcctgagc

SEQ ID NO: 45913 - DNA, 187 bp, Zea mays
  Clone ID: LIB3066-017-Q1-K1-G11
actcccactcgtcctcacagatttgaaacaaagattaaaaaaaaagaaaaaaaaaaaaaaaaaaatgtaaaaattataaaggataaaaaaattaaaaaaaaataaataaaaaataataaataaaaatataaaataacttaaataaaattaaataaaacataattttacaattttctttactttaaaa

SEQ ID NO: 45914 - DNA, 450 bp, Zea mays
  Clone ID: LIB3066-017-Q1-K1-G12
cccacgcgtccgcccacgcgtccgcccacgcgtccgcccacgcgtccgcccacgcgtccggggaagctgtgtcagcaagcaggccctcatctgctactcacttcatgggcatgcaccaaagccttggtattcagctggcgcagcttgggaaggatgcatctgcagcagcagctgcacgtagagttagtggtcaacgaaaggcggtcgaggttgagtctgttgcaactgctggtaaacaagagactcgagaagtagtgaagaagttattccgtgctgagtttgtcgagaggcaacatcaaggtttagatgaggataccgatttgagagctttggagaatggatttgtatcggtcacccctctgaatgttcatgggcaagtggagcctgaaatccaagccccagcttcagaatggctctcagcagctgtatcactagagaaagaaaaggaag

SEQ ID NO: 45915 - DNA, 419 bp, Zea mays
  Clone ID: LIB3066-017-Q1-K1-G2
caattcccagattcgacgcacacgtcactcctaatccaccatacctatgtctaactgctttccaatcaacacatccaggcttgccaacagtacacgtttacctatcaagctgagccaattacactaacccttactactttaactccctaactttcctctccccacacaagctaacaaaatcacctattgctatcttgcattctaacttataaacattcattcataatcctacacacatataacttcacaccactcacttttcaaccaatctctatgaccaattctgtcaatcaacaattcctctcatactaggttcaattactatcgcatacacattcatcaatatcctaaaactaacctttctcactactgtctaaacccatctcacattccctattgatcactgaacaatccaacac

SEQ ID NO: 45916 - DNA, 462 bp, Zea mays
  unsure at all n locations
  Clone ID: LIB3066-017-Q1-K1-G3
ctcgcctccgcctcctcccgttccccaggtcgccgccgccgcgtctccctcacgggccagtgcccgagcacccccctcacgcgccacagtcgaaaccaaagcagctcgcggtggccacacccggacctcgggctcgacatggggttcatgctcgtgcgcaagccgcgtccgggggacgagaagccggacctggcgaactggatgcggtgcttcctgtcgcagcgtctgtctcagcccgccgcggcggcggaggagaccgcgaacgcggagggtaaggccgccgggagacgagaggaagaggagggtggcggggaatgacgctgaccacctcgtcgtcatggtgaacgggctgtacgggagttctgcggattggaagtttgcagcagagcagtttgtcaagagattggccggaaaagtctacgtgcatcgtantcagagcaattattcacaaataacatatga

SEQ ID NO: 45917 - DNA, 382 bp, Zea mays
  Clone ID: LIB3066-017-Q1-K1-G4
tcatcaaattcatcactctcagcttctggtttaaagcttaggaactctaccccggcatcggtctcctctacaaagctcgctcaaatgctctcaacctattccctcgaacaccataccctgtttttctcaccccccataatacatactccctttactagcctgtactcttaactaaaagcattcactcataatcattgcacaccgctacattagcaccactaacttcttaataccatcactataccctttcataatacaccgacccattctactactctaattaacatcccttctcctttcatcagtagtgcaaaactaacctctctcactacaatataaacccatctcaaacaccctatattgttaccaaccattcaccact

SEQ ID NO: 45918 - DNA, 424 bp, Zea mays
  Clone ID: LIB3066-017-Q1-K1-G5
ggagttctgcttcttcagacgggtttgggtggactagcttccgaatggcacgtctgagtcggcctcatcttgctggtggttatggcagtcgccaactttgtccacactattgagacactgctactgaaactgaggattaaagcacagatgaagaaagcgaacagcacacactatcgcccgcatcaaaattgacaggcatcatcgtccttggaaaacaaggatgctgacaccgcctctattgtaaatactttcacccacattaacatttattgcctgctcgacattctctgtctctaattttttcgtgaattcgacctgctacatagaagtagatattccacacaacatggcggatgaaaccatatttaatccttcttcgatcactactgcatgagcaatgtactatatatctactctgatgaaa

SEQ ID NO: 45919 - DNA, 359 bp, Zea mays
  Clone ID: LIB3066-017-Q1-K1-G7
cccacgcgtccgctggccgtaaaattgatgatccagagttgttagaagcagttcgactgactatcattaacaacatgatacagtatcatccagtaactactttaactttgtttttccttttgcttttataatttacaacagcaataaatgaataaatgttgttaatttggtgccaggagtccagcagtcaattggctatgggggcaacttttgggccagaagcctctactgaagaggtattacctaaactatgtcagagacatcttctaaatgcttaacatatggactgaaaactttttaattctctaaagagatttatgaaaccatcttaattggttaaatctatcctgagaaattat

SEQ ID NO: 45920 - DNA, 430 bp, Zea mays
  Clone ID: LIB3066-017-Q1-K1-G8
ggatcaaggacatgaagtacagcaccagggtgaaggatgaggaaggctaccctgccatcggcctcgtcaacaaagccactggagaggctctcaagcattcccttggccagtcacaccctgttcttctgacccgccataatccagactccctggacgagtctgtcctgtggacagagagcagggacgttggggatgggttccgctgcattaggatggtcaacaacatctacctgaactttgatgctttacatggagacaaggaccatggtggtgtgcgcgacgggacggcccttgtgctgtgggagtggtgcgagggagacaaccagcgctggaagattgttccctggtgaacaaggaaatgtgtgaccgagcccgcaccaaggaagagctcctgccgtaataagtgaagtgattggtactgaagtttctg

SEQ ID NO: 45921 - DNA, 405 bp, Zea mays
  Clone ID: LIB3066-017-Q1-K1-F3
cccacgcgtccgcatcgaatcgtctcgctcgtggctgccctactcgtgctgcttgccctcggcgccgtttcctccacgcgcagcgcacaaaaggagtccgtggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagttgttgctggcacgatgtactatctcactattgaagtgaaggatggcgtagtcaagaagctttatgaagctaaggtctgggagaagccatgggagaacttcaagcagctgcaggaattcaagcctgttgaagagggtgctagc

SEQ ID NO: 45922 - DNA, 270 bp, Zea mays
  Clone ID: LIB3066-017-Q1-K1-D8
tgcgtcaccattgattacatctagcgtcggtttatcggctcgaacaacaagaccatggctagattcacttacaccgagggcagcaccaatgtttgcctcaaggagcttgcatgcttctataccctccatctactgacccatctctctagttataatatatctctctttcttttattgcatattattttctatccatttcttacgctcaactttttatctacttacatccaacatctatattatgttctactgtttaacatcctttatttt

SEQ ID NO: 45923 - DNA, 204 bp, Zea mays
  Clone ID: LIB3066-017-Q1-K1-D9
caaaaatggcaaaggctctcctaggtggcctatcggcgatcctcgtcgtggcggtggtcgtcggtgtggtcgccaagcgcacccccttcggcaagaatgcccgcgaccacttcacggtcccgggggaggctttccttgccacgttcggcaagtcggtcaagttcctgtgcgcgcccaccctatacaaggagtcctgccagaaga

SEQ ID NO: 45924 - DNA, 434 bp, Zea mays
  Clone ID: LIB3066-017-Q1-K1-E1
gcgattggattcaaggatatgactagccactgcgaagccctgacgatcgggaaacagcagaaagtgtctgccttcatgagcttgcagcaaagcgtgcaagctgcaggggtgccaggcagccagcccaaccagacgacggagctggaccttttccaagacctgcagttgcctcaggccggggcgcagagcacaaacccattctctgatgagagcgttcagggatacccacagtacatgaacgggcccaacggcgacaacgcacagccaggccaggacttccaacagcagtctctgaagctaccggcggcgagcccgtacgacaatttcctaagggcttctggctgttaggagtccagttacatggacgacaaccaccttacctcaagatagtcccaacggaagatcctgcaatttttccacattttgcagggaaa

SEQ ID NO: 45925 - DNA, 416 bp, Zea mays
  unsure at all n locations
  Clone ID: LIB3066-017-Q1-K1-E11
cggacgcgtgggcggtaggtgcattgcttcggtggtccaccatggcgcagcgagcggtggccgcgatgacgactaataagccccttctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaaacgcgtgatcctggacctcaagcccggcgctcaggtccgcgagaagctgntccctgac

SEQ ID NO: 45926 - DNA, 380 bp, Zea mays
  Clone ID: LIB3066-017-Q1-K1-E12
cccacgcgtccgggcgcctccggcaatggcaagacagacagcacgaaggctgtgcaggaggcgtgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtcatcaccggcaagggaaaccttgacgggcagggcccagccgtgtggagcaagaactcctgcaccaagaagtacgactgcaagatcctttccaactcgcttgtgatggacttcgt

SEQ ID NO: 45927 - DNA, 405 bp, Zea mays
  Clone ID: LIB3066-017-Q1-K1-E2
ggccgccctttttttttttttttttttgtttttgttttttggttttttttttttttaaacgatgggggcctctgctctgacgaattattcacaaataatggggagaaataaatacataccatgtcttttggtgccaaccaagctggatgcaaatcagtagtccatggagccgaaatccggctcctgcggcctgggaagcatgatgaggctgtcggcccggacggatcgctggcgctgcacgccgcgcatggcgttcttggcaaaacgcgacacgaggagcgtggtcttgaacctgctcgtggaaaccccggacgcgtctgccttcatctcctccttccggcgcctttgcttggccgcctttcgtttgaggtaccttcttcatgcggcctttattaagcaagaggc

SEQ ID NO: 45928 - DNA, 344 bp, Zea mays
  Clone ID: LIB3066-017-Q1-K1-E3
cgacgagacctctcgcagcgagtgggacgatcctctccaacggtggcgcagtccaagaaatggctcatattgcaaacggccgggaccatggcaactgcgtctcccttcttcgtgtcaatagcgcaaactccaaccagagcaacatgctgatcctccaggagagctgcacggacgcatcgggctcatacgtggtgtacgcgccggtggatgtggtggccatgaacgtggtgctcaatggcggtgacccggactacgtggccctgctgccgtcaggcttcgccatcctccccgacggaccgtcggcgccgggcatggctccccatcacggaggaaagggtgctgcc

SEQ ID NO: 45929 - DNA, 464 bp, Zea mays
  Clone ID: LIB3066-017-Q1-K1-E4
ccagcctcataagcctgcggttaggggggcataaccccaaccggagaggacggccgacgggtacgagctacgtagccgtggtccggcgagtcggggattccaggtccttgacaatgacccactggaaaaggcaaatgcatccattaggagcagaactctcatgaacaagcttgttctgcctttacttttggttgaacttgtgataaccaacccaaactgccaaaaaatctggtgttgctacatttgtatcaatctttacctgagcttgtgtttttgtaagcttatgcatgtacctccacatgtatagatatgctacctacattttctttctgtggtcatatgatatgttgacaaggtcacagatatactctcagtatatgatgacgcttctatgaatctatatgcttcaaaatcatcaaaaaggaaaagctgcagggggatgccaactccacagtacacatact

SEQ ID NO: 45930 - DNA, 215 bp, Zea mays
  Clone ID: LIB3066-017-Q1-K1-E5
tcccactcttcctaccactcgtactctcagtcttacgaccacgcatcctaacaaacaggcgagtacacatacaaacacgcatcctaaaaaaaaattaaaaaataataaaaaaaaaaaaacaaacaataaaacaaaaccacaaaaattatctatcaagaaaaattaaaaaacacatttaaaattaaaaaatatttaaaccaacacaataaaaatat

SEQ ID NO: 45931 - DNA, 467 bp, Zea mays
  unsure at all n locations
  Clone ID: LIB3066-017-Q1-K1-E7
gcttttgtcaaaacattaccaacacaaggggagaaaaagatggaacatggaaattgaggtgcctcangttctggagtgtcagaacgggtaaaaccaaaaggaagcgctgcatcaggtccatctctagatgggagcacaaaagttatgggttggcaactgccgggctcatctctagagggcagtgcaaaagtttcaggttggaaaccaccagtcttatcacttgaagggattgctaatggttcaggttcacaagcatcgtgtccttctacgcaaaggggcacaaaatcttcaggttggcagcgatcaagttcatccccggatgggagcagaaaagcctcaggttggcaacagtcaagtacatcaccagaggggagtggaaaagcgcatggctggcaacgatcaggatcttttacccaggggggtacaaaggctgcangtcggcaaccctctcgttcctgtacagatcg

SEQ ID NO: 45932 - DNA, 400 bp, Zea mays
  unsure at all n locations
  Clone ID: LIB3066-017-Q1-K1-E8
gccacgcgtacggacgaaagaagtggtgtaattctttggatcgaattacgcgcctggttggaccgacgctcggtgtttatacgtaatctgaagcttataggaacatttgagtggatgatggactgattggtaggcctcttgaaagtgcagntggtgaggggcatcaaccttggctaccgggacgcatgaggcagcgatgcgtatgtcgtcctacgacttggcaagactaaacttacgacgagcgtgaacatgagatctgtgaaccacatctggcgcgacgagcttactctgaccgtcacagataccagcctagctctgaagctggaggtgttctacaaggacacgttcagtacggtcgacccgatgggtgactcatagatcgacgttgcacccttgttgg

SEQ ID NO: 45933 - DNA, 324 bp, Zea mays
  Clone ID: LIB3066-017-Q1-K1-E9
cccacgcgtccgcccacgcgtcctcccacgcttccgcccacgcgtccgcttcctagcaccttgtcgtgttctattagggcgataattgctcttatttcccatccttaaccacacagcccacttaactatcattcatgcaatcttcttcggtcaggtgacatcagaggctatctatcaatggacctcatctatacaacgctggctgacatgccaaataaaggtcaaatctataacatttgccaagccaatatcctatgtcattacaatatctcttcttttattactagtgctttacgtctttcaactctctcattcttctttact

SEQ ID NO: 45934 - DNA, 470 bp, Zea mays
  Clone ID: LIB3066-017-Q1-K1-F1
tgcttatttgaacttggaggctggaaattcaagcccaacggttcatgtcgagctaacaaatgccgatgagaaactggccaatcttgcagaagacaagaatcggcgactttcagatgcaagccagttaagaacaggttcaaacccaatggttgatgttgagctaacaaatttcgatgagaaactggccaatcttgcagaaggcaagaatcagcgactttcagatgcaagccagttaagaacaggttcaaacccaatggttgatgttgagctaacaaatttcgatgagaaactggccaatcttgcagaagacaagaatcagcgactttcagatgcaaaccagttaagaacagggaggcttggtgaagaactggtcgagaaatatttggccaaacagctaggttccaacaatgttaggtgggtgaacaacagaatttgaaccggactgccctatgatatttgtataacacacc

SEQ ID NO: 45935 - DNA, 385 bp, Zea mays
  Clone ID: LIB3066-017-Q1-K1-F10
cggacgcgtgggcggacgcgtgggcggacgcgtgggcggacgcgtgggggagttcctgtacgtagacttgtaaaagctgccgactcagtttcggtatgcctatctaaagggttaggcgcacccatcggatcagttgttgttggttcagaggccttcatcgacaaggctagaattcttaggaagaccctaggcggtgggatgagacaggttggagttctttgtgccgctgcttatgttgctgttcgtgacaccgtgggaaagcttgcggatgatcacaggaaggctaaagccttggcagagggcctcacgaaaattaaacagttcacggtggattcatcttcggtcgagaccaatatggtgttcttcgatatcggggatccacaca

SEQ ID NO: 45936 - DNA, 152 bp, Zea mays
  unsure at all n locations
  Clone ID: LIB3066-017-Q1-K1-F11
tcganctgcgtaccggtaatctgaagccttacanggaaccatttgaggtggatcatnggacccggattggtagggcctacttgaaagggtccggagtggtgagggggcagtcanagccttgcctttaccgcgacgtcaaggagtgcagcgat

SEQ ID NO: 45937 - DNA, 427 bp, Zea mays
  Clone ID: LIB3066-017-Q1-K1-F12
cccacgcgtccggaggtggtgccggtgggcgtgctgctgctgctgctcgtggtggtggctgtgcaggtgcggagatcgtcgatcgatcgctgcggttcgtcggcggcggtgtcgagatgtcgatggacttcggtgccccggcggatgaccccaaggctttccgcaacatctgccgcgaccggatactgaaggacctgcttaagcctgacaaggataaggagaccaaaagctcatggaaggttcttataatggacaaattcacggtgaagatcatggcttatgcttgtaagatggcggaaattaccgatgcagggatttcgcttgtagaagatctgttcaagagaaaggagccaatgccttcaatggatgcaatctactttcttcaggcacttgaagaaaatgtcataatgcttctatctgacatgtc

SEQ ID NO: 45938 - DNA, 242 bp, Zea mays
  Clone ID: LIB3066-017-Q1-K1-F2
cggacacgtggggagtgcgtctagaaagacccataaaacccctcgacattattgcattaagtattagaaaaaaaaaaaaagaaaaaaaaaaaaaaaaaaacaaaaaaaaaaaaaaaaaaaaaaaaaaaaaaaataaaaaaaaaaaaaaaaaaagacaaaaaaaaaaacaaaaaaaaacataaaacacgccaagcaaaaaaaaaacaaaacactaaatattaaaaaaacacaaaccatttaaa

SEQ ID NO: 45939 - DNA, 410 bp, Zea mays
  Clone ID: LIB3066-017-Q1-K1-D6
cccacgcgtccgcccacgcgtccgcccacgcttccgcgtacgggacgaagaccatgagtggggacgcctcagaaggtgatcctcatcaacgacatgttccccggccctaccatcaactgcacatccaacaacaacatcgtcatcaatgtcttcaacatgctcgaccagccgctcctcttcacctggcacgggatccagcagaggaagaactcatggcaggacggcatgctgggcaccatgtgcccaatccagcccaacaccaacttcacgtaccactggcagcccaaggaccagatcggcagcttcttctattaccccagcaccggcatgcagcgggcggctggcgcctactggctcatcagcgtccacagccgtgacctgatcccggtccccttcgacacgcctgccta

SEQ ID NO: 45940 - DNA, 80 bp, Zea mays
  Clone ID: LIB3066-017-Q1-K1-C11
acgactagaagggataaactggcatcccagcgcaaacttgacgagctgagtctattataaacatgggggtctgagtttag

SEQ ID NO: 45941 - DNA, 476 bp, Zea mays
  unsure at all n locations
  Clone ID: LIB3066-017-Q1-K1-C12
ggcacatctcttgcctcctctttcgcgctgtccggagaggaggggcaggaggaggccgcacgcaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaggagctggagcactacgcggcgtacaaggccgaggagacgacggacgcgctcgccggctgcctgcgcatcgccgaggacatcaggcaggacgccagcgacacgctgatcacgctgcacaagcanggggagcagatcagccggacgcacgagaagggccgtcagatcgaccaggacctcgncaagagcgaga

SEQ ID NO: 45942 - DNA, 473 bp, Zea mays
  Clone ID: LIB3066-017-Q1-K1-C4
cggacgcgtgggggcggtgttgcggatgcaggtggacgcgttcaacaagcgcaccgaggcggcgagggcgcacgtcaaggaggccgccgtgacggcgtcccccaaggcgcggacggtgctggacctgtgcaacaacctgtacctggacgtggaggacaacctgggagcctgccgccgcgccatcggcttcaaggacgccgtcaccatccgcgccaccatgggcatggcggcgcaggacatgcagaactgcgacgagcagttcaggcagatcggcgagaagaaccccatggagcagttcgacgcgtcgctcgtcgagatgtccgagaactgccgctcgctctccaacatgatctgatcgatctccttctccacggacgacaacagagagccgggcgttttgggccctcgcatcgtttgtcgccgctgctaacgttcgcatgcccatgcccgcgagcgcgctctcgcgcgacaat

SEQ ID NO: 45943 - DNA, 388 bp, Zea mays
  Clone ID: LIB3066-017-Q1-K1-C5
acgcccacgcgtacgcctacgcgtggggcagcagatgcggctcatcgaccagactgacgcgcgtgtgcaccgcaccctgatgcgcaccgtcgtcggtcaagtgggcaggatggcggagacgatcgttctacctgtggaactactacggcagctcaagcccgcagagttcggcgacaccgatgagtaccaccaatggcagttccggcagatcaagctcctggaggccggacttatcctgcacccctccctgcgtctcgaccgtctccactctgacgtgctccggatccgcgaggtcatgcgcgcaacagatatccgtgccatcgacaccagcaagaactccgacgtgatgcgcgcactaagcaacgccgtgcacgctctctagtggcgc

SEQ ID NO: 45944 - DNA, 450 bp, Zea mays
  Clone ID: LIB3066-017-Q1-K1-C6
cccacgcgtccgcccacgcgtccgcccacgcgtccggtgccgccgccaccgtcgtggccggctccccgcctgaacgctcgtcctcccgagatccctcctcgcgctcgccgcgcgcgccatgccgtcgcgccgcccctccccggtcctcctcctcctcctcgcgctctcgctcgccctcctcttccttctcctctccccttccttcccctccacctcccgcttctctcgctccctcagctctggctccgctttcgcctcctcatctccggcgtcaacctccgcctcgcctgcacccgtcaagatctacctgtacgacctgccggccaagtttacctacggcgtcgtccgtagctacaaggctgcgcgtgcgacatctggctccgcgaacgccgctgctactctgcccgacgagcaactgcggtacccgggacaccagcactcggcggagtg

SEQ ID NO: 45945 - DNA, 377 bp, Zea mays
  Clone ID: LIB3066-017-Q1-K1-C7
cgtcgtcctccctctcctcatcagctcctgcttgcactccggcaggaaattagatggacacgcctcaaagcgaaaggggtccgaactccttacataaaaaaatgaattttatgctcaccatatatacgaattccactacactcaattagatgaagttgtcaattactatccacaactttaccatggtgtgcacaaatgtggtattcctatttacatataactaattgggaaagttcatacctacaaactagtgcaaataacaactattgaccgttatataaaatatcatgtcaaacagtttgagagatgtctccacatgatgtttccagcttgttctattgctgcaaaaaggcacatatactcatctactgcgatat

SEQ ID NO: 45946 - DNA, 471 bp, Zea mays
  unsure at all n locations
  Clone ID: LIB3066-017-Q1-K1-C8
cggacgcgtgggcggacgcgtgggtccaactttgttgtgcattagtgttcttgtagtcacgcctctatccaagggccaaaatgggaagctggtgtcgtaatggtttattgaaggggaaaaacagattgatacctggttcttggtcaatgttgctgggacgccttcacaccaatctgcaattttcatcatatttggctggtttttcctgctcctgatcagattttgaaagagctaaccattgcccacaatcaacttactgtccggttcggtcagggtgctgctagctcctcccaaagtttctctccaatatctatacaatttgtgccagtccatctaatcaccccgcgcccctagagaataggcattgaagaaactggtagcctgttcctcaagatcataggggggaaaaaagcacataatatataacgaactcatctgctgntctttcaataattgtatggtcatcacgga

SEQ ID NO: 45947 - DNA, 410 bp, Zea mays
  Clone ID: LIB3066-017-Q1-K1-D1
gacgcggacgcgtgggctgacgcgtgggatgatgttgaggttcctgaaagcaaggaaatttaatggttgacggagcaaagcagatgtggtcagagatgcttagatggaggaaggaatttggtgctgacgatatagaggaattcgactacactgaattagatgaagttgtgaagtactatccacaactttaccatggtgtggacaaaggtggaaggcctatttacatagaactaattgggaaagttgatacctacaaactagtgcaaataacaactattgaccgttatataaaatatcatgtgaaagagtttgagagatgtctccagatgaggtttccagcttgttctattgctgcaaaaaggcacatagactcatctactgcgatattggatgtgaaaggcgtgggccta

SEQ ID NO: 45948 - DNA, 487 bp, Zea mays
  Clone ID: LIB3066-017-Q1-K1-D10
gtctcgtcttcgaggacctgctcgcgcagggcggcctcgccgaggtcgagaagaagaacgcgcgcaaggccggcgcgctctacgacaccatcgacgccagcggagggtactacgtctgccccgtcgacaagtccgtgcgctcgcacatgaacgtgcccttcaccctggccaagggcccggacttcgagaagcagttcatcgccgaggcggccaaggagggcatggtgcagctcaaggggcacaggtctgtcggcggcgtccgcgccttcatctacaatgccatgccgctcgccggcgtggagaagctcgtcgccttcatgaaggacttccaagccaggaacccttgattgccttgtgcttatggtcatttggtattgctactcagtctttcttcctagcataagtgggctcgtgcaagagctgtctcgcgttgcgcactgggatctaactgtagtattagtaccaatacgtaacggctactgtattt

SEQ ID NO: 45949 - DNA, 415 bp, Zea mays
  Clone ID: LIB3066-017-Q1-K1-D11
cccacgcgtccggttctgtttgtgccaagcttgttggaatgcttgccttcagtggatatatggaagaataactggattctgtacaaaaaatcaaaggcagaaagggagcagcaaactgttaaaaaggaaaagagccctggtgatccaaaagagcagatgcaaggggagctgaacaatggtaaaaatttagatgctgatcaattaaaagaggctgatgttggttgcagtgatatgaaaaatgagaaagactatgttgatatcaaacagcaaggcaatgatggagagggtacgggtaaagttgaggaacctgttcagaagatgggtggggatgttgaaggaaaaagtacgggtgactcctctattgaccatgcaacaactggggataaaaagcccacataaaagaaaataatataaa

SEQ ID NO: 45950 - DNA, 406 bp, Zea mays
  Clone ID: LIB3066-017-Q1-K1-D2
gaagcgcgccgggcatggcaccgccgacggcaacgaggccatctgcaccggcgaccacgacgggtgggtgctggaggagctcatgtggaccatgttctgcaacggcaagagggtgggctacgcggtgcggcgggaccccaccgaggtcggacatggacggccccgacggcgagatggcgtacatgcgcgggagcttcgagcacaccgtcgggtcccgggactcggagtcgctctacatggtcggaccgcccggcggcgactgcccggagctcgccatcttcttcgttaggctatgaattgaaccgagcgaaccatacgaatcgaacaatacagtgtacacgtcgcagtcgtggtgtctaatctctcgcctggtctcgttcgttgttcagcagcctcagctagcgtc

SEQ ID NO: 45951 - DNA, 403 bp, Zea mays
  unsure at all n locations
  Clone ID: LIB3066-017-Q1-K1-D3
cccacgcgtccgcttctcctatgctgatacccagaggcaccgncttggtccaaactatctgagtgctggctgtgaatgcaccaaaatgtgcccaccacaacaaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcangctggcgagagatatcgatccttcgaccctgcaaggcaagaccggttcatccagcgatgggttgacgcactgacagaccctcgcgtgacccatgaacaccataccatttggatctcctactggtcccagtgtga

SEQ ID NO: 45952 - DNA, 411 bp, Zea mays
  unsure at all n locations
  Clone ID: LIB3066-017-Q1-K1-D4
ctcagcaaattcgtttcctcaaacattagattggcttcacagctatcttcttcagtgcatggagcgaggtcttttggctgcgtgtttagaaagctgcaatcaaggtcaatgacactcttggatgtaacctgtccaaccacacctcagtgggcattatatgctggcaatggacactaagaatatcattgtaaaggattacgcatgagtctggatatcatctccaaccaagaccgatgtgaaaataccatcgtgatgttgtcaataccagccataagcgtgggtctgtctgattggggttactcgcattaatattgtactgtattgtattagaggttatgcggcatactcataatctgaataagataacaaaatttggcattgtttgctttaaaaaaaaaaaaannaatatat

SEQ ID NO: 45953 - DNA, 343 bp, Zea mays
  Clone ID: LIB3066-017-Q1-K1-D5
ctcaatctctccctcgaacgacgccgcggggcccgaaggcgtcgcatgtcggcccggcagaggagccccgcgctggcctccaggcacgcgacgccggctgccgcaaggcccgccgccagcctgggagtgaaagagtcaacacggccctcgtcttcagtgggattagaaaaaatagattgatttagttaattgactcttgctcatcttcagtggcacacgcaaagacaaccgacgaaaaatgaatcgaatgtgctccaccatgttttctgtcgtgtgaccaaaatggagcaatatgcatagctttttttgcaaaaaaaaaaataagttaaaacacttataaaaa

SEQ ID NO: 45954 - DNA, 444 bp, Zea mays
  Clone ID: LIB3066-017-Q1-K1-C1
gcgcccacgcgtacgcccacgcgtccgggtggagttccccagtgggaatatgccaatgcaactggtaatgttcaaggcagatttgcccattcaggagccacagaaatcgcaaatgttggttttcatgaatatcagaatggcccttcaactatttgtcggggaccagtaccttatttccaccagcatgcgatgcatggcatgcaagctcttgatcctactcaaatgcaagttccttatcaacaatgccacagtaatggtttcttgcatggtggtattaattaccctggaaaccgtctccaattaggtccacgaaatccagttctcttcaccaggtctgaacgtgcttttgggcctccacagcatccgttcctggcaaatccagttaaccaccgcaacataaggattctaccacccgagcatgctacaataatggatttttcgaga

SEQ ID NO: 45955 - DNA, 458 bp, Zea mays
  Clone ID: LIB3066-023-Q1-K1-C7
caatttatcttacattgtttctccaaaacggttggattctagaaaaggatgctgtattgataatggacttgttgtccttggaacatgtttcttcgttctggatggttcagaagcagagccagaggagactacgagttagtgttgagcatgacctaggtgctagtgatgctgcaccaaagacactgagattgtttgtcccttactggataaaaaaccactcgtcaattccattatgttatcgcatagtagaaggggaatccacagaaagcacagaagcagactcacttagcagaccagactcgctaagtagagtgtctaagtcttcaaaattttcccttaaatattcttcaaagtctcttgtcagaagaggaacaatgtcgcacagaaatatgcaagtactggaagatattgaagattgtagcacagactatgtgatgctatcaccacaagattacttg

SEQ ID NO: 45956 - DNA, 457 bp, Zea mays
  Clone ID: LIB3066-023-Q1-K1-C8
ctcctcttcgcgaacgacgcgattccacaccgcaaaccctccctccctccatggattgatcgagctgctcgtccaccttcgctccgcccctcgcctcgccatttcgtagcttgtttctttttcccttctccctccctttcggtttctgctcgattcatcaaattagtttattggaggggagggagacgttaggtgggctgggcgtctcagcgcctgcgtgctccgcctcgggagaagccgagaaggtcaaaagaaatccccaccaccaacgcaggcgactcccccaatccaccatagcttcctattctccccatcaccagacgcccagagccccccgcccccagctcggagcaagcaataaaaggcaaaggtgccgacttttctgaaccgcttgccctccgtccacgccatattggtcgattgctcgattcctcggtcggtggagggaccccgggcc

SEQ ID NO: 45957 - DNA, 454 bp, Zea mays
  Clone ID: LIB3066-023-Q1-K1-C9
cccacgcgtgcgcccacgcgtccgaccacgcgtacgatttagataaatttaaaggttcatcggttcgccagagcaaatgagcagcagctgttgccttctgccatacgtacttcagcaacttctgatgataaggaagatgacatcagcctgaactttggtaagttaacgcctggactaagaaacaaacccaggcaacccccaccatacaccaaagtttccagggagagcattctgcctaagcagtccttgcctaaggtttctgctggcactgaagagtcagtcgattctgaagagaatactacattcaaacaggatagaagtagtccccaaagctcattttcagccaggacttcttcaggtaaagactacgacagtggactttatgaaaggaaccgaagtgttggaacacactgggaagcaaaatcaaccatagcaagaaattcctctggtttag

SEQ ID NO: 45958 - DNA, 465 bp, Zea mays
  Clone ID: LIB3066-023-Q1-K1-D1
acgcattcttcccctctgctaccctcttgcgtggactcgaacacccgaaatcagaacgccgtcggcagagccgtatccaggaaggtgaaagcaccgccgccaccgtcgtccgcgtgctacaccatagtcgtgaccttggagtactacctaggagattcgccttattgtgattcttgtgcgcgatcacttcgagagagcggaaaccagccgttccttcctcaattgctcgccggaggagggccgtcaccctgtttccatgtcgtgccgtgggcaaggggttcgggcattacgattcaccgacgagccatctacagaggatctcggggttcagcaggtggagactgctgagcaggagctcgttgaagagatcaaagatgtggtgtttgccctgaaacacaacagtgctccgggtcccgatggtttcccttctgaattttatcaggagttctgggaagtcatcaaagt

SEQ ID NO: 45959 - DNA, 337 bp, Zea mays
  Clone ID: LIB3066-023-Q1-K1-D11
ataactttagatctgcttgaaaccttcaatttttaatcaaatcaggcacgatacttataaggggctattcaaacgtcaaaccggatcactaggatcccactatcaacttaatccaaattgttcattcaatatgtatatatatataattatatatccatctatctatatatataagataatgaggtatcattaatgcatgcactcaattacatccatgtctaactcattctttctcaactatatttgctctttccttggcagatatcttgatgcaagcataattcacattcatggaaatgatcacttactagttatccattatcaccattgaaccatt

SEQ ID NO: 45960 - DNA, 444 bp, Zea mays
  unsure at all n locations
  Clone ID: LIB3066-023-Q1-K1-D12
gtggcggtgaagcagctcaagtccgggagcgggcagggggagcgcgagttccaggcggagggggagatcatcagccgcgtgcaccaccgtcacctggtgtcgctcgtgggctactgcatcgcgggcaaccagcgcatgctcgtctacgagttcgtggccaacaacacgctggagcaccatctgtacgccaaggacggccctgtcatggactggagcacccgcatgaagatcgcgctcggctccgccaagggcctcgcctacctncacgaggactgccatcctcggatcatccaccgcgacatcaaggccgncaacatcctgctggacaacaacttcgaggccatggtggcggacttcgggctggccaagctcacgacggacaccaacacgcacgtctncacgcgcgtcatgggcacctttcgctacctggcgccggagtacgcg

SEQ ID NO: 45961 - DNA, 442 bp, Zea mays
  Clone ID: LIB3066-023-Q1-K1-D2
tcgcccacgcgtccggtgctggaatcgaagccatcttgtcaagtaatgacctccaggtggcatctgaagataccatctatgacttcttactcagatgggcccgtgcacaatacccgaaatcagaagagagacgtgaggtccttagttctcggctgctccctcttgtgcgattcagtcatatgacgtgtaggaagctgcggaaggtcctagcctgcacagatatagaccacgagcaagcaaccaagtgtgtcaccgaggctcttctgttcaaagctgatgcaccacaccggcaacgagctcttgcagcggacgcaataacctgccggaaattcgccgagcgggcttacaagtacagaccactcaaagttgttgagtttgatcggccctacccacagtgcatagcatacttggatctcaagcgcgacgagtgctctcgactctt

SEQ ID NO: 45962 - DNA, 449 bp, Zea mays
  Clone ID: LIB3066-023-Q1-K1-D4
gctcagcctcctgcaccacccgaacctcgtcaagctgctgggctacagcaccgactccaaccagcggatcctggtctacgagtacatgcccaggggctcgctggaggaccatctcctggacttgcccccgagctggaagcccctgccgtggcacacgcggatgcggatcgcggtgggcgcggcgaagggcatccagtacctgcacgaggtggcaaacccgccggtgatctaccgcgacctcaaggcctccaacatcctcctggacgcggacttcaacgccaagctctccgacttcggcctcgccaagctgggccccatgggcgaccagagccacgtcagcaccagagtcatgggcacctacggctactgcgcccccgagtacgccatgaccggcaagctcaccaagatgtcggacatctacagcttcggcgtcgtgctgctcgagctca

SEQ ID NO: 45963 - DNA, 275 bp, Zea mays
  Clone ID: LIB3066-023-Q1-K1-D5
aacagacgtgcggccacacgtaaactgacgagctgacaatgtctactgaccggatcggcacggctaggtcacgaaatgaagcccaaacgtggtgcgacattcacagttgggacaggagattaagtgacatggcctcaaatgcagcgacaacctacttggtcatggtatctgtcacttattgtacagctgttaagacatttcacaaaatcggactagagtgatacttaatacagtgtcgtttctactgtgacacctgcaagcgccggtgttcttga

SEQ ID NO: 45964 - DNA, 457 bp, Zea mays
  Clone ID: LIB3066-023-Q1-K1-D7
attgaccaaagacccggtagttccctggatggactccggctagcctgcaagagaaaaaatggtgaaggacccaatggccagagttcagcaggtgctagcactagtttttcccacaggaactacaatgctttccataacattgcttcttcaagttacaatcctgcacctatcagaaattcgtcctcacccaattgcttgccagttccaagttctatcgatgatcaactcccacgatatggaactaatgcatggctctcagccggtacctatgaccttaatggaggggtcaacaatgctgggaattcgcagagaagtttccgggcaagaattactacgtctcaacagattgctccctgtagtgtatggccctcttcaaatgctatcagacttcctaattcatggaatcatcagctacctcattttcaaagtgcatttgatgatacccatgaggttattc

SEQ ID NO: 45965 - DNA, 436 bp, Zea mays
  Clone ID: LIB3066-023-Q1-K1-D8
cggacgcgtgggttggaccgcacgaactggaagaccaacatgctgacagctctcttggttgcttacattttcttcactctgcctaatgtgctgttttctatgatcagaggagaggtggggaaatggattgcgattattgctgttattctgcgactattttttccgcgccacttcccagattggttagagcttcccggttccatcatcctgctcacagcagccgtccccagtctgttcgcacacaccttcagggacgacctcgtcggtgtcttcatatgccttgcgatcggatgctacctgctccaagagcacatcagggcgtcagatggactcaggaacgccttcaggaagggcaatggcgtgtccaactccattggcatcctgctgctcttcatctaccctgtctggaccggcgtgctgcagatcctgtaggcgc

SEQ ID NO: 45966 - DNA, 465 bp, Zea mays
  unsure at all n locations
  Clone ID: LIB3066-023-Q1-K1-E1
cccacgcgtccgactcgccattcctaagtcctaactacctccaaccccgcacgcacaactggccgcgccaaggcaaagctagaagaagacaacgcaaagggagaggacagaggaggagcagaggacgatgggcagcggcggcgctaacactgccccccttctcaccccctacaagatgggaaaattcgatgttacccacagggtagtcctcgcaccactgacgagacagcggtcctacggcaacgttccccagcctcatgccatactgtactatcagcagagggcgactaaaggaggtcttctgatcgctgaggccacgggggtttcagacactgctcaagggtacaaggacactcctggcatttggacccatgagcaagtcgaagcatggaagccgatcgtagacggggttcaccagaaaggagggatatttttctgtcagatttggcacgtanggagagtctc

SEQ ID NO: 45967 - DNA, 441 bp, Zea mays
  Clone ID: LIB3066-023-Q1-K1-B2
acgcgctctggtagcaggaacagcgatggttggcctgagctcaggattcatcttcgccgcagcagtgtgagtgacctccgagctctttggaccaaacagcatcggtgtgaaccacaacatcctgatcaccaacatcccgctggggtcactcctctatgggcagatcgccgccatggtgtacgacgcgaatggacaaaggatgacactgatggataatcgcactggcatcattgacaccatgattgtgtgcatgggggtgaagtgctactcgaccaccttcctcgtgtggggttgcatcacattgctggggttagtgtcgagcgtagttctgttcataagaacaaaaccggcttatgctgctgctgctgctgttggtcggtcgagttgtaagcaccttcaccaagttttcagttaacggcggacttcttggtcaaaacaaat

SEQ ID NO: 45968 - DNA, 416 bp, Zea mays
  Clone ID: LIB3066-023-Q1-K1-B3
acgctgacgcgtgtgctgactcgtgggctgacgcgtggtcggacgcgtgggttggattgtccaggaaagggcagctcccctgcctcatgcccatcaaatcgttaaacttgttagatcggtaggcagagagaggccagactgatgggaatggcagccaaggagcactttgtgcttgttcatggtgaagggcatggagcctggtgctggttcaagctccgctggctccttgagggtgctggctaccatgttacatgcattgacctagccggaggctgcgtctatcctactgaccccaacacaattcggtcgttccagcactacgacaagccactcatagacctcatttcaaccttgcctgaagtggagaacgtgattctaatcggacatggtgctggagggctgagtgtgattcatgc

SEQ ID NO: 45969 - DNA, 213 bp, Zea mays
  Clone ID: LIB3066-023-Q1-K1-B4
gaaaataaagaagaaatctgacagtgagaaatcttgtaagaaagaactggaaaatgataaatgcgtggaagatggattcagcatatgagaaaggcaagcttatcaatcccatcaaacatctagatatatcactccaaccaccttctcaaactgccatctccaaatgacatccgttccatacgaactaacagaatctataccactttattctat

SEQ ID NO: 45970 - DNA, 451 bp, Zea mays
  Clone ID: LIB3066-023-Q1-K1-B5
cacgtcaaccacggcaagtttaaggcggagccgtggacggacgggcacgcgacgtactacggcgggcgcgacgggttaactgacaccacggacggcggctcgtgcggctacaagggcgagctgtacaccaacggcaccgggtgcggcgcgtgctatgagctcaagggccccaagggcaccgtggtggtgacggccaccaacgaggccccgccgccggtgagcgggcagaagggcgagcacttcgacctcaccataccggcgttcctcaagatcgccgaggagaaggccggcatcgtgcccatcacctaccgcaaggtggcgtgcgagaggaaaggcggcatccggtacacgatcacggtgaaccagcactacagcgaggtgaaggtgaccaacgtgggctgcgccggtgacgtggtggcgctgtgggtgaagggcaacaagcgcgttaagt

SEQ ID NO: 45971 - DNA, 424 bp, Zea mays
  Clone ID: LIB3066-023-Q1-K1-B6
tcgcccactcgtcctcccactcgtccgaaaaaaaaaaaaaaaaaaaaaaaaaaaaaaaaaaaaaagaaaaaaaaaaaaaaaaaaaataaaaaaaaaaaaaaaaaaaaaaacaaaaaaaaaaaaaaaaaaaaaaaaaaaaaaagggccacctatttaaaagacacaagcttacttttacaaaacattcaacactgaaaaaaccctatagtctcacataaattaaattaatatgagcatatgctttaaaacgtcatgactggtaaaacccaagagttccccaactaaatccctttaaaacaaattcacattttaaaagctgaattaaactctaaatgtcccggcacattaacctcttcaaaaattggggaaacccaaattgaaaatggtacactccatatacctataaattaatccctttggtttt

SEQ ID NO: 45972 - DNA, 461 bp, Zea mays
  Clone ID: LIB3066-023-Q1-K1-B7
ccgcgccgcgcgtggcccgatccagcccggccctcggatggtcgccgctggcacgtgacagggacgacaccagcggcggcgggtgcgggtccatggagttctggccggagttcctggcctccagcggcgggcgcgagttcgtggccggcggggtgggcggcatggcgggcgtgctggcgggccacccgctcgacacgctccgcatccgcctccagcagccgtccgccgcgggcgcaccacgccgccgcgacgcgcacccctcagccccgcgccttctacgcggcatcctccgcgccgagggcccctgcgcgctctaccgcggcatggccgcgccgctcgcctccgtcgccttccagaacgcgatggtgttccaggtgtatgcggtcctgtcgcggtcgctgggccccgtcaccttcgagccgtcgtcctacgcgagcgtggcgctggccggcgtcagcacg

SEQ ID NO: 45973 - DNA, 457 bp, Zea mays
  Clone ID: LIB3066-023-Q1-K1-B8
acggctgcgtaaacgaatccatcgccatggcgtctcgtctcgatgcggcggcggcctacggctggtccctctcttcagcgtgcccccctcgctcgcctaatctctcgccgcggccttgccggtgccgcagacggccatgggtctgcgaaggcgcccttgcggaaagatccgttgagcccgatcaagtgggaggaagagcactttgggctagcaagcctctcaatgtggggggttatttgctatggtggctacaagctttttagcggaaagaaggaagccaagactgatgcgggatcaccacaggcataggtggcggagatggagctgtacccatatctgcgggctggctacaatgtgaaatcaaaggaatgctctacgatgagctgtcaagatgataaatcgcggcatcaagagattatgctttaccgatgcaatatattgagaagctactcttact

SEQ ID NO: 45974 - DNA, 439 bp, Zea mays
  Clone ID: LIB3066-023-Q1-K1-B9
tcgtgcgcacgaccgctgattcgtcggcggccttgtctgcgccaccagcaacgagtcgctgggggatgccttcgactgctacggcgagatcctcgactccaaggtcatcaccgaccgggagacggcgaggtctcgcggcttcggcttcgttaccttctcctccgagaactccatgctcgacgctatcgagaacatgaacggcaaggagctcgacggccgtaacatcaccgttaaccaggcccagtcccgtggcggtggctgcggcggcggtggctacggcggcggtcgctgcggcggctgctatggtggcgggcgccgtgacggcggttatggcggcggtggcagctacagcggtcggcgcgagggtggtggcggcggctacggaagcggtggcagctacggcggtcctagcgagggtcgtggtggcggctacggctgc

SEQ ID NO: 45975 - DNA, 463 bp, Zea mays
  Clone ID: LIB3066-023-Q1-K1-C1
cggacgcgtgcgtgcgatgagagccttgttcctcctggtcctcttctgcatcgtgcatggtgagaaggaagagtcaaagggcatcgatgcgaaagcgtgcagtcctggtgggtccttcgacatcaccaagttgggcgcctccggcaatggcaagacagacagcactaaggctgtgcatgaggcatgggcatcggcgtgcggcggcactgtgaagcagacaatcctcatacccaagggtgacttacttgccggacaactcaacttcacaggcccttgcaagggcgacgtgaccatccaggtagatggcaatctgctggcgaccacggacctaagccagtacaaggaccatggtgattggatcgagattctacgtgtggataacctggtcatcaccggcaagggaaaccttgacgggcatggcccagccgtgtggagcaagaactcctgctccaagaagtacgac

SEQ ID NO: 45976 - DNA, 371 bp, Zea mays
  Clone ID: LIB3066-023-Q1-K1-C10
cggacgcgtgggccacatactagtcggggtaaacgatcgaacgagcacaggcacgcacgcgggatggcccgcgctcttgccctctccgccttactactcgtcgcctccgtcgacgaggctttcgccgcggaggccccggcagcatccccgaagcattcggactccacgccgtcaaaggcacccagcagttcgcccgacaagtctgataaggccctcacagcgtctgctgaaaatgctgaagatacaccaaaagcaaccccggccaaggccccggcgacagcctccaagtcagaggctcaacctctcgaggcacgcgactcctggtgcagcgctgcgtcacctactatcgagagcgccgcgtcagagaaggc

SEQ ID NO: 45977 - DNA, 451 bp, Zea mays
  Clone ID: LIB3066-023-Q1-K1-C11
cggacgcgtgggcggacgcgtgggcggacgcgtgggcggacgcgtgggggacgaacttaggaaggcaaagaagaaaatgggggagcaaaatatacaaaaggctgtgaagtccgcaatggatgctgcagaagctgctctttcaggaaataaaccgttttgtgttactcatgtggatgtgggtcttgataccacggctgtccgtgaggcggttatcaaagtcatggaccagaagggtttgcctataatgttattcagcaccgatgaggcatcaaacaaagccgttatctatgctggtgtgcctcccaatgctcctagcggcttcaaggtgttggactggctaacaccttcaattgcgccactcaagggaagaggcggtggcggcaagaacggcgtcgcccaaggccaagggagtgacgcttctcagctcaaggaagcaatggcacttgcgaac

SEQ ID NO: 45978 - DNA, 427 bp, Zea mays
  Clone ID: LIB3066-023-Q1-K1-C12
cacattcaagaacctactcgcctcctacattgaccaacaactaagcctccgtgaccgccacggtctattaggtgcagccatgggtgcctgtgcaacgaagcctaagacgcttgaggggaaagccccagctgaggccaccatctccacacccaaggttgcacctgagaccactgccatccacattgaggttgcggcgaaacaggcagtagttgagaaggtggaggaggacaaggaggaggcactaacagtggcggcgaaacaagagccagcagccaccatcgagcctcaacagattgctggtgaggtgaccacttcggaagtggcggtcgtcgttgtcgagcctgagaacaaagaggacgaggaagttgtggagaagaccgtcatcgagaaagagaagccatcagcagtccatgaagaggaaaatatc

SEQ ID NO: 45979 - DNA, 459 bp, Zea mays
  Clone ID: LIB3066-023-Q1-K1-C2
cccacgcgtccgcccacgcgttcgcttgactattcaggaaagtaaaaggcttgcccgtgaaaatgctaaagatattatagcatgtggttttgacattgaaagaacattcattttctctgatttttcttttgttggaggtgctttttatgaaaacatgatgcaagttgccagatgtgtaactatgaataaggctattggaatatttgggttcaatcttgaggatcacataggaaaggttagctttcctccagtgcaggcagtcccatcattcccttcttcatttccccatctcttcgctggcaaggaccaactgcggtgtcttatcccatgtgcaatagatcaggatccatattttaggatgactcgtgatgttgctcctagaattggttatcagaaaccatcactgattgaatctagattttttcctgctcttcagggggagaacacaaaaatgtcagc

SEQ ID NO: 45980 - DNA, 359 bp, Zea mays
  unsure at all n locations
  Clone ID: LIB3066-023-Q1-K1-C3
acgcccactcgttcgtccactcgttcggcatgtctgaggtgagcttntgcagggtcgcgttcctgctcgagtcgtgcgaggacgactactagatgcaccttgtcatggaactcttcaagggcagatagctatgagactacatgttagagctgaagatgtactacgtgctagtgatgctgtagctaagacactgaaattgtttggcccttactggataaaaaaccactcgtcaatttcattatgttatcgcatagtagaaggggaattcacagaaagcacataagcagactcacttatcagaccagactctctaagtagagtgtctaagtcttcaaaattttcccttaaatattttttaa

SEQ ID NO: 45981 - DNA, 444 bp, Zea mays
  Clone ID: LIB3066-023-Q1-K1-C4
gaagataagagaacgaggggcagggcagccagcgccgctagctgaagcaaggcagggcaagagaatccgtacgtcgaggtgcaggtcgtaggtaggatggacgcggaccagcagggcgtggttgcggcggcggtgaagccggcgctggccaaggggacgccgtcggcgtcgttccggctccgcaacgggagcctgaacgcggtgcgccttcgccgcgtgttcgacctgttcgaccgcaacggggactgcgagatcaccgtggacgagctggcgcatgcgctggatgcgctgggcctggacgccgaccgtgccgggctgtccgtcaccgtcggcgcctacgtgcccgactgcgccgcgggccttcgcttcgaggacttcgacaagcttcaccgcgcgctcggtgacgccttcttcggcgcactgggaggccaggacgacgccacc

SEQ ID NO: 45982 - DNA, 451 bp, Zea mays
  Clone ID: LIB3066-023-Q1-K1-B12
cccacgcgtccggacaaaacatggatgtgaatgtgagaaccatgtggtcgtcgatgcgggcgcaggttgcgatggctgtggtgttggtgttcttggtgagcggcgcatggtgcggtcctcccaaagtccccccaggcaagaacatcacggccacctatggcaaggactggctggacgctaaagcgacatggtatggcaagccgacggttgccggtcccgacgacaacggtggtggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgtt

SEQ ID NO: 45983 - DNA, 339 bp, Zea mays
  Clone ID: LIB3066-022-Q1-K1-H9
aattgcaacaccttaagtctcatttaccctatatgtctctcacacacacacatggaggactcgtcaaatcttgacacacaagtgggcccttgtcttatataccattcgatcgtctatgatggtcaatacttacctactactgcttccagcttcttcgctcttgtattgtaagacctaaattgaaagtaccggccgtgcaattacatcgtagcctctggaaatactccagactgaccaaacttacttgcttatcttcatatccacctttaacaacatgaccaattatcaaatatgccattcctatttgacctatccaagactttcacagccagtattgcc

SEQ ID NO: 45984 - DNA, 370 bp, Zea mays
  Clone ID: LIB3066-023-Q1-K1-A1
acgcggacgcgtgggcttggcattcgaaaaaaaaaaaaaaaaaaaaaaaaaaaaaaaaaaaaaaggaaaaaaaaaaaaaaaaaaaaaaaataaaaaaaaaaaaaaaaaaaaaaaataaaacaaaaaaaaaaaaaaaaaatgaaacatacataacaatcccgctgacgaagtgaacctcggatgatatggagagggaccaagaacctttgttacaccgaacaatggggccgtcgcaactacgaatacgtcttgctcagctgcgactccattcccgttctcaaaggactcacgcccgtcgagtgctacaccgacttcatgcgcgcgtttcgcgaccacttcgtcgactaccttggcaacaccatcgtggaaa

SEQ ID NO: 45985 - DNA, 434 bp, Zea mays
  unsure at all n locations
  Clone ID: LIB3066-023-Q1-K1-A10
cccacgcgtccgggcaagcacaaagatggtggactgaaaattacgagaaggtcatggagctggacaacgttcagaagtctaacagtcaagttgatcctctgccaagcattccaaggtctgacagtgagatctccaaagacgataccccagctacagcaccgcttaacaaggggcaattgctacgtacttcacccagaccactaaaaggcagtgaagccataggctattcatcttcggattgtcctcagcaccaatccagtcatcttcgcaacgtttaccgcaaagaccgctaccttgggcaccagttctgtgatccagttgaactggcatcgacgcctgagttatcaagcatcagtggtgcgaagacagagacgtctattggtgcatcagtgaggacaagctcatctnctgaagaagtcgatggatcgggcgaa

SEQ ID NO: 45986 - DNA, 312 bp, Zea mays
  Clone ID: LIB3066-023-Q1-K1-A11
gcaaagcataagagatgatctggaatctgttatctattagctcatgaaattaataaacactggatctatttacaagccagcaccgaaactagacactcacaatcccaaatataaataacctcaatcctacaaacatactaacacctcaccgagacactatgtaaatcatatccatcatatcttactacatactcttcttaaacatcatcactacgacatcaaacataaatcagcatcatcatatgccaataaacccttccgcgacccacttatcctcgaccgttaacaactacattatccatttcactctac

SEQ ID NO: 45987 - DNA, 443 bp, Zea mays
  unsure at all n locations
  Clone ID: LIB3066-023-Q1-K1-A12
cggacgcgtgggcggacgcgtgggcggacgcgtggggcccgagatccaacggcgtctgatggggagcaagctgcagcaacacctcggcacctgacctggccatgcatgcacacgtatactataatctaacaacgtagctgacctgggcaaattgccagcctgacaggggccagggtgctcgaatgtctcactctcaccgccgactaactttccatcaaaattgattcttgttcatactccatagcatgcacagattgattgaactgctacttgagattcttgtcattggtattagagagagagacagagacagaacgattggcatagcatgcagaattgtttggaagaagctagcanagcagttccttgtttgtatcctctgtaccagaagatgagtttgatctaggattaatccctgcaaggcaaggtaaagtaaattcatg

SEQ ID NO: 45988 - DNA, 375 bp, Zea mays
  Clone ID: LIB3066-023-Q1-K1-A2
acggcagactggccagggcgtggcggcaggcgtcaaggacacggtggcggtcgcggcggttgtcgtcacgaacactgtggcggtcgtggcggcgggcgtcacgaacacggtcacgggcgccgtggcgggcgtcacgaacacggtgaccggctcggcggcgggtgtcaaggacaccgtgaccggcggccactgatcgacgacccaagaatgcttcatgcatggccaagtgttgagggtttgaggccaaagatggcttgaatttccgtcctttttttgctttattttttgacattattgttttaacatgtttcattcacccgtctctgattgggattgtgatcacgaccgcctgcaataaaaaaggccatctttact

SEQ ID NO: 45989 - DNA, 474 bp, Zea mays
  unsure at all n locations
  Clone ID: LIB3066-023-Q1-K1-A3
acgcccacgcgttcgcccacgcgtccgaaatgaagaaaataaaaatagttgcaagaaaatttcctcgctccaacatcagctagatttatcatccaaggatcaagaagctcagcaaaatattctttctcagatagaagaagtgaagagggagaatattttactacaggcaaagaacacagaaatggaacaagagctcttaaaagctcaaaaatgtagccatgataatatggacaagttgcacgatgtggaaaagaactatgttcatctccgggataacttgaaaaacttagaggataagatctcaaatttagaagatgagaatcatttattgagacagaaggccttgaatttatctcctaggcacagccgaactgggagttatcactgcggttcttcaccatgcagcccaaaatcattcgttgaatcttcacctgtgaaacttgcacctnccnctcataaccagacagaatcaag

SEQ ID NO: 45990 - DNA, 454 bp, Zea mays
  unsure at all n locations
  Clone ID: LIB3066-023-Q1-K1-A4
cacaggattagttcaataaggaggagctgctggagttctacctgaagcaggcggcgcgcgggaggaagctcaagttcgacatcatccccacggtgcacctgtaccggcacgacccctgggagctgccgagcctggcgcgcgtcgttggcgagcgcgagtggtacttcttcgtgccccgcgacggcggcgggcgggcggccaagcagcagcccggctccggcggccggcctagccgcaccacggagcgcgggttctggaaggccacggggtcggaccgcgccgtgcggtgcgccgtcgaccccaagcgcctcatcgggctcaagaagacgctcgtctactacgagggccgcgcgccgcggggcaccaagacggactgggtcatgaacgagtaccgtctncccgacgctgccgacgctagcagcgacgcgcgcgtgccgcatgtggacgtggtgct

SEQ ID NO: 45991 - DNA, 464 bp, Zea mays
  Clone ID: LIB3066-023-Q1-K1-A5
catcgccgagcgcgacggcccgggccggtacaacttcgcgggctacgcggagctcatggagatggcgcgcaaggccgggctcaaggtccaggccgtcatgtccttccaccagtgcggcggcaacgtcggcgactccgtcagcatcccgctgccgcggtgggccgcggaggagatggagagggaccaggacctctgctacaccgaccagtggggccgccgcaactacgagtacgtctcgctcggctgcgacgccatgcccgtcctcaagggacgcacgcccgtcgagtgctacaccgacttcatgcgcgcgttccgcgaccacttcgccgactacctcggcaacaccatcgtggaaatccaagtcggcatgggccccgccggcgagctgcgctacccgtcctacccggagagcaacggcacctggaagttcccaggcatcggcgccttccagtgcaacgacaggt

SEQ ID NO: 45992 - DNA, 457 bp, Zea mays
  Clone ID: LIB3066-023-Q1-K1-A6
cgccaccaccaccgtcaccgccatcgctcgcccggatcgtcaacatggcagccgccctccgtgtcctcatcgccgtcctcgccgtcgtctcggtctctctccggcgcgccacggcgactacggcccccaccgtcgtcgacgaggcgtgcaagcagtacaccaagtacccggagctgtgcgtcaagtccctgtcgtccgcggcgccggaggcgaaggcgaaggcggagcggggcgggctggcggggctggccgggctggcgctggcgcaggcggcgcagtgcggtgccgagacggtggcgttcgtcaagggcctggagaaaatgccggggggcatgccgcccgtgtgcctgaacgagtgcgtggccaagttccagggcgcgctggtcgacctgcagcggtccaaggtggcggtgcagaaggccaaggacgaggccgtcgtcgacacgtggctcacggc

SEQ ID NO: 45993 - DNA, 174 bp, Zea mays
  Clone ID: LIB3066-023-Q1-K1-A7
cccacgcgtccggtggaagtggagagagtggtgcccagatcagcggggactcgacaacggtgggtggttcatgggaaacggcggacagctagcgggcggtccggtgatcggtgtggccggtggcccggatgagtcagttagagagcgagcttttttttttgatacgggggagtt

SEQ ID NO: 45994 - DNA, 460 bp, Zea mays
  Clone ID: LIB3066-023-Q1-K1-A8
cgagggagcgcgtggggggagagggcatggtctctctcgtcccggcagtcccgtctcaagcaaaagctctctcctcttcttccgctcagtgcaccaatcactgcaacatactggcctgaggtcattgagttggtgaaagggaaggagggggtatcatgggcatctcatccaagtggattaaatccttggttggcataaggaagcaagaaaaagcgcagaatgcagaaaagcaagaaaaagggtggaacgctgagagcagtgaaactaggagctctgctaatcaatcactgcacaaacggaaacattctttggatcccggagctgcacttgcagtcgaagaaattacagtacaaagtgaagcattgactgataacaaaagcgcacaaatggtttcaaattcatttttttcagacagtacaccgcttgatgtgcaaatttctcaggctggacatcatagtaa

SEQ ID NO: 45995 - DNA, 397 bp, Zea mays
  Clone ID: LIB3066-023-Q1-K1-A9
ctgcaaggtgatcagcgtaaaaatgtcgctacttttctagtccaggccggaatcgtgaaaagggatagcatcaagattcacggattttagactgcaaatttgaagtgcttgtgtgtgcctatcatatgataccatatgataccaggtattgaagcttcggaagcttgttggccttcgtaacatcagtagtcgttattcatctgaatatgtgtcattatttcatttgataagactggtattgatgcaagttgtccttgcagtatgttttgtaagtgttacctgcatgaaagtatcgtttgtctgcggagctgtctgctactgatattgaataacaagagagattgctgtttgtaattcgtctatgaattattatgatctttccccagacttgagcttt

SEQ ID NO: 45996 - DNA, 415 bp, Zea mays
  Clone ID: LIB3066-023-Q1-K1-B1
acgatcgccgtcgagacgtcggccgcgttcgccgcctcgtccatggtgttccgcgacgacaagaagtactcgcgcaagctgctgaacaaggcgaagctgctgttcacgttcgccaagagccacctgggcagctacgacggcgagtgccccttctactgctcctactcgggctacaacgacgagctgctgtgggccgagacctggctgtacctggcgactaggcggcaggtgtacgcggacttcatcgtccacgaggccatctcgtcgagcgtggccgagttcagctgggacctcaagttccccggcgcgcatgtgctgctggccgagttcaacatgacctcggcgggcggcgcgcagaacttcaagtcgcatgcggacaacttcgtgtgcgcggtgctgccggacacggcgtttc

SEQ ID NO: 45997 - DNA, 387 bp, Zea mays
  Clone ID: LIB3066-023-Q1-K1-B10
cccacgcgtccgcgaaaaccctcgcggcgaggagcgctctccgtcccacacacgcgcgccggggcctccgcagtccgcacctgcctccacgacttgtcgtgctcgtgcgctactctcctcgagcgcggcgcggagcacggggacatcaaatggcggcagcggcggagatcggtggtttcgcggcggcgagagtggcggtggcgacgctcacgccggctgcgcacccagccccggcggcggcggtggcaccgcagcctaggagggcggtggcggcgcagtcgctgcagacgaccgccaccgaggcgctgacggcggatctcgccggcacgaccaacggcgctgtgcatgctcggatgaatagtaaggcttcacgtgaaatcacttcac

SEQ ID NO: 45998 - DNA, 375 bp, Zea mays
  Clone ID: LIB3066-023-Q1-K1-B11
cgcacgcgtgcgcaaaagccctcggaccgtctaacgctctacatcgtatacatgcgcccgagagcctccggaactgtgaccgcggctgcacatactatgcagctcctgcactacactcctatagcgcggcgcggagcacgctgacatgaaatcagagccgaagcaggacactgggctgtatgtggttgccagagtggctgtcgcgacgatgaggacacctgtgcacatacttaatgcagcgtaggagtcaccgcaggctaagaacgcggtagcagctaattcagttgatacgaacaacaccttggcccagtgcgagctagtcatcgggagcatgctacgcagtcaactcacaaccttgaataatgacgtgacaga

SEQ ID NO: 45999 - DNA, 420 bp, Zea mays
  Clone ID: LIB3066-022-Q1-K1-H11
atttgaaacagttaagaattcatatataagagtgcatatatatatatataattctgccaagacaaaggtaatggagtcgtcacgcatgttccagccggccatcatcctgcttctcctgctcattgtgaccaccgatgtggcgcatgcggcgagggaatgcgagaaggacagcgagcgattccttggggcatgcatggcgtcagacaactgcgccaacgtgtgccgcggtgagggcttctccggcggcatgtgcagcaccttccgccgccgctgcatctgcactaagccgtgctaaattaacctactcccggcagttcgatggtggacgtttattctatctattggcttacttgattctttgtcccctaacaatacgataacgcacgtgctgacatgtacgttgtgtggcatatgcttttc

SEQ ID NO: 46000 - DNA, 92 bp, Zea mays
  Clone ID: LIB3066-006-Q1-K1-B9
cggacgcgtgggttgtatttagaatgctgatgataaatgtaattttacatacttgtgtctgttttattataaaaaatacagacttgatagtg

SEQ ID NO: 46001 - DNA, 346 bp, Zea mays
  unsure at all n locations
  Clone ID: LIB3066-006-Q1-K1-C1
cggacgcgtgggccgataatagtggcagcagcaagagcggaagcggaagcggaagcaggagcagaagcagcgggtcgacgcangtggatgtcatcctggccggcgtggtgattggggtcctggcatttagcctgctgatgtgcatcgccgcgtgcgtgtgctgcgccaagaagaagaggaggaagaagcccccgcacatgaacatgccgtactacaccgacgagcacgggaacgtcttctacgcgaacagcatgcccaagtggcagagcagcgcgatggaccacggctggcacgcgccgtactcgcccgcaagcggggacatgagcggctcgcacgggccggggct

SEQ ID NO: 46002 - DNA, 435 bp, Zea mays
  Clone ID: LIB3066-006-Q1-K1-C10
tctaaatagaaacaatactgatggcccaaaacaagatgattgtggtggttctcctgcttgcgcacctttcttgtggtggctagatcgttgtgggttccagaagaaccatcaaatgcggatgacataagaggtgcttgcatcgaggagtgcaccaaagaaaataaggctcctggcgacaagaagacatgcgaagtgttgtgcaccaagctcacaaaaaagcctagcgaagaaggcaaacatgattgatgaagtagcactccgataatatataccctagtggatgagtggtcatctttgtagccatgtctgccacacgatggccttgattatattgtcttattgttttgtttttggtttccactagtatcctaattccttgttcatgtaacctaatgtcactcaaagcattttatatgcttcacttaattaaataaa

SEQ ID NO: 46003 - DNA, 433 bp, Zea mays
  Clone ID: LIB3066-006-Q1-K1-C11
cccacgcgtccgcaacatcaactattgccatagagtctagcgtcttactcatcgctgtgaagactgctgttataacaatgttcttgtttgcagatctggttccagatctagacctcccaatgttcctcctctgatgcctcagttcatgagggctcatggcagcatcagcgaacagtaccaacagaattcatcatctagcttatttgctggggcccataggtcaggaggcatgcgacctgccccaacacctctaccagagaaccccacctttaccttgttcccgccaggttcatctggccatagctcgatggagactgatgatgctgggggaagccggttctacgcctgggagggtgaccggtttgccccatacccgttgatgccggtagactgcgagacaagctggcggacctcacagcagcagtcccaccag

SEQ ID NO: 46004 - DNA, 435 bp, Zea mays
  Clone ID: LIB3066-006-Q1-K1-C12
cccacgcgtccgcgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaactttacaggcccttgcaagggcgacgtgaccatccaagtggatggcaatctgctggcgaccacggacctaagccagtacaaggaccatggtaattggatcgagattctacgcgtggataacctggtcatcaccggcaagggaaaccttga

SEQ ID NO: 46005 - DNA, 366 bp, Zea mays
  Clone ID: LIB3066-006-Q1-K1-C2
cccacgcgtccggttctctgttaccttagataatgctttttctaattcaactgccatgcgcacattgtcacctatgcttgctggttatttgggtgctgatgttgatccaacagataccagtaacaaaacttatagtgtgcttcatcagcgttgtgcatgtcacattattaacttgatagtgaagtgtgggttgaaaaggcttaaggattatttagatgtgtttaggactgctattaatttcttaaactcttctaaccagagaattggttcatttagtaattactgcaaagcaaaaggttgtagacctagaaaatttggtttaaacatggatgttagatggaattcaacttatcttatgctaaaaca

SEQ ID NO: 46006 - DNA, 333 bp, Zea mays
  Clone ID: LIB3066-006-Q1-K1-C3
gccccgggacctccaaggtgaacatcaccggcgtgacctgcggccctggccacggcatgggcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgccttcaaggtcaccgtcaaggatgtcaccttcaagaaca

SEQ ID NO: 46007 - DNA, 377 bp, Zea mays
  Clone ID: LIB3066-006-Q1-K1-C4
cggacgcgtgggcggacgcgtgggtgcgcttgagtcgaccaacgttgagaatgcattggcagaagtcctagctcagatctaccgtattgtgagcaagagagcagttgaagcaggtgaagatgcagcatctgggcctggcaggggcgagaagataaacataaaggatgacgtctcggcagtgaagaagggtggctgctgctctagctgagctgccgtgctgtaatttttttttgggagttgtgggatgtagcttatgttatggcattttcagcgactggaaattggtagtggcatttagcagcctctattacctagagaggtaattgtcaaactgaaaaaaaaaactgaaggttagatcagtttagagctctggtact

SEQ ID NO: 46008 - DNA, 399 bp, Zea mays
  Clone ID: LIB3066-006-Q1-K1-C5
gtcatctcctccaccaccaccaccaagctcaacaacagccagctcgcgaaaataatggagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaagagtgcgacaaggcgtacgtggtg

SEQ ID NO: 46009 - DNA, 373 bp, Zea mays
  Clone ID: LIB3066-006-Q1-K1-C6
atgcgccatccttgggagcatgtgttggtgatgggtctcggtgcagtatttgtgaacgagctggtaaaatttgacgagaagctcaaggaggacctcgacaagatgcttgagcgcgccaggctagccaacgagcaacgctacattgatgatgatgaatagctgttcagatttgtttgtcagtgacctgtatttttttgcaacatgttgtcagtacacatggtcaggactgtggatcccccatgacttagttgttgcctcagcttccacatttcaactgtggccttgtaataaaatgtcgttgcccaatggatctgatggatcacaattgtaagctacaaattatgggctttgaatatgatcgcttactttctct

SEQ ID NO: 46010 - DNA, 380 bp, Zea mays
  Clone ID: LIB3066-006-Q1-K1-C7
cccacgcgtccgcccacgcgtccgcggacgcgtgggatcgctgacgcgaacgtcgggggggccacctgcggctggaactcggtccagcctgtcttgtagtagccgtagagcgggttcgcgttggccgcctgcgcgcagacgaggcgcggcacgcggtccacgagcccgaggacacggcacatctcgaaccccttgtagaaggcgtatatgttccccaggttgcctcccggcacgatcacccagtcgggcacctcccagtcgaactgctgcagtatctcgatggccgccgtcttctgcccctcgaggcggagggagttgagcgagttggcgaagtagataggcagctcggcggtcaccttcctgatgagccgcatgcaccc

SEQ ID NO: 46011 - DNA, 363 bp, Zea mays
  Clone ID: LIB3066-006-Q1-K1-C8
cccacgcgtccgcccacgcgtccggccagccagccatcgtcacactggtgagctctgcagtctgcactctgcttagctccgagcttcagtgccttcgttgttagctgttagctccacagtccacagttccacacacacgtccagctgcactgcaccaatggccgccgtcgaggtccaggtcccgactgccgctcccgtcgaggaggctgctgctgctgctgcagcgggagtggaggctgcccagctggccgccgtcgagaccccgaacgaggagaccgctgctccggcggcggagaccgaggtcgtcgccgctaaggagccggtgtcggccgaggccgagactgagtccaaggaagtcgaggt

SEQ ID NO: 46012 - DNA, 365 bp, Zea mays
  Clone ID: LIB3066-006-Q1-K1-C9
cccacgcgtccgcatggatactgtctgccttagagcttccatggtcgatgaacatggagagtctaattcgtaaaattgctagtgcccttcctcagtatcgagacactctcaatcacgaagcatgaaaacatacttgatgtcaacttatactattgcaatgcaaaactctcccagtctacaactacaagctacgcgatgcaattgctaattacagtctctgacacttgctgctcatgatctctgaaacccttagcatcagaacacgataccactgatacttctctaaggaaagacagttgatcaacattaaacactcacattctatatcatttacccattaaaaggaacatttgcattgcaaccat

SEQ ID NO: 46013 - DNA, 367 bp, Zea mays
  unsure at all n locations
  Clone ID: LIB3066-006-Q1-K1-D1
aaccagattcaacgatggaatataggacgaaatttataagagctaagtatgagacacaggattttttgaagccaagtttgcgcatttcatcgagatcatcttttaaatctaccaattctgtgaagagtgtagatagcaatttctctagcacttcaaggaaggatatctctgaagatacaagagaatttgttggagagctgaatattacagtcgtgaaaggtactaacttggccgttagagacatgctaacaagtgatccatatgttgttttaacactcggagggcagaaagctcaatcgacagttaaaaaaagtgatctntaatccgtatggaatgaaatgcttaagatttctgttcctcgaaatta

SEQ ID NO: 46014 - DNA, 431 bp, Zea mays
  Clone ID: LIB3066-006-Q1-K1-D10
cgcacggcgcacccagcgcttctccttccgtccttggcaaccaggcccaggcatcggttggccgctattcctcctgccccatctcctcccgatccatccgagcccaaaccctagtccagccagatctccaccgccgccggcgagagcacggcatcagatccgccgcgatggcgttccgccgcatcttatccacagcggtgcgccgccgctcggccatcgccgcggcagcgtccgggaacgcgcgcgaggcctccacggccgtcgccgcggcgcccggcgtgctagcccccgacgcgaccccggtgcgcgctcccgtgatgccgtacgatcgcatcgccgaagccgttaacgccaggctccggcggcttgagcacccagacccgcgcttcctccgctatgcaagccccgttccgtcccacgccgaccacacg

SEQ ID NO: 46015 - DNA, 433 bp, Zea mays
  Clone ID: LIB3066-006-Q1-K1-D11
cccacgcgtccgcaaggttccaggagggaatcaaggccttctcaggaagcccaattgttggggagatacgcggtctgggactgatacttggaactgaatttgtcgacaacaaatctccaaatgatccatttccagctgaatggggtgttggttcgatatttggcgcggagtgcgagaagcgtgggatgctcatcagggtggctggggacagcatcatgctgtcacccccgctgatcatgactcccaatgaagtcgaagaaatcataagcaaattcggcgatgctctgaaggccacggaggaacggattggagaactgaaatccaggaagaattagccgatgctgctggttgtaacgacggtgaggatggtgatggcagcagtatattttcaaactttatttcagtaaagtgctgggctggaaccttgtagtcg

SEQ ID NO: 46016 - DNA, 441 bp, Zea mays
  Clone ID: LIB3066-006-Q1-K1-D12
ccgcgcgacgcaaaaccctagcccatccaccgatccttgtcatggcggccaccaccagccaggcgagcctcctcctgcagaagcagctcagagatctcgccaagcacccggtggatgggttctcggctgggctggtcgacgatagtaacgtattcgagtggcaggtcaccatcatcggcccgcccgataccctatatgatggagggtacttcaatgcaataatgagcttcccagaaaattacccaaacagcccgccatcagtcagatttacctctgaaatgtggcatccaaatgtttattcagatgggctggtgtgtatctctattcttcatccacctggtgaagatccaagtggttatgagctcgcaagtgagcgttggacacctgtgcatacagttgaaagcatagttctgagcattatatcaatgctctctagtccaa

SEQ ID NO: 46017 - DNA, 324 bp, Zea mays
  Clone ID: LIB3066-006-Q1-K1-B6
aagaaacaacatgactgacagcgacgatgatgccacagctgcgtagcctcgtcacgcgggtactcgtggccacggccatagccgccgctcccggcgttgggtttgtcgttaccggccgcatctactgagacaactgacgagccggattcgagacaaacgtgtcccacgccatccaaggctcgactgtggagatggagtgccgtcaattcgagtcgcaacaggtccacgacaaggcggatgcgaatacgggccccggctgctggtacaggatggagatcagcggcgaccaccaagacgagatctgcgacgtgcgcctgctcaaga

SEQ ID NO: 46018 - DNA, 397 bp, Zea mays
  Clone ID: LIB3066-006-Q1-K1-A10
gcttgggaagctgcaactgagcttcctttatctcataggcgtgatagtcatggggtttgaggtcatgaggaacattgtaagggtgatgaagccagtaagggttgcagcaattgagtcgtaagtcataagaaccaaatacatgtacgttgttcttgagaccttgtggtagtcgagatgatactttcacttctccccaatgcctggagatgatgattttagagtagcatctgttaacacatgtgaaactcggcctgctcctagtagcagaataatacgaaacactgagaaaacagtgcgcgcctggacagaaatgtctatggcaaggttgcccgttggcgtatgtacctgtaagagtatctgtaccataccgagatttggaatcgatgctttgctgcta

SEQ ID NO: 46019 - DNA, 424 bp, Zea mays
  Clone ID: LIB3066-006-Q1-K1-A12
cctgcacctcagaggggtgggggaagatacccttcgggccactgcgcagcgacgcgattagcgtcgagccccctatcgcggggttaccggtgatctcgtccgctcccagccggatacctcgttccattcaaaggcgcccctggcgtgggtgtctaccgaaggcgatccatacttcattctcgacaacgtcaacgagcgagatgtctgggctgagttccaggcacaggaccatttggcctagaggagcgccgaagtggccaacctgacgtcccggtgcaagggactgaaggaggagggtgtagccgaccgcaaggaggcctgtcgactgagggctgaggtccttggtctgaaggcagaggcagaccaccgtgaggaggtgctacggtgggcgcaggagggccttcaagcggtgacggaagaacgt

SEQ ID NO: 46020 - DNA, 392 bp, Zea mays
  Clone ID: LIB3066-006-Q1-K1-A2
ccggttccctcctctcggcggcggctcatgtccctctccatctccggcgtggcgcttggcgtctgacctcaacaagcaagaaagcaaatggcaggcggcagggttgcacatgccaccctcaagggcccgagtgtggtgaaggagatcttcattggactgaccctgggtctgatcgcgggaggcatgtggaagatgcaccactggaacgagcagaggaagactaggtccttctatgacatgcttgacaagggccagatcagcgttgtcgtcgaggagtaaagagttcttcccagttattttcaaagaactctctcgagagcatgacaaagtgattgcttgctgtggagatttgtcctggaaataagcccaaccatttgggaacaccagatttt

SEQ ID NO: 46021 - DNA, 118 bp, Zea mays
  Clone ID: LIB3066-006-Q1-K1-A3
aaaaaaaaaaaaaaaaaacaaaaaaaaaaaaaaaaaaaaaaaaaaaaaaaaaaaaaaaaagagaaaaaaaaaaaaaaaaaaaagaaaaaaaaaaaaaaaaaaaaaacaaacaaaaaaa

SEQ ID NO: 46022 - DNA, 269 bp, Zea mays
  Clone ID: LIB3066-006-Q1-K1-A4
cccacgcgtccgcaacgatttggaatttggagaaccctatgctggcctcccggacactgctgcccgcgtctttgatgctggcctcctcggcgcattcgccatggccggccacgcggaagacgccgaggtgcggttgcaggagatggtggtgacgtgcggtgacgagagcgtcgacagctacacgctcacggatgctgttgtgtacgtttaattattgggatgtaattattagtgatctgtgcagataagattttggggaaaaaaaaaga

SEQ ID NO: 46023 - DNA, 405 bp, Zea mays
  Clone ID: LIB3066-006-Q1-K1-A5
cggacgcgtgggcgaactaatatatagataatcgaaatcgaaaagaactgtcttttgtgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaataatatcgattcatacagaggaaaaagttctctattgatgcaaacgctgtacctagaggatagggatagaggaagagggaaaaatcgaaatgaaattaattaag

SEQ ID NO: 46024 - DNA, 330 bp, Zea mays
  Clone ID: LIB3066-006-Q1-K1-A6
cccacgcgtccggagagagagagtgagagagtgagagaggcctcaccgcttcgacgtggattctgtagacgagctgcaggcgtcggcgctcgcggcatgacgcgcggtacgccatggcgaggtgggcgacggcgagcgcgagcgacatgaggaacatggcctcgacggcgacgagctggccgttgccccgccacacgggcgcggcgccgaagacggcgacggccttggcgaggacgtagcagacggaggcggcgctgcaggcgacggcgacccacctgtaggcggcgccgtcgacttcggccggggcgtacgcgcagaggatgatgaggg

SEQ ID NO: 46025 - DNA, 400 bp, Zea mays
  Clone ID: LIB3066-006-Q1-K1-A7
cccaacaccacctcgcctgcgatctccgtagcctccgtcgcgtcgagcatcgatcagggcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaagagggaggcgtcctccctggcatcaaggttgacaagggcaccattgaagttgttggcactgat

SEQ ID NO: 46026 - DNA, 373 bp, Zea mays
  Clone ID: LIB3066-006-Q1-K1-A8
ccgcgccatgacgatgacgatagccgccgtgctctgcctgctcctcttctctggcctgctcgccgcggcggagaagactttccgcggaggtggaggcggaggctacggcgggttggaggccggtggcggaggcggcggcggctattccaccccgagcgaggcggcgccatccacgcctgccgctggggagacgactaccccttcgtcaggcggcggttactccactcctagcgtggcggcgccatccacgcctgccgctgaggagacgacgacgactccttcgtcaggcggcgggggttacggcggtgcaaccggcaaggcttcctcaggcggcggctgactggaccccgacggtgacccaaaagttgggctg

SEQ ID NO: 46027 - DNA, 437 bp, Zea mays
  Clone ID: LIB3066-006-Q1-K1-A9
gggatcctagcaagagaccaaaggccgcagaagtcctccagcataccttttttcagggttggacatgtgttccacttcctgtccgtccaaaagcttcatcacttcctagaacacctccatgtgttggatcaaaaggaaattcagagaacagtgtggctagaagattctcaactggaactctatctacaatgaaatctcatagcaatgcatccgcaaaattaaatggtttatctaagactggtgtacaaagaaaacttaatttggatcgtcagccatcccaaaagggtatgaagccaaccgagactagtaataaactaactacgaatcgggtaccagctcggaatagcccagggaatcctgtacttaggcattcacggagcttgcctgaaactggccgaggagcaatacagaaggtctcatcaattacagagaaacta

SEQ ID NO: 46028 - DNA, 368 bp, Zea mays
  unsure at all n locations
  Clone ID: LIB3066-006-Q1-K1-B1
cccacgcgtccgcccacgcgtncgcggacgcgtgggctcgaccatccctgcaaattagggcgatggctcccaagatcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgttcttctcaattacttcgaccccatcaagctggacgagattaagacacgc

SEQ ID NO: 46029 - DNA, 436 bp, Zea mays
  Clone ID: LIB3066-006-Q1-K1-B10
acatacaggaaaagcaagcaagaatcatcggaataatggctcgtgcatgtgtgttgctcggggtgctcctcctggccgccatcgcggtggcaccgttcgcgggcgccgcacgcgtggacgtcgtggagggtaggtccatggcatccgccgatgcaccggaggcggcggccgatgctcccgctcctagccccgactccgcctcatccccagactcatcgtcagaggcgccctccagcagcagctcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattggttatttctttatttattatatgtctctctcgggtggtttttatttttc

SEQ ID NO: 46030 - DNA, 312 bp, Zea mays
  Clone ID: LIB3066-006-Q1-K1-B11
aaaaaaaaaaaaaaaaaaaaaaaataaaaaataaaaaaaaaaaaaaaatataaaaagaaaaagaaaaataataaaaaaaaaaaaaaaaaaaaaaaaaaaaaaaaaaaaaaaaaaaacaaaaaaaaaaattcggtaagggcccaattttaaaaatccaaatttaccatcccttttattaaaactataaattttttttttgggtacctctaattaaattacttggcccctaatttaaaatttatcaatttgtaaaacccttagattcccaaatttaattatcctttgaaataaatccctttttataaatttgac

SEQ ID NO: 46031 - DNA, 416 bp, Zea mays
  Clone ID: LIB3066-006-Q1-K1-B12
aaacaaaacaaaactggctctgaacaataagccctgaatcatggtcgcattcgctacaacaggtcccgcatcgatgcaacatgtcctgattcttaaaaggaacatgttgtcatccacacaactacaaatccgtactatgaaaatacatttctaattagaccgaggaaaccatgaagatggatggaagcagaacacccaaggagaccaaaagggagaccagcaaggcaggtccgttcgaggtggctgaagccgaaccagccggccggccgcctgaaccagtctgcggggtagcagccttggagcccgtccccgaaagcatgtctctgaaccagtacgccgagtccttggggtaccgcttcagcgtcgcgaagtcgacgtagacgatgccgaacttggacgtgtagcccgacagccac

SEQ ID NO: 46032 - DNA, 329 bp, Zea mays
  Clone ID: LIB3066-006-Q1-K1-B2
cgatcacaataagatggcgtgtatagacaatgcaatgagagccttgttccttttagcggtcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccattcaagtgaatggcaatc

SEQ ID NO: 46033 - DNA, 426 bp, Zea mays
  Clone ID: LIB3066-006-Q1-K1-B4
cggacgcgtgggtgcatgatcgcagacaactgcgccaatgtgtgccgcggtgagggctgcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgttcatgtatgctcaaggttcattatcttgttcatgtattaagtatgttatgaataactcaatatttattattttgttcatgtatgaattatcttctaatgagctcaaggttcattatcttgggcaaggactcaagggtcattattttattcatggatgccaggtattccaaaa

SEQ ID NO: 46034 - DNA, 395 bp, Zea mays
  Clone ID: LIB3066-005-Q1-K1-H9
atcacaataagatggcgtgtatagacaatgcaatgagagccttgttccttttagcgctcttgtgtggcgtgcatggtgagaaggcaaagtcaaaggacaacgatgcaaaagcgttcgggcccggtgggtccttcgacatcaccaagttgggcgcctgcggcaatggcaagacggatagcacgaaagctgtgcaggaggcgtgggcattaacgtgcggcggcaccgggaagcagacgatcctcatccccaagggcgacttcctcgtcggaccactcaacttcacaggcccatgcaagggcgacgtgaccatccaagtgaatggcaatctgctggcgaccacggacctaagccagtacaaggatcatggtaattggatcgagaatctacgcgtggac

SEQ ID NO: 46035 - DNA, 343 bp, Zea mays
  Clone ID: LIB3066-006-Q1-K1-B5
cggacgcgtgggcggacgcgtgggcggacgcgtgggcggacgcgtgggcggacgcgggggcagaatggcaaacatggaagcgacacaggcgcctacgacgctcaaggaaggttcgttcccgcgaagctggacgagatgttcaccaagcacgccaagaccgtaccgaacgctctgacgaaagacgagctcgacgagatgctcaaggataaccgggagaagatggacgtcgcaggatggctgggagccaagtcggagtgggagatgctgtacaagctagccaaggacaaggacggccgcctgtccaaggacaccgtcagggccgtgtacgacggatccctctttt

SEQ ID NO: 46036 - DNA, 307 bp, Zea mays
  Clone ID: LIB3066-005-Q1-K1-G3
cccacgcgtccgcccacgcgtccgcccacgcgtccgagtagaagagcctgtgaccgaggatgctggtgaccagcagatagaagtagctgagcaggagctcattgaaggagaagaacaggtggctcaggaggagcctcaaagcgaggagtttgatctgatctaggtggcgtttccccagttgacttttgcgccaaggatgatctttagttcgttttatatttatcttatattttgtaataagacttcctctatgtgataaatactttgatgatattgtgacatttatctctatacactctgttattat

SEQ ID NO: 46037 - DNA, 471 bp, Zea mays
  Clone ID: LIB3066-005-Q1-K1-G4
gacagacgtgcgcgcgggaaagtagtcaggagaggcgtttccctcgcaatcgaccatcacagatcaaatcgctgcgactagctagggtttcgtcgcctcatctctcgtcgatccatcgatggcgtccgagggcgacaacaagaggatgatcacgctcaggagctccgacttagaggagttcgaggtggaggaagcggtggccatggagtcgcagactctccgccacatgatcgaggacgactgcgccgacaacggcatcccgctccccaacgtcaactccaggatcctctctaaggtcatcgagtactgcaacagtcacgtccacgccgccgccaaacccgctgactccgctgcctccgagggcggcgaggacctcaagagctgggacgcgaagttcgtcaaggtggaccaggctacgctcttcgacctcatcctggctgccaactatctgaacatcaagggattgctgga

SEQ ID NO: 46038 - DNA, 463 bp, Zea mays
  Clone ID: LIB3066-005-Q1-K1-G5
ctctcttcttccccttcctcggcggctttccaccattcaggttcagactggaggggccttcgtgccaatctccagtgcgtgttcttcagtggaggcgccggccggactcgcgatggagcgggacggccagcagacccgccgcgacaagctcatcatcgatacggatcccggcatcgatgatagcatggctatcctaatggcgttcagagcacatactctggaaatcattgggctcacgaccatattcggcaacgtcgacacagaaggcgcaacatgtaatgcactattgctgtgtgagagagcaggacatcctgaggttccagtagcagagggcagccacgagcccctaaagggaggaaagccccgtattgctgattttgttcatgggtcagatggcattgggaatctgtttcttcctgcaccctctgctaagaaggttgaggaaagtgctgctgatttcatg

SEQ ID NO: 46039 - DNA, 159 bp, Zea mays
  Clone ID: LIB3066-005-Q1-K1-G7
caccgtttcagtaggttccattgttcatagtagcctgacatccttgtgctgcttcctgctctgtgagcccatttgttatttaattcattcaattagttgaaattatacgctgtcgcactggctgatcaatcatgttgtagaatggtccaggaacccttc

SEQ ID NO: 46040 - DNA, 458 bp, Zea mays
  Clone ID: LIB3066-005-Q1-K1-G8
gcgcgcgctcgtcgccggcgggtcgtgcgggcccccgaaggtgccacccggccccaacatcacgagccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaaaggtgcgatgcaagtacccc

SEQ ID NO: 46041 - DNA, 387 bp, Zea mays
  Clone ID: LIB3066-005-Q1-K1-G9
acgcccacgcgtccgcccacgcgtacggagctagctagccagccagccagcagccagcttgctgggcgcgcccgtccttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccagctccgggccccaccagcggctccttcgccgtcgcgcccgccgtcggcgccagcctcggggccgacgtcggcttcttcttcgcctactacattcagtgagccggccgcagccggtcgcccggaggccgaagaagagactaagccggagagaaagtgacatggctgcgcgca

SEQ ID NO: 46042 - DNA, 474 bp, Zea mays
  Clone ID: LIB3066-005-Q1-K1-H1
cccacgcgtccggtgatttgaaataattgggaataaatagttcgtgaatccctgaagcgtgcgatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgttcatgtatgctcaaggttcatta

SEQ ID NO: 46043 - DNA, 314 bp, Zea mays
  Clone ID: LIB3066-005-Q1-K1-H10
aaaaaaaaaaaataacaaaaatacacaaaattaaacttagacaacaaacaaaaaaacactatgctaagtcaaacatgcgcagacaagcacagtcaaaagacaaactatgcaaaaatgaactggccccgttgttccttccaacatcaccaacttgagctccttcgacaatagcaaaactcatagcacatccacttgccatgacgctacctcataatccaaccgagacacctggaaactcacgagcttcatactcaaactcaacatgctcgtatgaccactcatcttcacaggcctattcccggaaaacttcacca

SEQ ID NO: 46044 - DNA, 426 bp, Zea mays
  Clone ID: LIB3066-005-Q1-K1-H11
aaccgaccgattaacccaccaccgcctcgcctcgtctccgctctcttcctcggacaaagccggggccgttcggcgggaggcaggggacgcacgggcaggcagccatgaacggcatcaaccccaacggcgggttcctgtcgtacgggaacatggagagctacgcgatgtgggtggcgaccggcgtggcgtcggccttcttcgcgtccctcgagcgctgctcctgcatccacctccacaccgcggaggacgacggcgtcgaggaggaggaggacctcgaggaggcccgccgctccttctcccgcccgatccctgagtactactacgaccggtccggctcctccgactccgtcgccaagatgtgacctgaccgaaccgcgccttccttcggccaagaaatgcgtggtgatacgatcccgttcttgatct

SEQ ID NO: 46045 - DNA, 436 bp, Zea mays
  Clone ID: LIB3066-005-Q1-K1-H12
cgacaagatggcgtgcacagacaatgcgattagagccttgttcctcctggtcctcttctgcgtcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatacaggtggatggcaatctgctggcgaccacggacctaagccagtacaaggaacatggtaattggatcgagattctacgcgtggataacctggtcatcaccggcaagggaaaccttgaacggcaaggccca

SEQ ID NO: 46046 - DNA, 240 bp, Zea mays
  Clone ID: LIB3066-005-Q1-K1-H3
cccacgcgtccgcccacgcgtccgcaccaattccgacgagaaattaaaagcgctccaacttgatatctatctcaacgccaagatatacataatataaacaacacacaaattccatacagacctcattctgattatcctactcattatgcccactccatacaacacatacaatgcaataccacaattacacacctctatacctcttccactcatactcgacaccatctacaccaatgtata

SEQ ID NO: 46047 - DNA, 463 bp, Zea mays
  unsure at all n locations
  Clone ID: LIB3066-005-Q1-K1-H5
cggacgcgtgggcggacgcgtgggcggacgcgtgggcgcgaggataaggcgagatctcgagggcgtgcctaccgtccgtccgtccgtcctgttcttcgtcgtcgtcgtcgccctcagcagcagctcgctcgctttatccaccttgagtgacgagttaatgcctgagtgctgctgacctgaccaagtgaccaccataccatcctgctcctttggacctttgcgcgcgcggaggacagttggtgctggcacgcacggcaaccatgcacgacgacacagcggcaggcttgtttgcgatcgtggcgtggctgtacaccgccacggagcgaggtgagcacgggtggctggcagcgtacgtcaggcccgggtcgtgctgtacggngcggctctgtacactgttggcgagtcgtccatgttttccgtgcacgagatctttgatatatgccgcacgtacagtcgtgggtgc

SEQ ID NO: 46048 - DNA, 465 bp, Zea mays
  Clone ID: LIB3066-005-Q1-K1-H7
gtggaggacttaataccaaaagcagttatgcatttcttggttaatcatacaaaaagggcgctgcataattaccttataacaaaactttatagagatgatcttttggaagacttgctcaaagaacctgatgagataaccataaagaggaagcagatacgtgaaaatctcaaggtccttcaacaagcttacaaaactttggacgagataccacttgacgcagaggcagtagagaggggtggatactccctggattctgatgcgattggtctgccaagggcccatgggctttcttcatccctccacggattcaacgatggaagctcaccatattcaaccccgaagcagtcaaggtcaaggaggtcaaaccattctggcgagcagcttcctttcaaccccaatatgagtggcaatggtttttgatgccacccttctacgttacaagacggccaaccagattggttatgg

SEQ ID NO: 46049 - DNA, 471 bp, Zea mays
  Clone ID: LIB3066-005-Q1-K1-G2
cgcgtccgcacacgcgtgcgcggacgcgtggtcggactcttgatcagacgcgtgctcggacgcgtgttgccgtgcttacatgagtctaagcgatcttcatccacccttctgctctgctccctcgaaatggaggccacgagcaacgcgatggcttcaggcctcctccttctgctgcttctcatcaacacaggctttgtcctgcccatccattccgaggactgctgggccaacacccgcgtcatctgcaccatcacgcacaactgccgcaacgacacttgctcggagcgcagcatgcctcacttccgctgccactgtgagttacccaacctgaagcccttctgacagtgcctgcgccccaactgccactagtccggtcgcctcgtattggctcacttctccagcgatcatggatggagcccaactgctactgcccaatctgcttcattctttaatgtttaaggcattctttat

SEQ ID NO: 46050 - DNA, 262 bp, Zea mays
  Clone ID: LIB3066-032-Q1-E1-C1
gcttggaactttgggctgatttatgtgcttgttcgcgctggccctgggcataggcatttccccgccgaaggctgcctgagtccccttcgggagcacggtacgggccatacatcctagtgttgcagtgttcggcacgagttctgcggagaagtaacggtcagcttatggggtctacatcctagtgtcgtagtgtccggcatctggattctggtctgaggtacccctctcattttcctccatttcgaaaaagtagggctattcc

SEQ ID NO: 46051 - DNA, 495 bp, Zea mays
  unsure at all n locations
  Clone ID: LIB3066-032-Q1-E1-C10
tggcttggaacctttgggctgatttatgtgcttgggatctcgtagatagctcgcctggaagttccctaaattggaatattttttagtagagcgtttggaagaaactcacggatgctccgaagagaaggtccaaggaccccagtcaaggaacaaaccgtcggtatcagtacacagcactcactccccagaccctaatccttctgatcatcccctcaggcaggctgacccgctcccgcaggcgaagcgctgacccgctcgcgagagcgagattatacgaagtcagagagagaagacgttaacaagtcacctaggtcgttgtcgtcctgcgtccttgccttatcggttgggcggtccgaccgcccacgtagatccggtcaacaagtcacctagagtcagtttcntaacccgtccaagatagcgattcgngtgcgagaagggaaggaagatggtagtacacttgatagtgatgccctctgatgtcacgtcgtccatgac

SEQ ID NO: 46052 - DNA, 301 bp, Zea mays
  Clone ID: LIB3066-032-Q1-E1-C11
ctttgggctgatttatgtgcttgtggatgtgcgggcgaggacacgaagaccatgcgaaagaatcctacgtacgtctcgaggggttgagcacctcagccagaagacggtgtgcactgatgtcatagactcgctcgactctccggttcctgatctagactcacatgcggagacgcgtagggcgcactcatatacttcgtcgaagaatcctgcccgcaaggccgagatcatcccatgggctagatcccgccgtctatcgcgactgctcgatatccgtgtatccccagcctgccgacgcagccgt

SEQ ID NO: 46053 - DNA, 487 bp, Zea mays
  Clone ID: LIB3066-032-Q1-E1-C2
cttggaacctttgggctgatttatgtgcttgtttatgtgcttgtttatgtgcttgtggatgtgcgggactcaaagcctaatgtttgtattgtaagtgtaatatgttaatatttgagatttgatgtggttcctgttcctttcttgtgtgagggagacctgaggggagagaggcctctattcctgtgttcgtggccgtccggtgtagagctgctgtagacggattggcattagagggcggagaagttgtgggaggagcttttcactggtgttaatgagacttgtactatggtgtacggttggttttgtaatcatactattcacgtgtctgtttcgtcttaggataacgtaatagacgataccgctactaaggttacgggaagggtgactaataagatagccgttactgcggagtcctccaagagaaggaccgtcggctcttactagaacattctcaccgaacttaccgacacaatagatatccgggagt

SEQ ID NO: 46054 - DNA, 427 bp, Zea mays
  Clone ID: LIB3066-032-Q1-E1-C3
gaacctttgggctgatttatgtgcctgcttatgtgcctggttatgtgcttggctagcaaataggtaaacggtttaacgcttgattacggccgcagttgcatctgcggacgtcactgaggacctgatgaccttagatcgtgttgacgttaattcggaattcgtatgcagtctcattgcgggtagtgtttgcattcctggttcctacaaggcagagatttgaagtcatgagaaattagtcatttctgtcggactctccggcctaggtgagaacgttactcataggccaatgacccgcaggaacttcgtccctgatggcacgaaaataacggggacgcgtcgaataactaactctacttttaggcgatagtaccgagctctttatatggacgccattgggcacagacggataccgtccgccttacagtct

SEQ ID NO: 46055 - DNA, 498 bp, Zea mays
  Clone ID: LIB3066-032-Q1-E1-C4
cttggaactttgggctgatttatgtgcttgtttatgtgcttgcttatgtgcttcgttattattgttctgttctgctcttgtctctccttctggataaagttggggttgcctggtgggaggtaggggatgtatgggtaggtagttacgaatggtactaattttaatggtgggccttcgctgcatgggaatacggagagtcatgtgacgcgggcggtgattggtgcggtgctggttcctcctgtgctttctgagtgtcgtcttcgtacttattcctatattgtggaggatgatggtgctgaggaggaggaggattctgaggaggtttgttgtcttcctctttgtttgactttcgagcatcatcatgattggcttggtcttcttgttcctgctgttaagacgcgattcgattgaattgtgttccttcttgcttaagaaacgtgcggcgacatgacttgccctcggactcaccacgcgtctccgtccgacctgccgagctct

SEQ ID NO: 46056 - DNA, 474 bp, Zea mays
  Clone ID: LIB3066-032-Q1-E1-C5
tggcttggaacctttgggctgatttatgtgcttgtggatgtgcgggtaaactcctggtccgccttctttcgcctcgaacgaaagccgtagatcgccagaacgtctaacgtgttccatacctaaaccctaaggttcgaccgaggccgaaacaaacatccgaaggttagactcgccttccacgcagtccgtccttttctgctcaggggtggagggagtcctcagccaggaacgtcggaccagcccgagaagccgtagatcgccagaacgtctaacgttcagcctcagctgtgagtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccctgttagtcggtgcaacagtg

SEQ ID NO: 46057 - DNA, 474 bp, Zea mays
  Clone ID: LIB3066-032-Q1-E1-C6
tggcttggaacctttgggctgatttatgtgcttgggtcgttgctttctgtggagggggtggagtttggggatgtgttcgagcttaaggagcctgttgtggtgttgggtagtgtgaagtttgttgttagtgttgggcgtggtaatgatgttaagagagttgttgcgccttggagttatgagagtggtcttggaagtagtcttagtaatcctcttcctgttcctttaacatcggtggagatgctgttgaggaagaaggattctgctaatattgtgtcgcattagttgtcggagaaggagcgtgaatagttgttgctgctgttgctgttgtagtagtagtagtctgagttttttgcgctggttcctacggagacgatgatggaggaggagtggtggagtagtgatattgggcgtcgtcgtcgtggtcgtcgtcggcctgaccgtcttcggcggcattggcgttagcggcggtgacgt

SEQ ID NO: 46058 - DNA, 402 bp, Zea mays
  Clone ID: LIB3066-032-Q1-E1-C7
gcttggaacctttgggctgatttatgtgcttcgttatgtgcttgtatgttcagtcctctcccttaaaagtacggtgcctatcgtttctctaccgtcacattattctctgactatcgcactgtccgcttcagtctgcggtaccactacagttggcgccgccgatacagtcttatgctttatcttctcattctccttcttgtagttatcctccgtatttctcttgatcttctgcttcttaggctccggggttttcatctgtatcttcttctccttctccttctccttccttttcaggttattatgtatcttgttcataatgatcttctccttatgcttacggccgggggtattcctcttcgtttgcgccttctgcttcttatggtctggagtatttttctgcat

SEQ ID NO: 46059 - DNA, 507 bp, Zea mays
  unsure at all n locations
  Clone ID: LIB3066-032-Q1-E1-C8
tggcttggaacctttgggctgatttatgtgcttgtgccccctacttgttcctgttcttaattgtgcgtgtcttatgttcttcttaggaaagtgagagtcctcgtacaagaataataaactaaaagtgcgactagtctggcgttaataaaattctaataattaagccctacgctcgactctgatgcttagtccttactcgttcccgacttgcccgtcgaggtaaacgtcgaggatctcggcgtcggcttcggaatgaaggaccacgcgtacgcgtgtacttagtagtgtaatggtagaaagagctcgatcatagcttagggctcgaagaaagagcctagtcacaataagacttctaaggactcgaagaaggaacctcgtcgtaacggcatcgcagcctaggatttagagtcaggttaggctacctagtcttaaggcgactagtgtangaacgccgtcatcccttcagcctaagtcgggaacgtgaagaaggagaatactaagacctat

SEQ ID NO: 46060 - DNA, 464 bp, Zea mays
  Clone ID: LIB3066-032-Q1-E1-C9
tggcttggaacctttgggctgatttatgtgcttgtttatgtgcctggaaagaatctgaactaacaaataggtagcacttacccgaattctcgaggcgctcagataaaattccgaagtcgatccacgaagaaggaacctaaacgccgaaggaagttggaatagaaactgagttcacgggcgattctaacattgaagtcgagaaaaaatccggctggtccgctagggaaaagcacgatatagacccccctacttcgcactggcacttcccggtcgcatgcttgcctcatattacgttccgccacgataatttagtgcatattaacctccccgacgctcctacctgaggtgaggagacaacactcggagtataaaggacatatatcttcgagtcgtcggttaaatgtgtgatagaacgcggaactgatgcgagtatcactctggttcataccgaacttcctagtcac

SEQ ID NO: 46061 - DNA, 172 bp, Zea mays
  Clone ID: LIB3066-032-Q1-E1-D1
cccccaaccccccaacctaccaaaaggccccaaggggcgcgatattattttaaacacggaacaactaacgaactcttcacgtacctttaacccaactacggttttaccccaaaacgaccttccacccccaaggaccacttaaacacacgacatatacggaccaacctcacgg

SEQ ID NO: 46062 - DNA, 390 bp, Zea mays
  Clone ID: LIB3066-032-Q1-E1-D10
tggcttggaacctttgggctgatttatgtgcttgtttatgtgcttggctatatactcgcctaaatcggtctgtgaatacgttttccataccatgtgcagcgactaaaccgacctcccacgtcgataatgcggcgaatgctatgaaaggggagtacgcaagaggaccaggatcgaatcctgccgagtaaacgtagggggtcggattacaacgatgacaaagacgctgactccagtcgatatgaacatgttacacgtcgcggattaggtcgcgtcgagagaatacgctaagtccactcatgccatgacattcgatatgaacgtgaggtagtacacgtccaatgcgtacgactttgacatatcatatagtccagtcgattgtgacctatagag

SEQ ID NO: 46063 - DNA, 490 bp, Zea mays
  Clone ID: LIB3066-032-Q1-E1-D11
tggcttggaacctttgggctgatttatgtgcttgtaggccgtcccctccaaactaagaaaacgccccgctaagacagtcacatagctcggacgcttcccagctttagcccctcgtcccgggtagagtcacgtacataagcggcggaggttcggcggcaaaccgcccactaagactgtcagagtagccaaacccatcttcaccactcctcgggacagacccggtatattaccttttcctttaaaatttacgtacgcggctgcgggcaaattaaccgaagctaacaagaccttttacttcataaccgatgagataaccgtaatagcacgtacgcctccggtgggaaaagccgaagaaatatttagattctcgaaggacgctacaatctccctacacgagactaccttataaaaaggacttcgtcgtagcctaatgaaccacatagaatgaagcccacgaataataaagggaatcaaccccatctggggaatg

SEQ ID NO: 46064 - DNA, 483 bp, Zea mays
  Clone ID: LIB3066-032-Q1-E1-B9
tggcttggaacctttgggctgatttatgtgcttggtaagcattttgtcgggtagaagactgcgccttatactgagaagggtcgtaattttaatcatgcggttgcgtcggcgaagcccgcggtggatgacggtgatactgcgtcgacggaaacttaggataagccgctggtcgagcggaagtttacgaagtctctccggggtgttactcggaggacggatatcgttaaggtgtctaagggttttcctctcacttgttctattagtgagcttggtaagaaggctactgtcaaagatactactttggtgaatcggagatttgacgttgctcatatccttaatgcttaacctcatcagatcccgaaccgttcctgacctacttggtgtggtgggtcacggattcgtagtagtaagtcaaccaagccggttgacacacacacaacacacaacggaagtttcgggtcccgaccaccggggaagttttta

SEQ ID NO: 46065 - DNA, 328 bp, Zea mays
  Clone ID: LIB3066-032-Q1-E1-A3
tggcttggaacctttgggctgatttatgtgcttgcctatgtacatgcatttgtgtcacacggggaaattacagtcttcggctgtcataaggcatcaataactcgctcttgcttgccacgatcgtttacttattgatatatcggattgaatgacctagacatatacgaaactccctctcttcgtatggccgacggagttgcactgcacgtcactgctagatattagcgagtcattaaaactacggggaaggagatcgtctagcggattattctctgactcgtgattgtccccggttgaatcggctgtgtcgacgagcgtatacgtgctc

SEQ ID NO: 46066 - DNA, 514 bp, Zea mays
  Clone ID: LIB3066-032-Q1-E1-A4
cttggcttggaacctttgggctgatttatgtgcttgtttatgtgcttgcttatgtgcttgtttatgtgcttgtttatgtgcttgtccaccccgtgattgactttacctttatgtaaaggtattgagtgcgactcttgcttgcgttgttacggttctgtattgggtgtcgtcgtcgtcgtcttctgttgttgtgtctgctgtcgtgtcggttgtcgctgtacttgttgatgatgttaatgttaagtttattacttcgatttttgcggtgtacattttgtcggggcttcctgatggtgataagttggttctcgatgatgatgttgctgatgatgatgaggatgttgctttcgctggtgtgtttaatggggttattacgatcgagtttagggatgatgcttttgctttgtttggtgttgaagtaattgtgggtggtgttgctgctagtaatgtgtttgctgtatctgttagtgttgtggtgtgtgctcgtgttgctgctgtggctgttgtgggagtt

SEQ ID NO: 46067 - DNA, 505 bp, Zea mays
  Clone ID: LIB3066-032-Q1-E1-A5
ggcttggaacctttgggctgatttatgtgcttgtggatgtgcgggtggatgtgcgggtccggaagtgagggaggagagcggagggagagggaggagtgaggtattggcgagcctgggaggtggtgcggggtccgtatgttggtttcatttttagtctatctattatgtctccgctcgattaatctctctctctctccactcttccttaagacctttttacccccccgccgccgctttttttacctccgtcaggactaccttccgactccctgtctgtcttagcatgttcgccccttagtcttggagactttactctggttattcttcgtggctcgtaagtcttaagaggttagaccttagtatagacccgaggctaacccgtttgtcgagtctgaactaacttgtctggtaataagcgctacccgcctttttgacttttgggtcctgacctgactgaacttgattcaaccgcaccgtgcgcgcgcgcgcccaattcctctctgtc

SEQ ID NO: 46068 - DNA, 503 bp, Zea mays
  Clone ID: LIB3066-032-Q1-E1-A6
cttggcttggaacctttgggctgatttatgtgcttgcggatgtgcgggtggatgtgcgggtggatgtgcgggtgaggagtataagctcacgcgtcatagttcctgcgcttacgcgtcatttcctcctaggcctcatagaggagtatagggatgatctcgtagtcctagtcgcataaatgtaatcaccaagaagcctaaggacgtatccgtgaagtataagttagacagacgcagtcccggtttaatttgggggtcagatgaactggagccaccagttccggtagtaaataaggaatcgtagcctattcatattagggagttagaatcgatctttaggggagacatttttggggaggctaccgtctttgagtttgtaaagtccttcgttgtcataaagttcccggctaagtcggggctggaggaaaggctaccggctctcttaggaagacgagatggcttgacgtccttgcctcgcacagccttacggcctcggacgcgcatag

SEQ ID NO: 46069 - DNA, 407 bp, Zea mays
  Clone ID: LIB3066-032-Q1-E1-A7
tgcttggaacctttgggctgatttatgtgcttgtcaactaaacctccgccgggacacaccttcttaaccttttcttcatctttaataaggtaataataactcgccttggttgttaaataaaattaaaaaaaaaatatatcgaatttaacaacttgactttatagaaatcccctctctggcttgcctgactgactgtcgttgcgctgcccgttacatattactagtatttaaaattacggttcgtaattcggtctagcgtgttattgctgctgtggtgattgctgtgttttgtattttctgtttcgtcgtgcttgtgcttgctcttcctcatgtgaggaagttggtgggtggtagttcgtggtcgtagtggtaggtgcgtcgtcagttgctggcggtgttgctgtggg

SEQ ID NO: 46070 - DNA, 416 bp, Zea mays
  Clone ID: LIB3066-032-Q1-E1-A8
ggcttggaacgtttgggctgctttatgtgcttgtttatgtgcttggcctcagactgcgagtggttgattccctccgcccccccctgggataagggtttaataacacggctagcgtaccaacacacacagtggtgcaaataggcgtgactgctggagagcctatacgaactaatactgtaacatctatatatatatcgctctaatcggtgatcggtgcgtgcgaagtgactaaaatcgatttacgacggaaacatcggcaataccaatgcctaataagtgacgaatcgacagacaccacgacgcactatcgtgggattggaggaaggaatatgtgtgtaggtggtttcgtagatggaggagtctacgcgaagaggcatttaatcgtggttatactcagtgcgtctcgaaagagtgtt

SEQ ID NO: 46071 - DNA, 230 bp, Zea mays
  Clone ID: LIB3066-032-Q1-E1-B1
tggcttggaacctttgggctgatttatgtgcttggaagaagagaaactccgggtttgagtagatcgaaacgtttgagggaaaaatttaagataacggttttccttaagtatgtccactaaattactaatttcaatacaccaagggatcgattcaacctatattttgaaaccaattggccggaaggaactgcctaccttttgggttaagctgtaatttagtaccccttgga

SEQ ID NO: 46072 - DNA, 425 bp, Zea mays
  Clone ID: LIB3066-032-Q1-E1-B10
tggcttggaacctttgggctgatttatgtgcttgtttatgtgcttgaaacccaattccgcaacgtagtactcgagcctctccctttaaaatgcgcgtgtcgacacacttccacgttccgacagcgtctcctggcggccaccgagcctctctagtacgccaaaaaaaaaaacgaaaaagggtggttgtctcagaggacttaagtccatgcatgtgcgtacgtcatgctacagtctcctcacagcgctattcaaacctaacctatcggttgctgccccataatgcttagatcgggaaaatttcggtgccatttaatccaactgttccgtaatatactttttccctgctagtcggtgctacagtaaagaggcttgtattgactgtttcccttaatagccgtgtcattcgaacggtgaacgggatctgt

SEQ ID NO: 46073 - DNA, 344 bp, Zea mays
  Clone ID: LIB3066-032-Q1-E1-B11
tggaactttgggctagatttagtgcatgttcacactttcctgttattactatacctagttagttaatacacacgctgtgtgctatagtcgtggcgtctccacatacttctgttgccgtcgtttctagtgtggataaagttttggtagagctattgaaggaaggtagcgtcgttaaggtattcgagctcgataagagaatcgtcgtttttgtcgaagtatttgaagttgtacctatatatgctgctgttgtcgttttactgttggtgcacacgaagctcggcgtagtcattgagttagttattgttcacatatttttcgaccttatggatgaggagccgagtttc

SEQ ID NO: 46074 - DNA, 501 bp, Zea mays
  unsure at all n locations
  Clone ID: LIB3066-032-Q1-E1-B2
ttgcttggaaccttgggctgatttatgtgcctgtggatgtgcgggtggatgtgcgggtggatgtgcgggtggatgtgcgggtggatgtgcgggtggatgtgcgggtggatgtgcgggtggatgtgcggggtgtatattattgtacggaaccgtctctgatgtttgaccgagttgagtgacgcgagagaccgggagattacgtttctcttttgttattacggacctttgttcgcgcggttaatcgggtatcggaggacggtcccggtgtcctattggctaatcgggactacgtttagggtttgcgggacgacgtgagcccggtcgggagaacggagtcttgttgtagggttgtacgttgctgcgatcagttacgttattgntccttttgtcgtgtgaggatctgcgctactcgaaaagtaagccggcattcggacctctaagcgttaggagaagaataggcggcctaggaggagttataaggtgaggagcacgactcgactc

SEQ ID NO: 46075 - DNA, 326 bp, Zea mays
  Clone ID: LIB3066-032-Q1-E1-B3
tttgggctgatttatgtgcctgtggatctgcgggtggatctgcgggtggatctgcgggaaaaaatacaaatagatataaaaatgggatatacggataaatatacgggatagatctacggaatgtatattaaatgtacggaaccgtctctgatgtttgaccgacttgagtgacgcgagagacctgcagattacgtttcactttagttattaccgacctttgttcgcgcggttaatcgggtatcgcaggacggtccccgtgtcctattggctaatcgggactacgtttagagttttcgggacgacattagccccctcggtagaacgga

SEQ ID NO: 46076 - DNA, 503 bp, Zea mays
  Clone ID: LIB3066-032-Q1-E1-B4
tggcttggaacctttgggctgatttatgtgcttgaataatcccgtgctcctttgaactggggttcttattactcttaatcgtaattttattttacattgttgttgttcttgtcagggccccggagcgaggactgttgacgctgatggtctttaggtgttttccttgaggttgtggtgttttgtttttcggtattggtcatgcctgttgtggttttgttttcgttttaggttttgttgatcgtgttaagatttcgtgtaagtttgctcctattattgctgattagtcgtgtttttagatgtatggctatatttctattgcttgtgctactcttgtttgtattgcttctgataagtttcctatgtatactggttgtatttgtgctgtagagcgttctgctggagatagtattggtattgcttctgctattgcttgtaatgaataggccgattcctcgaagttagacataatagcgactccttgtaatgtcaagaccgatacgcct

SEQ ID NO: 46077 - DNA, 487 bp, Zea mays
  Clone ID: LIB3066-032-Q1-E1-B5
tggcttggaacctttgggctgatttatgtgcttgtggatgtgcgggtaagtgagaagtgattgatctttgttgttgccgttagttacggatggtggcgatgattctgttgtttcgtatgagtaggctgtttctgtacctcttgttgttactctggttcttgattctgattccgttccttagtcttaggctgttgaggttacttaagttctttctggtccgtttaacgttgttgttttgctactactgctgtaagttgttttagagctacttcttgatgttattcatgttcctgttgcttaggttgttgactctgtgtgtgtagaggaggattgttgtgatgttgaggttcgttgagttgctaatgtttgagttgctgctaatgtttgtgctgctgtgtatgatgtttctcctgtttgtgattctgtcgttacttttgaggaatagcgggattatgatggtgatcatcctgagtgttttgctgagctt

SEQ ID NO: 46078 - DNA, 227 bp, Zea mays
  Clone ID: LIB3066-032-Q1-E1-B6
gcttggaccttgggctgattagtgctgagttggggtgcgtggactgcggttgctcctggggttgtgtagtgcggggggttgggacatgacgagggagtctgtcagcgatgtagtccactgtgcggcgtcgtcccggtggggttgaactgctatgttgttgctcaatcggtatgtctcgcggtcattgagattgtttcggcgctgcgctaccgtagtagaatgtgtgg

SEQ ID NO: 46079 - DNA, 505 bp, Zea mays
  Clone ID: LIB3066-032-Q1-E1-B8
gcttggaacctttgggctgatttatgtgcttggcatggctcgccggaacggaccaggcgcggtcagccccggcccggcgtacttctgcacgcgtccccgtaggaagacccctgcagggggcgcagtccgggagataatcgaagaaatacctataaagtacccctagaagcacggagtcacaatcgacctcgcgactacgaaggataagtacatcaggacgttctgtggacccggacccgccataccccttgacttactcgcgtccgatagggcctcagaggacgaatacgctacagacggaagaatagccgaagctaaaaggatcgccttaaaagaggaaacgctactgaaagatggcttcaagataaaaaagactcccgcgggcggcaccttattactctccattgaagacaaaccaaaggagtatcctctactgcacgggaaggcggccgagtactagaccacgtccgattacagtatcggatgtctatgcggtcccggaccc

SEQ ID NO: 46080 - DNA, 504 bp, Zea mays
  Clone ID: LIB3066-032-Q1-E1-A2
tggcttggaacctttgggctgatttatgtgcttgtttatgtgcttgtgtttgcgcattagggttatggtgatgcggatgcgcggctgtttgcgtctcttggttttggtgcttttcctgtgtttcattctgttgatgtgtcttgttaggatcgttaggtgggtcattctgcttcttaggctaaggctgatggttgtgcgtggcggaaggctggtagtcggactcttggttatcattattctcctgctattcgttttgtgccttctgctattgttggtggtaatggtgtttttggtgtccttgggcctaggccttagattattatgcatcgttatgctgaggcccaaccaggagtgagaggaagtagagattacggtcattctctcagtcgtcgtcttcgttgccgttcggcgcggcaacaatctctctcactctctctctctctctcgcttgtcgtcggtgccatcatcgtagcagcgtagcgacgtgggacgcaaaggaggggc

SEQ ID NO: 46081 - DNA, 236 bp, Zea mays
  Clone ID: LIB3066-031-Q1-K1-G5
gcagaaggtcatggacactggcctggtgtataacatgacggacatggtttacgtgccggacgtgttccggctcaagtacacggtcgactaggcgagcacgatcatgtacacgaagatgtccgtgtagtgcgccaagctgtgaacgcttgtacaggaggaccttaactaccagttcatcaacgtcatcctcaaccagatggacttcaacgcgactgtcaaccggaacgtcaataacg

SEQ ID NO: 46082 - DNA, 443 bp, Zea mays
  Clone ID: LIB3066-031-Q1-K1-G6
agttccctcccttattacaatcttcctcagtgccgccgctcccagacaccgagcccgactggccaaccccgatccggcgatccgtctccttcttttcctcctttctgccgtccccgatcactcgcaaccatggcggcggcagcaggcggaggcgcggtgcgtgctctgtcccagaaggagcaggacatacagatgatgctcgccgccgacgtccaccttggcaccaagaactgcgatttccagacggagcgctatgtctttaagcgccgttccgacggcatctacatcatcaatcttggcaagacatgggataaactccagcttgcagcgagggttatcgttgccatcgagaacccgcaggacatcatcgtccagtctgcccgcccatatggccagcgtgctgtcctcaagttcgctcagtacactggcgcccatgccatcgc

SEQ ID NO: 46083 - DNA, 273 bp, Zea mays
  Clone ID: LIB3066-031-Q1-K1-G7
agaccccagccagtcgatcgttcaagaaaaataccagcttaccaacaacagcagcagcaaggccacccgttcgacgacatggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgctgtgggcgagtgcgacgtggacgaggcg

SEQ ID NO: 46084 - DNA, 346 bp, Zea mays
  Clone ID: LIB3066-031-Q1-K1-G8
cccacgcgtccgcccacgcgtgcgaccacgcgtccgcccacgcgtccgcggacgcgtgggctggcagcagcgcaagctcatggccgactccgcggctgaagccacgtacaagcatgacccggtcgaggtcgccaaccaacttaaccgtgcagtccacagatccgtcgagaaggaggacattggcacgaggcgggagatgatggggacgacgactaggaagtctaagttcagcgggccgtgcagggcgacgaacccgatcgaccggcgctggcagtgccggcaggactgcgcgacggaccggaagcgcctggcgcggtgcgccaaggcgttctggcgcaacatcacc

SEQ ID NO: 46085 - DNA, 271 bp, Zea mays
  Clone ID: LIB3066-031-Q1-K1-G9
cccacgcgtccgcccacgcgtacgcccacgtttccgcccacgcgtccgaaaaaaaaaaaaagaaaaaagtaaaaaaaaaaaaaaaaaaaaaaaaaaaaaaaaaaaaaaaaaaaaaaataaaaaaaatgaaaaaaaaaataaaaaagaacagcctttttaaaggactaaatttaatgaaattttcattcaaaggacataatattaatttagggccgcctaaattcaattaagttacctagattaaaaaactctttcattgtaaataatctgg

SEQ ID NO: 46086 - DNA, 387 bp, Zea mays
  Clone ID: LIB3066-031-Q1-K1-H10
gtccgaggccgcgtcccgcgagaaggtccatttctccatctccaagtggacggatggcaaacaggagaagcccactgtccgcacagaatccgatgaataaagctctggtgccatagtggcatagtccttgctacagatgatttgaagtgttgttgcaagtttccggaacatgctatttagctggcttgattttatagtcaatgctgaataataaatactttttacgacaattgtctttttcgttgctaattgcactcgccctacctgaatcagtcatgtgaacatcatggaatgcttcagttttgtacaaactaaatttggtgtgctgtccgacagattctatgtctgggccttaaaaataaaagaataatgaatggaatggttttg

SEQ ID NO: 46087 - DNA, 322 bp, Zea mays
  unsure at all n locations
  Clone ID: LIB3066-031-Q1-K1-H11
ctccggcctccagcttttcctttgcgccccagggccggaagagcccacacaccaccaccacgactagatagccagcgacgatcgagccgcgcgccggtggacgcgcacatacacgcggtagcttccttctcaagcctagctagccccatcctgcgcgcaggcggcggcagcgagaattgacgtgcgacgacgagcttgtgcttgctagctagagagcgaggatgtcgagccggaggccgtcgtcgcgtggcaacatctncgaagacgagatcaacgagctcaatctccagcttgaaggccttggtcccagcttccggcggcg

SEQ ID NO: 46088 - DNA, 293 bp, Zea mays
  Clone ID: LIB3066-031-Q1-K1-H12
cccacgcgtccgagcaacccaatccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccg

SEQ ID NO: 46089 - DNA, 377 bp, Zea mays
  Clone ID: LIB3066-031-Q1-K1-H2
cccacgcgtccggagaccagcagcagggaacatcgtccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaagccggcaacaagaacatgcacg

SEQ ID NO: 46090 - DNA, 320 bp, Zea mays
  Clone ID: LIB3066-031-Q1-K1-H3
cccacgcgtccgcccacgcgtccgggccgagccgaacgggcgtgcgccatgcgcatgcgacgctgacgagcaacgacaaccacagagcccaaccggaaggaggatcggtaccagctcacggcggcgccagcaccacacgccgccggcgtcgacgcccacccccctcccgacaggcacgcttcttgcgcctcttgtgggatgctactacggataacgtacgcccaacccacgccttcggcggcggcccagttgaggctccctgggccgcgtttacgccgacgccgcgtcgctgccttcgcagcggacggcgccggcaattc

SEQ ID NO: 46091 - DNA, 290 bp, Zea mays
  Clone ID: LIB3066-031-Q1-K1-H5
atcacgacaagatggcgtgcacagacaatgcgatgagagccttgttcctcctggtggtctggtgcatcgtgcatggtgagaaggaagagtcaaagggcatcgatgcgaaagcgtccgggcctggtgggttcttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaagccct

SEQ ID NO: 46092 - DNA, 280 bp, Zea mays
  Clone ID: LIB3066-031-Q1-K1-H6
accgaatccccagaccaaatcgccgtcgccgtcgccgtcgcatcgcagcagcgggagtccgagggtcccggaccgaatccatttccagacacccaaggccaagatccatcgctcgttccaaccagccttcttcttcttctgcttggtcgtctgatctcgttttccattcgtgtccaatccgatccagccaaccgctgtgaatgatggcgctcaacctgtcccaccagaccggcgcggtcgtggcggccgcaccggcggcgccacgcgcggccgtcgtcgc

SEQ ID NO: 46093 - DNA, 289 bp, Zea mays
  Clone ID: LIB3066-031-Q1-K1-H7
cccacgcgtccgcccacgcgtccgcccacgcttacgcgcttccttcttcccccttcgtcgggctatataagtgtccagctgttgcatcttaagttcgtcgttagtttcgccatcagcgtctagccaaaagcatcgtcgtggtgaaaaagggagtcggggaggtagtgaattacgtcgtcgtcggtgatctgcgtcggtgccagattgtcgtgctcggtgtttggctgataggggtcaccatcgtccgcggaagccgttcatggctgtggttggagtcaagtgcctatgt

SEQ ID NO: 46094 - DNA, 287 bp, Zea mays
  unsure at all n locations
  Clone ID: LIB3066-031-Q1-K1-H8
ggcggccccgccatcggcccggccaaggacacgctgggccggcggtgggagaccgacgccgcgtacgtgcagtccaaggaggcggtgaaggacgtgtcggtgcccaccagcaccatcaggttccccgacgggacgtcccggctggtggcgccggcgctggtgtacgccagcgctgccaggatggcggacgccgacgtggggagccccaacttcaacctgacgtggaaggtggacgtggacccgtccttcagctacctggtccgnctcttcttcgccgacatcgtgag

SEQ ID NO: 46095 - DNA, 229 bp, Zea mays
  Clone ID: LIB3066-031-Q1-K1-H9
cccacgcgtccgcaggatgaggcacatggatgatgctgcgatgtgttcatgagaggtctaggccgtcgtctcccagtcaactttgggttgctggaccgttgtctccttataatgtaattatttatttattttgtatagaactcctgctatgaagtaaagatgtgacattcgatccaaaaaaaaaaaaataataaaaaaaaaaaaatatactaaatatttaatatgtttt

SEQ ID NO: 46096 - DNA, 448 bp, Zea mays
  Clone ID: LIB3066-032-Q1-E1-A1
cttggaaccttgggctgatttatgtgcttgtttatgtgcttgcttatgtgcttgcttatgtgcttgtttatgtgcttgtttatgtgcttgtggatgtgctgtggttggttctgttctatatctttgtttgctcttggtgacctacttatttaacaaagcacttaatttcaatgacttggactgttccattttgtgctacttatgtgaaccgacctgaccacttctggaccccttttgcccccccgcgggcccttcactcctcctgactggagcgtcagggcccgggtgtgtctggcgggtggtgcatcttagggctactgccagccggatgggtcagggcgtccctctattggtggaagggaagtgaacttaaatgacggagaagaagaaggcggtgactttgtcggcgcgttatggctatctgtggttggcggcggactctcctcat

SEQ ID NO: 46097 - DNA, 487 bp, Zea mays
  Clone ID: LIB3066-032-Q1-E1-A10
ggcttggaacctttgggctgatttatgtgcttgaatcgggtcctgttctcgtcgagagataagaggaggcctgcgaagtcggttgatttgccgtcgggtaataggcatttagcgaaggtgtcgcattaggtgtctgttgctgtgcttacgcgttcgtaggaggatgtcgttagttggttggggactagtgatgctgctgtggtgtctcttccttctgttgatttgtaacatcatttctttggaggtatggaagtcgaatataagagtatgtacagtgggatagataacgacagtagcttcttcaggattgaaacggctagggtagatgatgatacgaagtacagacgattgcagagggggagtcaaccaatgggaaatacggtaaagggaggacccgtagagtcgctcgctcgtctctcctaactccttccctgcacaaggcatattatgcaggtaggacgcaatactacctagagagccaccgatt

SEQ ID NO: 46098 - DNA, 423 bp, Zea mays
  Clone ID: LIB3066-032-Q1-E1-A11
tggcttggaacctttgggctgatttatgtgcttgtagtaagtacctcgtaactcttaggaaggtcgtttttaagaggattcaacacgaaccacggcggaaggcccggaggtggttgcggcggcagaggacacgacgttccggcgggcaaacgcactaaaaccagactcggtttccacaagggacattgcggttgcgccaaagaggcgatcggcgtatctgcatgcgcagagtccgacctaccgacgaagaccgctatagccaaaagagacgacaccgtcgatatattcatagctgtgatgttaccttgcgaattctgccacctaccgggtggcgaaatattaacgtatttgctctgaatattatactacgtccactagatcttaacgtggggatttcggaataataataaactacgacggaac

SEQ ID NO: 46099 - DNA, 384 bp, Zea mays
  Clone ID: LIB3066-031-Q1-K1-G4
tcgactagtctctagcatcgcgagcgggcctaccctttttttcttttctttttttctttttttattttatacggttttcgtttcagataaccgcggattagccatcttgtcaaacgatcaggatctaaaacactggagtcaagatccaacatcgtccatgttcaaacaactaggccctacccatcaccctagggggctccacattattcgacttgctgcacgggtcctattcagttgatcaccatacacgcctgcatagcggctcacgcgactcactagcgcggggcccatgcgcccacaacttattacgactcgtcaccaaccaaccaaaccaagccacccagcacgtgcactccaagcgtgtgagctgtgctctgctctacc

SEQ ID NO: 46100 - DNA, 283 bp, Zea mays
  Clone ID: LIB3066-008-Q1-K1-F11
cgcactcttgctacacacgagactgctgttctcattgagctcatcttacgacatctgcgttatcgttaaacagatgtgtccggacattcaaactccgtaccttacaatttcttgcgctcggatcggctccttaagtccggaccttatcaccaaaaggaggaccggtgccccatttccaacctacagaatgtgttaaatcaccttgaacttacatgtatttcacttgcgccccaatgctagtacttatcctacacctgtcatgtcatttcacaaacattgacta

SEQ ID NO: 46101 - DNA, 350 bp, Zea mays
  Clone ID: LIB3066-008-Q1-K1-F2
cgcccaagggccgcgtcctcgcgccgccgccggcgggcacggcgttctcgggcaccggcggggtcgagcccggcgacggcgccggggacaacggcggcgctggcacgagcggcgcgtgcagggcggccagcggccggttcttgggggtggtggctgctgctgcggctctggccgttttggttgctgcctgacttgagtagcgatggtttgaaggcattcgtcatttggaacgactgttctgcttatgtatgtgtctgtatttaaattcatcatttaatggtgatttttgttcgatgcttaggctatcgaaccctaaatttctactctaaaaggaatatttcatcttggtc

SEQ ID NO: 46102 - DNA, 363 bp, Zea mays
  Clone ID: LIB3066-008-Q1-K1-F3
gacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccggcagcatccccttcaagtgcggcgtcagcattccctacaccatcagcaccttcaccgac

SEQ ID NO: 46103 - DNA, 300 bp, Zea mays
  Clone ID: LIB3066-008-Q1-K1-F5
accacgcgtacgccctacgcatccgaccacgcgtacgcccacgcgtcctcccacgcgtgcggtacaattcatccgatgttttacagctttaaaaacaaaataaaataaaaacaaataaaataaaaaaaaaaaacaataactataatacaaacgaagaacaaaataacaaaacaatacaaatactgctgtaacggagataaggaacctaaagagcgccgtcagcaccgtcgccgacaggcgcaccgcctgcaactggctcaagaacgccgacagaggcgtcaacggtcttaacgcctgtaa

SEQ ID NO: 46104 - DNA, 402 bp, Zea mays
  Clone ID: LIB3066-008-Q1-K1-F6
tgccttcaaattctgccgtagtagtagttatcgccatctttcttgttgttatcctcggcgccagccacgcggtcaccggcgcccgtgtcggcaccatgatgatccggcagccttcttcgtcgtcctccgtcctgatgttcagggaggcgcccgcgttccggaacggccccgactgcggcgcggacggccgggtggacatcgccatgacgctggacgccaactacctccgcggcaccatggccgcggtgctgtccatcctgcagcacacggcgtgccccgagagcgtagcgttccacttcctcaccgccgacgccgacgccgacggccacggcctctccgccgcgctgcgcgcctcgtttccgttccttgaccttcgggtgtaccgcttcgacccgtcgcgcg

SEQ ID NO: 46105 - DNA, 346 bp, Zea mays
  Clone ID: LIB3066-008-Q1-K1-F7
gcgacggaaaacatgagatagcacgcaatctgacaaaacgaaaaaacgagaaagacggggagggtgctgctggcatcgggggccacgacctcggacgccggcatcacctgcagtcaggtgagcttcgccatcgcgcactgcctctcctacgcccgcggcacagagtccggcccctgcgaatactgctgtagcggcgtcaggaacctcatgagcgccgacagcaccgtcgccgactggcgcaccgcctgcaactgcctcaagaacgccctcaggggcctaagcggcctcaacgacggcaacggcggcagcattccgttcaagtgcatgttcagcatccccttcacca

SEQ ID NO: 46106 - DNA, 472 bp, Zea mays
  Clone ID: LIB3066-008-Q1-K1-F8
cccacgcgtccgggctccccaaagatagcatagcagcagcactcacaatagcagaaacgaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaatattcctcctctaatttctcgaccccgtcgaatttttttcctttctattcttctactatactactgctatatgggt

SEQ ID NO: 46107 - DNA, 75 bp, Zea mays
  Clone ID: LIB3066-008-Q1-K1-G1
tcgaaacaatcctaatgaaacaaaaataaaacacaaattacaatataaaaacaacaaaaagaacaaaaaacaaaa

SEQ ID NO: 46108 - DNA, 402 bp, Zea mays
  Clone ID: LIB3066-008-Q1-K1-G10
cccacgcgtccgcggacgcgtgggagaacaacctacccccacatgcagaaggatccgggcggccaccgagagtcactggaagaagctcgtccggcgccccgcgacgagacgacggcctcctactccgctccgctgaagaacgacctccccgctgacagcgttggcgggccttgtagcgaggagggggtgcggatgcgccgcgactgttcgcgggatgagcttatgcggcagcagctccctcgcatcaggtgcgaagaggccgttcgagtacgggagaacgcatgttgtgaggcccaagggctcgcacaaggccaccattgtctggctccatggacttggggacaatggagccagctggtctcaactactggaaactacttacccttctaatattaaatggat

SEQ ID NO: 46109 - DNA, 361 bp, Zea mays
  Clone ID: LIB3066-008-Q1-K1-G11
ctgatgactggacatgaaaggaatgaacttgaaggcgcaaaacatagctcagtgaccggggagatggctgatatgacaacttactatcaatgtgctgttattgatgaaattcacatggttggctgctaatgacggggttattcgctcacacatgcacttgtgggacttcgttcatatgaacttcatgactgaggtgaccacacctgatcgacctcttatccagcaaattctcgaagctactggtgatgtagataccgatcaatattatgagagactatctactgtggatcctctgaacatctcactagggtgtttctgtaacatcacagcatgagattgcttattatgattctcaatacgt

SEQ ID NO: 46110 - DNA, 361 bp, Zea mays
  Clone ID: LIB3066-008-Q1-K1-G12
aggcgaagaagaccaaccaaagcaaagccaacgggatctccctctcattccagaggacgccgcgtcgccaggcccgcttcgcgtgcgacgccggcatatagggtttcgccggcgccggcgatggacccaccctccgtgagccccgatcgctgggggcccagtcagggcgctggcgtcgggccctccggcctccgccgatatggcctcaatttctccgcctccagcctcctccaggcccccatcgcggccctccttgagtactccggcgtagtccagtccggccctgccctggcggcgcaccacccgtccgcggggccctagtcgccgttgtcggcgtcggaggtcgatggtcttctctccg

SEQ ID NO: 46111 - DNA, 402 bp, Zea mays
  Clone ID: LIB3066-008-Q1-K1-G2
cggacgcgtgggcggacgcgtgggtgttgcttcgatcgaacgagtagttggcctagaggagcgccgaagtggccaacctgacgtcccggtgcaagggactgaaggaggagggtgtagccgaccgcaaggaggcctgtcgactgagggctgaggtccttggtctgaaggcagaggcagaccaccgtgaggaggtgctacggtgggcgcaggagggcctccaagcggtgacggaggaacgtaactccctcgccaagtccctggaggacgactggtcctcgggtcaagccctggccgcccaaatagaaggtcttgagaagagtctggagggcatggcttggaccgtggagcaacatggggccgaagcggtggcaaacctctttcaagacctcgatgtggggggca

SEQ ID NO: 46112 - DNA, 331 bp, Zea mays
  Clone ID: LIB3066-008-Q1-K1-G3
gtcagggctcggcgggcaacacgccagggccaggcaaacagcagcgtagagctgggcctgggcagagcccccgagccgagcagttggtttggtggcgcgcctttactgccgctgccgctcactttcccagggaggggttaattgcctccgcgggcctcgctctcgcgtcgcgtccttcggatgccgcactgaccgccaccaagtcacgcagctcagccgcgcggcgcgatgggcgagaggaggaggcgtgcgagcactgcttccctcgggggtggaggtggaggcggagctggaggtagcggtgttgcgcccgcgcggaacgaggaggaca

SEQ ID NO: 46113 - DNA, 118 bp, Zea mays
  Clone ID: LIB3066-008-Q1-K1-G4
attcaaacagcagcgtagagctgtgcgggagggtagccctcgtaccgagcagttagtttgaatactctcctttactgccgctgccgctcactttcccatggaagagttaattgcctcc

SEQ ID NO: 46114 - DNA, 351 bp, Zea mays
  Clone ID: LIB3066-008-Q1-K1-G5
cggacgcgtgggcggacgcgtgggcgctagcgagcgagagagacgcacatctatgtgtcgagcgacgccgcggcctcgatcagagtcggaggcgaacaccctcatggcggcggttggcggcggcgcaagagggaaggtatccttcaagatcatcctcacctgcgaccccaagctccctttcaaagtgttcagcgtgcccgaggcggcgccctttaccgcggtgctcaagtacgccgcggaggagttcaaggtcccgtcccataccagctccatcatcaccaacgattgaattggcatcaacccccagcaaagtgcatgcaacgtgtttctgaaacatggatcggagctgcg

SEQ ID NO: 46115 - DNA, 410 bp, Zea mays
  Clone ID: LIB3066-008-Q1-K1-F10
cccaataaaaataaagaaaagttggcacagtgcaactccaagacagcccttgctttcagagttcgggatgagtgctttcagccacacattgacgatagaagtggaattaatgattcacaatgttgcatataattgtggttctgatttcagtcgtttagacttcagtggtttctatgcatttatcctggaacggggtgatgaagtaatagctgcagcatctgtaaggattcatggaactgatttagcagaaatgccattcataggcacaagatgcatgtataggcaccaagggatgtgtcgtcgactactgaatggaattgaatcggccctcggttccctcagtgttcagaaactagtagtatctgctgtgactgaaatggagaatacttggacaacttgttttggtttta

SEQ ID NO: 46116 - DNA, 380 bp, Zea mays
  Clone ID: LIB3066-008-Q1-K1-D3
cggacgcgtgggcagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcatgagaagcttttccacagatactaaatgggatgtccttcaagttgctgcgggttgtcgca

SEQ ID NO: 46117 - DNA, 369 bp, Zea mays
  Clone ID: LIB3066-008-Q1-K1-D4
gcgatgcacaagcacgagataccagccaccatgcgcctgtccctcctcctcgtcgtcggggccggcctctcggcgcgcaccgcggcgcagctgccgctggcgggcggcggcggcggcgccctgaagccggacttctatagccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcggtgctgatcgcgtccacccagttccagaagtcggagcacgactcggagatcaaccactcccttcccggggacgcctttgacgccgtggtgcgcgcc

SEQ ID NO: 46118 - DNA, 331 bp, Zea mays
  Clone ID: LIB3066-008-Q1-K1-D5
cccacgcgtccgcccacgcgtccgcccaccttccctacaccgccgccgccgtcggacgcagccgcatccgccatgggggcgtacaagtatgtctcggagttatggaggaggaagcaatccgacgtgatgcggttcgtgcagcgcgtgcgctgctgggagtacaggcagcagccggccatcgtccgcctcacaaggcccacccgccccgacaaggcccgacgactaggctacaaggccaagcaagggtatgttgtttaccgtgtccgtgtcaagcgtggcggcaggaagaggcctgtgcctaagggtattggctatggcaagcccaagcacc

SEQ ID NO: 46119 - DNA, 440 bp, Zea mays
  Clone ID: LIB3066-008-Q1-K1-D6
aaggaacctgaagactcgtgttattggttgcccaaagactatcgatggagatctgaaatgtaaggaggtaccaacaagctttggatttgatactgcttgcaagatatactccgaaatgattggcaatgttatgactgatgcaagatccacaggaaaatactaccactttgtgaggcttatgggtcgtgctgcttctcacattacattggaatgcgctttgcaaacacaccccaatgctgcactcattggggaagaggttgctgcgaagaaagaaacccttaagaatgtcacaaactacattactgatatcatctgcaagcgtgcagatcttggttacaactatggtgttatccttataccagaaagcctgattgatttcataccagaagttcaaaaactcatcgcggaattgaatgaaattttagcacatgatgttgttg

SEQ ID NO: 46120 - DNA, 340 bp, Zea mays
  Clone ID: LIB3066-008-Q1-K1-D7
cccacgcgtccgcccacgcgtccgcccacgcgtccgcccacgcgtccggcatacagcagagctatcatgcagatcaccatcaattaggtggggtgaggttaagatgcgatcctcaaagcgttgcaagtacagtgagccagctggaggtttgtggtcctcttcaaataacgttgctttgcaggatatcgagggatcgagcagtcagcacatacctcatgaatatggcgatggcatccagccaagtgttgtgcaaaacgtacaataagtgcaacatggaacaattctagataacattccggaaaacaacagtactgatgaacacactagagaaaattctggg

SEQ ID NO: 46121 - DNA, 307 bp, Zea mays
  Clone ID: LIB3066-008-Q1-K1-D8
cccacgcgtccgcttcgccacaagcacctcgtgtcgctcatcggctgctgcgaggacgagggcgagatggtcctcgtgtacgactacatggcgcacggcacgctgcgggagcacctgtacaagagcgggaagccggcgctgacgtggcggcagcgccttgagatcaccatcggcgccgcgcggggcctgcactacctgcacaccggcgccaagtacaccattattcaccgggacgtgaagacgaccaagatactggtggacgagaactgagtggctaaggtttgcgactttgacttgtccaagaccg

SEQ ID NO: 46122 - DNA, 308 bp, Zea mays
  Clone ID: LIB3066-008-Q1-K1-E1
ggagaagatgacccagatcatgttcgagaccttcaacacccccgctatgtacgtcgccgggcaggccgtgctctctctgtatgccagtggccgtaccacaggtatcgtgctcgactcgggagatggtgtgagccacaccgtccccatctacgagggatacgccctcccccacgccatccttcgtcttgacctggccggtcgcgacctcaccgactacctgatgaagatcctgactgagcgcggctactgcttcaccaccaccgctgaacgggaaatcgtgagggacattaaggagaatctcgcctaca

SEQ ID NO: 46123 - DNA, 421 bp, Zea mays
  Clone ID: LIB3066-008-Q1-K1-E10
caactttctgagagtatgctgtgacgatagtggctaggctgatgctgctgccgaggctgctgcatatgttggcaccacaacatctcggggtggccttggttatggggagactgatgctttggaggcattggtggttgaggcagccaagaggattgatcgacatttgaggaatctgtttgaatgccttcgccaatcctgattttatttgactcttggctcacgtgtcactgtgccagcgcgatcaatattagtagttcctcttcatctcgtgcaaatggatgcttctgtttggggtgatgatgctgaccattataatcctcatcggttccttaaaagggacattgatcttggagaaatattaggagcacctaaaggatcaactacgataaatattttcagtgggtgtaccaagggcgaatca

SEQ ID NO: 46124 - DNA, 382 bp, Zea mays
  unsure at all n locations
  Clone ID: LIB3066-008-Q1-K1-E11
cccacgcgtccgcccacgcgtccgcccacgcgtccgcccacgcgtccgcgacgctggaggagctgaagaacgacccgcgcacgtcgggcgcgctccacgactgcaaggagatgctggggtacgccatcgacgagctcaagtcgtccttcgacaagctgggcggcttcgagatgaccaacttcaacaaggccgtggacgacctcaagacgtggctcagcgccgcgctcacgtaccaggacacctgcctggacggcttcgcgaacgccaccaccaccgaggcctccgccaagatgcagaaggcgctcaacgcgtcgcaggagctgacggaggacatcctggcgggggtggaccagttctncgacacgctgggagggctcagcat

SEQ ID NO: 46125 - DNA, 392 bp, Zea mays
  Clone ID: LIB3066-008-Q1-K1-E12
gcagatcaccgtcgccttcaaccacttcggcagaggcctcgtgcagaggatgccaaggggccgctggggcttcttccacgtggtcaacaacgactacacgcactggctcatgtacgccatcggcggcagcaaggcccccaccatcatcagccagggcaaccgctacatcgcgccgcccaaccttgccgcgaagcaggtcaccaagcagcatgacacgccggagtccgtgtggaagaactgggtgtggcactccgagaacgacctcttcatggagggcgcctacttcaccgtcaccggcggccagatcaacagacagttcaacaagaaggacctcatcaagcccaggaacgggtcctacgtcaccaggctcacgcgctacgccggcttcctcg

SEQ ID NO: 46126 - DNA, 348 bp, Zea mays
  Clone ID: LIB3066-008-Q1-K1-E2
gaggattgctaccatcctatatcatatcatacatatacacaaggaggaggagaaggtgtgtagcgaggttgaggtccggaggatgccttccagtgccatgagttccgggctggagccggtgctctgcgcgcctcggccgcgcagggtccagcagctgcacccctgcagcgccgacctcatccttggcgcaccgcccttcccgcgcaacgccaacagcaaggccagcggcagcagcagcagggaaggaggcaggaagacgaccaggccggcggcggaggacgaggacgaggacgaggactgccgctgggcggcgttcggcgggtcgccgccggcgcgcgcggacaaccc

SEQ ID NO: 46127 - DNA, 396 bp, Zea mays
  Clone ID: LIB3066-008-Q1-K1-E4
cccacgcgtccggggggacaggaaatcagcggccatggcctcgattccggcgacgaccggcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcccgcgcaaggactgcgaccaggtgcatgcggacagggaccgcgc

SEQ ID NO: 46128 - DNA, 240 bp, Zea mays
  Clone ID: LIB3066-008-Q1-K1-E7
acaacgccgatgcggacgccatacacgacctaaccagcgccatacgggggcgcgcccccacgagcagatgtcgaagacggccgagttcgaggtcttcaatgttgatgacctgatgaactgggcacgtaagggctcgatttggcccatgacctttgggctcaaatgctgcgcggtcgaaatgatacacgccggcgcgttcagctacgacttccaccgggtcggagtcatcttacggccctc

SEQ ID NO: 46129 - DNA, 403 bp, Zea mays
  Clone ID: LIB3066-008-Q1-K1-E8
cggacgcgtgggcggacgcgtgggcggacgcgtgggcgggttccaggacacgctgtacgcgcactccaaggcgcagttctaccgcaactgcatcatctccggcaccgtggacttcatcttcggcgacgcggcggcggtgttccagaactgcatcctggtgctgcgccgcccgatggacaaccagcagaacatcgcgaccgcgcagggccgcgcggacgcgcgcgaggccacggggttcgtgctccagaagtgcgagttccaggccgaggccgcgctccgggactgcgggcgcccgcccatccgcaactacctgggccggccgtggcgcgagtgctcgcgcaccatcgtcatggagtcggagctcccggaacttatcgacaaggcggggtacttgccctggaac

SEQ ID NO: 46130 - DNA, 401 bp, Zea mays
  Clone ID: LIB3066-008-Q1-K1-E9
tgagaaatgccgtcctctacaccaccatcagtacaacccactccaagccttcagacattggcatgtcctgcagtagcccagaatactcatattgatgttagtgagatcaagtccaagatttttaagaggataggacatgaacgaggaaataaatactttcagcacctggaaaggttcttatcttcaagattgagcaagaatgaattcgagaagctctgtcttgtggcacttggccgtgaaaacctcccattgcacaaccaccttatctgttccattctacataatgccagtcgagcttgtggcccacctgtaattaatgaccctaagctggtcagaggtgccaccacttctggccatgcagttgttcctcctgtctgggacaatggtggtgccttgaacct

SEQ ID NO: 46131 - DNA, 426 bp, Zea mays
  Clone ID: LIB3066-008-Q1-K1-F1
gcgtaaagggcatttggagtggcatgattggaggaactttcatgcagacggctatcttagtgtgggccaccttgagaactgattggaacaaagaggtagaggaagcacagaaaaggctacacaaatgggaggatcagaagacgacgacgacaacgacggagcccctccttgcgggggtcgtcggcaatggcaatgccaattagtttactggatggacatcattctcccagacggcttcaccagcgtcaccgtcaggatatggaccctgcaaagtgtttctccggagtgtttaagttttctttcccgtatcaaaatttgcgaaacagagaaggaagggttttttttttgaaaacagaactgacgtctatcttttgagtgtaagaaattcgagcatacatgtggattttttttaaaaaaaaaaaaata

SEQ ID NO: 46132 - DNA, 156 bp, Zea mays
  Clone ID: LIB3066-008-Q1-K1-D2
ctgacgcgtgggaaaaaaaaaaaaaaattaaattaaaaaaaaaaaaaaaaaacaaacacgctagggtatccaagcatcacatacacattcaaacaacatcataattcatattttgcttctacctaaattcactacactgtccttcattctacatcc

SEQ ID NO: 46133 - DNA, 369 bp, Zea mays
  Clone ID: LIB3066-008-Q1-K1-B6
caaaactcctaattacctcctgtagggatccctcatgcgtgtgttttcttctggctgttgtatctgatgctcaaagtagatgctccgtgtgtcttccgctgctgttccgcaaggaaactgactcccccgaccgtcgtcgtgatgctgcccgctcatgctcctagacgggaatgactgccgcagaatgacgaatagggctggtgtgtgttacagtatggtccttttcccctcctttccattaagctctgtgatgtagctgtccgtgctgttgattcatgagatcatgctagagatttttcctggcagtgcgtgtaaaactgtcgaactatttgaacgaaagttgtacactgcaatatgtaacaatctcct

SEQ ID NO: 46134 - DNA, 443 bp, Zea mays
  Clone ID: LIB3066-008-Q1-K1-B7
aggaagggtgttgccatcaactttgtgacccgcgacgacgagcggatgctgttcgacatccagaagttctacaacgtgttgattgaggagctgcctgccaacgtcgctgaccttctgtgatcattttgaagaaaaacagaactaaaagaacggtggtgggggtgatctggtaaggcttggttttgccgaaatattgtgggggaggagtgataaggtcggtggggtttctatgttaaagtcgtggtctcgggcaatatgcgatttttctttatgccatgttttgggaaattttgtagctgcctaggcctcgtgctgttgtggtggttcattagtatgaagacgaaagctctgctggctatgggagtcctttttctttttgatagtattttgtttaaaactatgtatgaccgaattatttgtcatccttgactcaattctgctgc

SEQ ID NO: 46135 - DNA, 240 bp, Zea mays
  Clone ID: LIB3066-008-Q1-K1-B8
atccaaacaacgacaccaacgccaacattaattaattagtagtctccatgccctgggattgtgcgtggccgctccgttaaacaccacccatccttcgttcggcattttttcccccttgtttatataattttattgtatcgttttggcaaataattttgtgattcgaccccaaagcaagtttggttgtcttacgatttgtaaacctggaacaatatataatgtgattgaactgctttgtct

SEQ ID NO: 46136 - DNA, 432 bp, Zea mays
  unsure at all n locations
  Clone ID: LIB3066-008-Q1-K1-B9
agagtatgtaaacccagttgcctgtgcagtggcaatagaagctttgaaactttaccgggaaagggatattcctggtcatgtcaagcaaatcgctccaaagttccaggacggaattagggcgttggcagacagcccaatcatcggggagatacgtggcttagggatgattatgggaaccgaattcaccaacaacaaatcaccgactgatctattccctgccgaatggggggttggtgccatctttggagaggagtgccagaagcgcggcatgctggtcagggttgctggcgacgccatcatgatgtcgcccatgctgatcatgacgccccggcgaggtcgacgagctggtgagcatctacggggaagccctcanggccacggangagagggtgtcagacctgaagatgaaatccgagaagaactaaccaaaag

SEQ ID NO: 46137 - DNA, 412 bp, Zea mays
  Clone ID: LIB3066-008-Q1-K1-C1
gggggacaactgcacctggattaccttatgtcgaggaggcaattaccaatgctggtgactggttggttggtggggacttggaggttatagaaccaatcaagtacaatgatggtctagatcagtatcgcctgtctccagcacagctgcgtgaagagtttgccaggcgcaatgctgatgcagtatttgcctttcagcttcgcaatcctgtacacaatgggcatgctcttcttatgaccgacacacgcaaacgtctccttgagatgggttataaaaaccctgttcttctgctccatccactgggaggattcacaaaagcagatgatgtgcctcttagttggagaatgaagcaacatgagaaggttcttgaggaaagtgtccttaacccagaatcaactggtggtgcgaacttttc

SEQ ID NO: 46138 - DNA, 424 bp, Zea mays
  unsure at all n locations
  Clone ID: LIB3066-008-Q1-K1-C10
gatgaggtcgaagaagacgagggaagcatggacgacggcagcgccgaagaggatgatggcgagctgtccgacggaggggctctcggctcgccgcggcgacgcgccttctccgctccaggtattggacgtatggagataaatgggggaaatggagtgaggtcaatccaagaggggcagcaatggcatttatgtaaccatggaatcgagattgggcgtccatcaccaggaggggatgaacctggtaccatccccagagatgtgagagtggagaatgggcatggagttgttggaagaagagacggnggtcctgcatccagctattgggacctgttgagagcacacctctctgatcctttaacaggtgttctcatggatgatggcattgatttatcatgtggccattcatatggaagtagtggaatgc

SEQ ID NO: 46139 - DNA, 440 bp, Zea mays
  Clone ID: LIB3066-008-Q1-K1-C11
ctccctaggccctagccaagggaatagaggcctccctggatccactaccacggaacacggatcataactctcacgcagatgctggagttccattggagaacattctttatcttggtggacctaatattgcttctgaaatttacaacaaagaatatgcaaatgcacgtatttgtggagctgacaaatggagaaaaacccttgcaaaatttttgaggcggcctcattttattgtgtgggataacagtgatctcatcactcatgaagtcatgggcggcttaaaaaatgcctatgctggtgctggtatggttagctgcattaaccaacgagagtgcaaccagcaaatccgtttactttgcactttgcacatctgagttgatctacatcacacaccttttggaagaagagcctgagaaacttgttggtagagatggcaatgggta

SEQ ID NO: 46140 - DNA, 411 bp, Zea mays
  Clone ID: LIB3066-008-Q1-K1-C2
gttccgaagggttaagtgcaagtacgactccaaggtcaccttccaccttgaaaaggggggcggcgccaactacctggcgctgctggtcaagtacgtcgatggcgacggtgacattgtggcagtggacgtcaaggagaagggctctgacacgtacgagcccctgaagcactcctggggcgccatctggaggaaggacagcgacaaaccgcttaagggacccctcaccgtccgcctcactaccgagggaggcaccaagtccgtctacgacgatgtcatccctgccaactggaaggccaacaccgtctacaccggcaaataattaactttagtgctgacaatactttaagccgggctatgctagctatactagaattgtgtggatcccaagcaatgcattacacatgcattcat

SEQ ID NO: 46141 - DNA, 388 bp, Zea mays
  Clone ID: LIB3066-008-Q1-K1-C3
ctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttcatcactgataccaaggctgctatcgccgaaacttacaacctcacagattcagaatttctgaaagctgatagctgtcaaactcgagatgctggctcaactgcctcaacagctattattgtaggtgaccgtttgcttgttgcaaatgttggagattctagagccgttatttctaaaggaagacaagcgattgcggtttcaagggatcacaaacctggtcagaccga

SEQ ID NO: 46142 - DNA, 349 bp, Zea mays
  Clone ID: LIB3066-008-Q1-K1-C4
gatcaccggccgtcgagcgagcagtctcccaattccacccaataactaataacatctcggcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgtcgtcgtgcccgccgtcggggcgctcgtcgccttcttcctcggctactaccttcactgagcgacgacgcgcggggcg

SEQ ID NO: 46143 - DNA, 412 bp, Zea mays
  Clone ID: LIB3066-008-Q1-K1-C5
cggacgcgtgggtgccgcaggtgtgggacgaggagggcgcggccaagggcggcgcggtgaccccggcgccggccgcggccatgctgggctcgcctactgcgagagcggcgtgccccgggaccaggccaggttcgccgtcgtcttctcccacggattcaccggcttccgcgaggacagcgtccgcgcctcccaggaagttgcggaggagctgggcgtgtacatggtgggtttcgaccgcgccgggtacgggcagagcgaccctaaccccaaccggtccgtcaagagcgcggcgctggacgtggaggagctcgcggacgcgctggggctcgtgcccgagttctacgtcatcggcatcttcctcggctgccatgccgtctggggcgcccctaaatacattcccgacaggatcggc

SEQ ID NO: 46144 - DNA, 67 bp, Zea mays
  Clone ID: LIB3066-008-Q1-K1-C7
gttggactcctatatatagaggccttccggcacatataatatacgtcggaccaatattattgtgatc

SEQ ID NO: 46145 - DNA, 344 bp, Zea mays
  Clone ID: LIB3066-008-Q1-K1-C8
cggacgcgtgggcgatcgattacagcaatggcggccaaggtgttcctcctcctgcgacgcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtctttcggggacgagaacaactacgtgagcgtgggcgtcggcta

SEQ ID NO: 46146 - DNA, 374 bp, Zea mays
  Clone ID: LIB3066-008-Q1-K1-C9
cccacgcgtgcgcgccaaggtcctggtcgaggaggacttcctggccgtcgagaaagaggggtaggtgcaggtgcaggtgcaagcgctcgaggcggagctccggcgagccggccaggagaacagactcctcatcgacatgctccgagcggtggtggccaagtacgcggagctgcagggccaggtcaacggcatggcggcgccggtgtccacggcgggcaacatcgccgacgccgccgacgcctaccgccagttctccgcgtcgatcgacgacagcggctgcgcgtacggctcgtcgtacatgaagcggacgatccggaacgactgcctcaacaccgagccctagcatcacaaccgcaagccggcgacgtcgtacg

SEQ ID NO: 46147 - DNA, 387 bp, Zea mays
  Clone ID: LIB3066-008-Q1-K1-D11
gaacgtcgtacgagaacctttctccctcctccacctttctccttttcttgccacggcagaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaagtgtttgtgcccatcgacg

SEQ ID NO: 46148 - DNA, 431 bp, Zea mays
  Clone ID: LIB3066-008-Q1-K1-D12
aattctccggatcgacggcacgcgtccggccttctaccacgcgggcctggtgctgttcaccctgtgcgccgccaccccttcactggggcctcgcacagcggtccacatcatcgagtcgagcgccccagcaaggaagatgcagtcatttacttgtttcaggaccctttaactaactacactgaggacaggcgcatggtcacgcgctctactcccgtaaggcatggattacacattcaactattcggcgacactaccaatggctgcaactcaaccgagcctccattttaaccctcataataaaccccatggagctacatttgacgacgaacgacatttgagcgacctgcgaaacatagtacccaatgaacattgatatgcagaagtgttcataagagacttacaaatttcattgagtgggcctcaatccatac

SEQ ID NO: 46149 - DNA, 412 bp, Zea mays
  Clone ID: LIB3066-008-Q1-K1-B5
cccacgcgtccgcccacgcgtccggtgtctgcgtgcagggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgcctcacgtacacgctggacgagatcgagggcccgctcgaggtcggctccgacggcacgctcaagttcgaggagaaggactgcatcgactacgccgtcgtcaccgtgcagcttccgggggg

SEQ ID NO: 46150 - DNA, 253 bp, Zea mays
  Clone ID: LIB3066-031-Q1-E1-H6
ttggcttggaacctttggactgatttatgtgcttgattgaacttttagattaaacagccgttgttgctgttgctgtactatagtcattgcagctccaaggctttggattggacttacccttagatatttaaggataagacttactgtctgccttaattagatcctcctcctcctcgtcttactgcccgactctgccacttaccttagcataacttgacttagttaattgacgctaacgacggtgtcgaattcg

SEQ ID NO: 46151 - DNA, 376 bp, Zea mays
  Clone ID: LIB3066-031-Q1-E1-H8
tggcttggaacctttgggctgatttatgtgcttggttacgctccttaacgtaggggctcatgcggacgttactgctggacgtatcggcgacgttgggacctgtagacatgggaatagtaatcgtaatgattggattaattatggaaacggactcggggcgactaagaaggttgaagttgatactgagacgcatacgtgcatggacaacactgaatctgacaatacggatgcatacacggagaacgtgtggctatacgcgcgatcggaatattaatggatgtagtggatagtgctactctgggtgtacatcttgtcgtctgagagagagactgattctcttaagtctgatacgtagaattacactgtctacgggatt

SEQ ID NO: 46152 - DNA, 294 bp, Zea mays
  Clone ID: LIB3066-031-Q1-K1-A1
cccacgcgtccgcggacgcgtggggtcgcatcctttccggtttgccggttggggggcaaacgagaactaggaaagtgttaagtcttgctgaatcagtatttactcctttccagagttcgcggaagccggtcagggcctccgactttaatagcaataggcgttatagtaggacgcacaatgcgttactttggggatcctttgtgtggctggttcagtgattgagatagatttggaaagagtttgttttgctgaattgttattcaatactcactaaggcgtgtccctgtttacatg

SEQ ID NO: 46153 - DNA, 205 bp, Zea mays
  Clone ID: LIB3066-031-Q1-K1-A10
gtctggtacagctgctgctgaaagctgtatttggaccacatgtcgatccgacgtgacatgaggactgcgctagctgtcaacagtcacggacacaccagcttggcttttgctaacaccaaattcatatgatcgttacacgggaccaagatgaacaaggtcgacacgctcaagaagcccatggacttgaacatgtgcgtgaacgcac

SEQ ID NO: 46154 - DNA, 346 bp, Zea mays
  unsure at all n locations
  Clone ID: LIB3066-031-Q1-K1-A11
tgaaggcacatggtgacaagagcagagactatacaattccagctggcgtaatccaaggggtgccacctggtgtacaagctacatcctctgggtggcaaggtaacgttcaagcagctggggcatatgctgccccacccggtgccccttcgcaaagccacggtgccaatggacatgtgcagaactggaatcccggcaactcagtctatcccccagccccaggaccaggaacatatccaggccagatgtactcatctccctcacagtatgcagcgtcagggggcttccctaataccccatccactgctccgncacactatgcagcatcagggggcttccctaacacccc

SEQ ID NO: 46155 - DNA, 213 bp, Zea mays
  Clone ID: LIB3066-031-Q1-K1-A12
cgcaggcgagggctctgctcaccagcaggatatcggtggctgtcgcccgatggaacagcaggatctgaggcagcgtattctgcggctgctccatgagggcaacggtactgtccaagagcacctggatggactgctacatcacgggaagttaaccatgcagcacgcatacttgaggacgtacatatggattgctgatagccgacgaccgactca

SEQ ID NO: 46156 - DNA, 477 bp, Zea mays
  Clone ID: LIB3066-031-Q1-K1-A2
ctcaaaaacatttcagaagccaagttcaagcatatcttaaagcctatagctgatgcctgcatcagagaggaacaaaaggaatatgttgatttcgagccatattatacacatatagtctgtcatgaatgctgccatggaattggacctcattctatcacccttccaagtggtaaaaaaacaacagttagaagggaacttcaagaattccattcagcattggaagaagcaaaaagctgatatagttggtctctgggcactgaatttccttattaagaaaggattgcttcctaagagcctgtcacaatctatgtatgtctctttcctggctggctgcttccggtcaatccgctttgggctggaagaagctcacggaaaaggacaagctctgcagtttaactggttgtatgagaaaggggcttttgtgttgcagtctgacggaaaattctcagttgattttacaatggttgaggatgctgt

SEQ ID NO: 46157 - DNA, 369 bp, Zea mays
  unsure at all n locations
  Clone ID: LIB3066-031-Q1-K1-A3
cggacgcgtgggcatagacaggcgtcttcgtactcgcctatctccgcgacccaaagcgttggccctgctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtnccccgtgctggttttggtgacctttgacccactgtcatcgatgaagtgaggactggcac

SEQ ID NO: 46158 - DNA, 431 bp, Zea mays
  unsure at all n locations
  Clone ID: LIB3066-031-Q1-K1-A4
ccgtcgtcgcgatggcggcctcctgccgccgtcgccgtcacacgccaccgcagagctagctgccgacgaagacaaggcgggcaatggccaaggcgcccctgccgcttccgtcgctgctcgtcctcgccgccttcttcttccaccacccctgctgcacggcgcagggccgcgccgaaaacatctcggaggtcgaggccgcggtccgcgcccgcgcgtccgagctgctccgcgacgccaccagccagctcgtcgacctgcccctcccggccaacctctccggcgcgggcgtccgggcctcggccctcagcgtgcgcagcaacgcgctctgggccggcggcgtcaacaccaccggcttcaccgtcccgccgcgcgtcgtgccggccccgttcgcgcgccgnctcgccatcgtcttcgagctcttcgtgggaaac

SEQ ID NO: 46159 - DNA, 137 bp, Zea mays
  Clone ID: LIB3066-031-Q1-K1-A5
gtcgaaatggaacattaacattttcagcgttagattgttgtttttgtgtgcgtgttatatgtatatatactggttgacaaactagtttggttgattgagtctgatcgttgttgggttatttgaattgggtttgtgat

SEQ ID NO: 46160 - DNA, 460 bp, Zea mays
  Clone ID: LIB3066-031-Q1-K1-A7
caagcgagtcgtggtgcttggcccccaggttcccctcaaggagcagctcgagctcgacaaggatgatgagagcctgaggaggtggaaggagcaactccttgggcaggtcgacacagagcagctgggagaaactgcggaaccagaggtcaaggtgctggacctgaccatcctgtcacctggcagaccggacctgatccttccgatcccgttccaggctgacgagaagggctatgcgtttgccctcaaggacggcagcccctacagcttccgcttctccttcatcgtctccaacaacatcgtgtcaggcctcaagtacaccaacactgtctggaaaactggagtcaaagtggagacccagaagatgatgctggggacgttcagcccccagctagagccctatgtctacgagggcgaagaagagaccacccctgcttgcatttttgcgagaggttcttattct

SEQ ID NO: 46161 - DNA, 467 bp, Zea mays
  Clone ID: LIB3066-031-Q1-K1-A8
aggagctgtttggagctgttgccttgacaggaatgctctgagggctgcatctgcttctgctgacttctcggctaaagtatgggatgcacttactggtgatgaactacattcatttgaacataagcatatagttcgggcatgtgctttctctgaggacacccaccttttactcactggaggcatggaaaagactttgcgtgtgtatgatattaatcgtcctgatgcagctccaagagagcttgacaaatcacctggttctgtccgaactgctgcctggcttcatagtgaccaaactatattgagttcctgcactgacatgggtggagtaaggctatgggatgtgagaacaggtaaaattgtccaaactcttgaaaccaaggcttctattactagtgcagaagtaagccaggatggcaggttcatcactacagcagatggctcaagtgtaaaattttgggacgcgaatc

SEQ ID NO: 46162 - DNA, 457 bp, Zea mays
  Clone ID: LIB3066-031-Q1-K1-A9
gacccacgcgtccgcccacgcgtccgcccacgcgtccgcccacgcgtccgcaaacttacaggagtatggctatggcgacggcgaagctgaactccccggctaccagcttgctcgctggcggccgcacgcgccgatctgcgcccgcccgctgcacgacggtgatccgcgccgccgcaggctcctactcggacgagctcatctccaccgcgaaatctgttgcttcccctgggcgtggtattctggcaattgatgagtcaaatgcaacatgtggaaagaggttatcatctattgggttggacaacacagaagtgaaccggcaggcttacaagcagcttttgctgacaactgctggtcttggtgaatatatttctggcgctattcttttcgaggagaccctttatcaatcaactaccgacggcaagaagtttggtgactggttgaaggatcagaatatcat

SEQ ID NO: 46163 - DNA, 423 bp, Zea mays
  Clone ID: LIB3066-031-Q1-K1-B1
cccacgcgtccgcccacgcgtccgcttttgtcagttggacaatccgcagctcctccatctgattcttccccccatcccatccccaaggttgaccggcgaaatcagcagtccgagaaccgcgagcttctgcctgatccagcctcatcccgccatggacgaatctgaggagcacagcaacggcggcgggcacccccacccgcaccacgggtacgagtggaagttcccggcggcgctgagcgcgaacacgacgagcgtgcacgtgacggcgctggacggcgtggtgaacgtgaactcgctgttcacggtggccgtgttcgtggggctgtcgctggcgacaccggggcagctgcggagcctggcaggggacccgcggtgcgacgccggcccgggcgtggcgcggtcgctgctggtgctggaggtggt

SEQ ID NO: 46164 - DNA, 281 bp, Zea mays
  Clone ID: LIB3066-031-Q1-K1-B10
cggacgcgtgggcggacgcgtgggcggacgcgtggggcggcctcccacccatacaccttgggcgggcgccgcgccgtcgagggccatccagagctcgccatggcggccgtccggtccaacagggcccacgcccaccagcactgccgctccgaggcgtcgtgcccgacgacctccgtggccgtggcggcggcgagggccggcgacgccccacgccaccgttcgcaggctccggtgcaggtctcgaaagggcatcaccagatgcggcggtcagcggcgttccc

SEQ ID NO: 46165 - DNA, 445 bp, Zea mays
  Clone ID: LIB3066-031-Q1-K1-B11
cccacgcgtccgcgccattggcggcggcgacgcgccaaccatcatcagccagggcaaccggtgcataggaccaccaaacatcgccgccaaagtgatcaccaagcactacgcggaagaaggcgtgtggaagaactgggtgtggcacacggaggacgacctgttcatgaacggcgccatcttcaatccgtccggcggcgcccccaagcaggtcgacaccaacgagtgggtaaagcccaagccaggaacctacgttacaaggctcacccgcttctccggcacactgtcctgctgcacgggcaagccgtgctgaaggccggtgggcatcaggctgcttcttctagctcatggcctggccatgccaggtcgcgctggctgcgtttcatttcatggaagaaagcaaggatggatcacaggttgtcgttctgctaattaatctacatacgtt

SEQ ID NO: 46166 - DNA, 327 bp, Zea mays
  Clone ID: LIB3066-031-Q1-E1-H5
tggcttggaacctttgggctgatttatgtgcttgactatgataagacggtgcgtatagataacgtgacgagagttccgccttcttcgggttctccgcgtactgcgtacggcgagaaggaagagctaaagggtactgacgtgaaagtgcttgggttcggtgggcctcctgatactattaagctgggtgttcctggtaacggtaagatagatagtatgaaggtcgtgtaagaggtacgtatactggtgcgtggtggtatcgcgaagtagataacttctacatttaagggtgatccgtccgctggataatctaatcctataggtttccgt

SEQ ID NO: 46167 - DNA, 371 bp, Zea mays
  Clone ID: LIB3066-031-Q1-E1-F9
gaccatttttgtcgttagtgatagaagaagaagggggtttcctcttccggccgtacggtgttcattcttcgctcgtccgtgcgtacctgatctacatgtgtgggtgtctgtattattataattatgatttgacggtccctacgtgtctatatctaaacgtacgccgccgtactggagccgtcttcaataccagggagatacctgcggattcctatacgaagaatgtacgatgacactccactcctaaaactgatgagtagtagtagtattcggccgcagagaacataggggtcatcatcgaaagtcactacgacccccctgtgtctctcattagacaacgatcgctgacatgtctcgcacgaccacgaccc

SEQ ID NO: 46168 - DNA, 423 bp, Zea mays
  Clone ID: LIB3066-031-Q1-E1-G1
tggcttggaacctttgggctgatttatgtgcttggtaaagtggagcttggaccgtagccttcctggcttacttggttgctatactagttatatgttgatgtgttgttagctgttgtatgagggggtttgcgacgttgaagaagacgggtgcgaatcttaaggtggaggtggtttgtgattgttgtcttgttgtggaggttgattgttgtgattgttaggagtgtgttaaggaggagtagcatcgggttgaggtcgagggttttaagctttgtgtcgtgtgttgttgggaggaggatgttgagaagtgtgttgaggttgtggtctgtaaggctgagaattgttgatctgttgaggtagaggttgatgttgctgttgtccttgtactggtgttgcttaaagttgtagtgtgtaaggtgccttgtg

SEQ ID NO: 46169 - DNA, 426 bp, Zea mays
  Clone ID: LIB3066-031-Q1-E1-G10
cttggaacctttgggctgatttatgtgcttgtgtctgttttttcccttcttattcactcctcctagatgattagtaggaggcatgagtaagattgattcaggaggttctctctctttctcttttagttatttttgcagtgagagggagggtggaagaggacgagtgtgcttaggcctacaaagcgtgctatggctggggatggtgttgctggtaagattcgtacgtctactcttcatattcttaatattccttttattgatcacgccttgatagcgcccgacaatcctagcgttaatgccgcggccgacggcaatatcgctaattctggttctcgggataatcgtaggctagaggaccataatagatcgagattatcgagtcactgcggagtcgaagccccctcctcggtccctctatcgactagc

SEQ ID NO: 46170 - DNA, 452 bp, Zea mays
  Clone ID: LIB3066-031-Q1-E1-G11
tggacctttgggctgatttatgtgcttgtatgaatgctggtgtggttagtctgatgcatattgcggaggcgaatgcgttggtgctggcgatagcgggggcgaatttgttgaagtcgatccctaaggtgtcggaagaggcttcgaatcatctcgctataactaagctggttaatggttaggtgtccattggtttcgctgagggggagtctaagcggccgcttggtaagcatgctgcgtgtagcttgacttcagctatcaatgaacttgggtttctattggtggtcatatacagattgcaatttctgacagtagtcggtaaacgttcatccaccatgcatacggcaatgaccagcctgttacacgacttagtgtccgaaactgacgggaccgttagtcctacctatcccagacctggcggatcaaaccaagtacgtagacgtagagtaaacctt

SEQ ID NO: 46171 - DNA, 459 bp, Zea mays
  unsure at all n locations
  Clone ID: LIB3066-031-Q1-E1-G2
cttggcttggaacctttgggctgatttatgtgcttgtggatgtgcgggtggatgtgcgggctgtggatgtgcgggtcaatttaagataaaatacggacgcgaacgcgagaattacgcggctgctgacgtgggtataggccgtgacggtcgcggcgccggcgcctccggcgagtggtgtacggcgtggcttctttaaagcttttttaggtaagaatactatggttattcacggtaaggatcggtcggatgtcaaagtgatacggcacggtaagttgatgggcgttggctttgatgataatggcggcggtcgtgggcataaggatgcgaataagtttnttcctaacagtacgggtgtacgtggtaatacttttactcctaaggacggctcgggccgcgggcttcgtcctgagactaagcgtgacaagttcgcggagcgtcttggtaagtttgcggcggcgt

SEQ ID NO: 46172 - DNA, 437 bp, Zea mays
  Clone ID: LIB3066-031-Q1-E1-G3
tggcttggaacctttgggctgatttatgtgcttggaaaaggaccggtctcgatggccgggtctgcgggctttggatttgaatttgatggtcgtcgggggaacgtctgagtcgtctgtgtagtgagagtgggttgatgtgcgttggttgggggatggattgggaatggtttttcagggggttccatttgggtgcagaataattgatctagaatcggcatggataaggggaacctgatcggtcaacctaaatacagtaccgtgatagcttcggaggacgtcgatgtaacgcgacccacgtttagagtctcgaacgctaaagggaagaaacctaattaagtgtgcgcaaatggtgggagcaatcacgatctcaccaatgcagttaaacgttctggtactcaaccagcgatgtgtacgaacggaccaatgagaccctgatc

SEQ ID NO: 46173 - DNA, 102 bp, Zea mays
  Clone ID: LIB3066-031-Q1-E1-G4
ggcttggaactttgggctgatttatgtgcttgatcaggttcagacatgtaagtggttcattccccacctacttctcttctctctctctctatatgagatata

SEQ ID NO: 46174 - DNA, 133 bp, Zea mays
  Clone ID: LIB3066-031-Q1-E1-G5
tggcttggaaccattgggctgatttatgtgcttggaagaggctagggatatcgcttctgtacatcatacgaagactacttacatggggatgtattcgtagctgtcgaatcatgtggcttatcacgtgagtata

SEQ ID NO: 46175 - DNA, 407 bp, Zea mays
  Clone ID: LIB3066-031-Q1-E1-G6
cttggcttggaacctttgggctgatttatgtgcttgagcctttctttccaccataactccttctagtgttgttgtctttagatattgagtgtgatcgtttaattttgacttggtgacttgctcttcctccccttcttccctcgttgcttttgactatctgtaattacggtggtggtagtaggtggaggtgtggcgtgcgtctcgctttagaaggagtaggatacatagacgacgtctgttgttgatgcttattccggtattaagaatcgtgacccttagatggagtgtcacgctcccaagtgttgccttgatggtactcatactactaactccggtaagatacgggacaaatcttagtccgtagtgagggccactgccgttactgagaatttgtaggatactactgc

SEQ ID NO: 46176 - DNA, 328 bp, Zea mays
  Clone ID: LIB3066-031-Q1-E1-G7
tggcttggaaccgttgggctgatttatgtgcttgagattctagttagctgactgcctaagaaaaacattagtccattaataatagtaggagtaagtttatttgcctgatgatacggtttgttcgggtgttggtgttgcgccggtgtcttcagcggtggctgtggtggcggttgtgccttctgtggcgttggttcgggtgaagcttgaggagtcgagtgtgacggtgccgtcggtggtgaacggtggtagtcgtgtgggtttgtataagcgtctgggtgtggcgggtcagcgtcatgcggatgatgtggaggagtctggatcgagtggt

SEQ ID NO: 46177 - DNA, 301 bp, Zea mays
  Clone ID: LIB3066-031-Q1-E1-G8
tggcttggaacctttgggctgatttatgtgcttgattatgtgcctgtttatgtgcctcattatgtgcttgtttatgtacttgtagatgtgcggctcgtatataatgtaagtctacggttgatctatgtggtcgaagttatgcctaagtacgatttgcctgaggcatttaattaatccaattgtctaccttatagacttgctgagaaggaagataccggtatgaggtgtgagacgacggtgatgatgatcaggaagctcaagcctagtgggttccgtagggtgatgaatttgactgattggc

SEQ ID NO: 46178 - DNA, 324 bp, Zea mays
  Clone ID: LIB3066-031-Q1-E1-H1
tggttggaacctttgggctgatttatgtgcttgaaagtaatgctgtcacgaatgtccggtcgttataagttagccactttcgcggcaatcccctcgatattctcagtcctaaatcttgaaggctcaaaggactgacaggttatgtccctatggcctgcacctgcatcggaaactagaactaaatgagtccccatttccccgccttatatgagaccctcgcctctgccgagtctactccaggatattcgtgccactccccaatagaacgcgttgtttagttaaatcttttattcgataacgctccttgtttggactggtttggtg

SEQ ID NO: 46179 - DNA, 345 bp, Zea mays
  Clone ID: LIB3066-031-Q1-E1-H10
ttggaacctttgggctgatttatgtgcttggcttgaggttgtgctttgtgagaaggcttaccctcttactcttaagcggatggacggtaaataggagaagtttatcgcttgtatagaacttgacgaacaaagtctcggcgttacagcggtacagcttccgtcatagacgacccgaagcgccgccgtaagcccttggaatacgtcacccagtcggtccgaccccacagctaacgtcgaacaacaaacatcccccatgataaccgctcccactgccgtcaaccgtatctgtttcattcgaactagctacgcgaataccacggaacgtcctagccccgcataaatcaa

SEQ ID NO: 46180 - DNA, 336 bp, Zea mays
  Clone ID: LIB3066-031-Q1-E1-H12
tggcttcgaacctttgggctgatttatgtgcatggtcttgcgacttctgctcatattgatcctcttcctgttgatgttaagaggcatgttagggatgcgcacgccttgacctctgtttggctccttaactcggcccgttgcgccttctgcttattcggttcttacttgcactattggtattggtgctactcttgtgtggcgttcccgtgttgttgcgacccatacttagtactacgttcgtgtcgattatcgcactcctcggactggtattcctactggtctcctgtcggtcgttactcattattaggcgactacttgggtaactttgcctaagag

SEQ ID NO: 46181 - DNA, 409 bp, Zea mays
  Clone ID: LIB3066-031-Q1-E1-H2
tggttggaacctttgggctgatttatgtgcttgtttatgtgcttggagattagtagtagggaatactgcttacttgagtcaagcaaccaggctgaaaacgatttgcgttagtagtagcagtagtagttggtgcgcgatgtcggcatcgtctggctcttgttcgtcgtcctcggccggcgccgtgtaggtggcagcggagccggcgttcgtcgacgacaacactgttgttgttgtcgtcggtatggtggcggatgacggtgagttgttctagtagcgtgtgattttggcgagtgcggaggaggtgcgttgtggtgtgcttgagatgtatgttggtgcggttcatgattatcgtacggtgctgtcgggtgttgatttgtgtagtaaggaagttggtaataagaatacgtat

SEQ ID NO: 46182 - DNA, 380 bp, Zea mays
  Clone ID: LIB3066-031-Q1-E1-H3
tgcttggacctttgggctgatttatgtgcttgtttatgtgcttgtttatgtgcttgggttgagcttgaatgggtgcgtgttacgtgtacgtgatgtcgatgagtaatgataattatagagtttaattggaaggaggactggcattagtctatggtggtgttcgtattatatgttggtggtggtgttggttattttttctttgataggtatgtcctccgtgttctccgcgggacgtcatcatggacaatgcatgtttaatttatgttcccggtggtggtttagccgaggtcattcgggttgtgcccatgttgatgttgcgctgtcgttcttgtagtggatggcgttggtaacctaagtcgtttgtcttatcgcgatttcct

SEQ ID NO: 46183 - DNA, 452 bp, Zea mays
  Clone ID: LIB3066-031-Q1-E1-H4
tgcttggacctttgggctgatttatgtgcttgggtggttttgttactggtttggttaaggatatgtcgggttggtggcgggagattgatgttgtgcatgcgtagcttaaggaggtggcgaaggatgcgctggcgtttattagtattactaggccttttgatgggatgctttggtcggcggtgttggtgtcggcgcatgttagtgtcgttaggacggtggatgttgatgcggggagttttaatcctaattcgatgcggaaggcggatgcggatttgcttcctagtcattcggcttgttctcctcctgttgatactgcgagtaaggttattaatgattctcatcctgatgcgcatactggtgggtgtaaggttgcgcttgggtcggattcgctgatggcggttggtggtgagtcggtggtgtttcatcataaggatcctgcggcgaatctgctg

SEQ ID NO: 46184 - DNA, 483 bp, Zea mays
  unsure at all n locations
  Clone ID: LIB3066-031-Q1-E1-F8
ttggttggaactttgggctgattttgtgcttgttataatttcgcgtagagcctccgtagctctactaaggcgataggaatgatacgggatacggaggttatttcgcgtttgaagttttaccctgcggctactttacggttagttattagttatacgacttttactgcggatactggtcgttcttctgttgtgtatggtgttgtggctatgactactattatgtttcttagtctgtaatctgcttagagttgtgcggattgtgttgggtaagttctagtgggggctatggctattgtgactttgcctttgggtgtggaggttggttcgttggatggtcgtgagaggatggattatactttactgttcgattctgcgtttaatcctcctgctgttattgtgtggcctggtgaggttgcggtgtggtatcgttgttgntcgtttatggttatggtggtgtatttttggttgagtcgtgctgctgtt

SEQ ID NO: 46185 - DNA, 457 bp, Zea mays
  Clone ID: LIB3066-031-Q1-E1-E3
tggcttggaacctttgggctgatttatgtgcttgtggatgtgcgggtcccgtcgccgcgactccttctccttccggcctggccgagggacctagtgtgaagagttagtttcgtattcacagtaaggataagcatcgtaagttcgtatcgcctatcgtatctcccagtatcgcgcttcctccgtccggagttactattctctcggctcttggcccttccggtacgaagaccgttatacacgtgaacgttagaatcatttcggaagtcaggaagggcgccggtaaggtccccactattgtcccctgtctcggcgtcgacacgggtccttcgtccgtactaagcgggtccgcggcctcgcatactattaccaacgcacccaagccgcaccatggcgacgatcgggagggctcccccgagctcactatcggtcacggttccggcgggctgcttacggtctc

SEQ ID NO: 46186 - DNA, 476 bp, Zea mays
  Clone ID: LIB3066-031-Q1-E1-E5
tggcttggaacctttgggctgatttatgtgcttggggatgcccggttaactaagactaggactaggaggcaaaagaacgtgttacactgcgtacgagcccggcggctctcatccccggcgacggctccgaaagagaaccattagtacgttcctttacatctgccgataggacgggcaacgaaaccataagatccatagtcgctaaggtacccctagccaccgtgaacctattctcatgcaccgactctctgcgcgcttcggactacgccgccctcgagtctatagtcccttcctgtaaggttaatagagtctccaggtaggtgatgccgggaatctcaaacctcccggccgctatacacggcggctagaccggtctcctcctgcacgagataacaactgtggaatccctaatttctacaagtgatacggacccgtacacgattgtctccgtaccggaatcccgccgtataacaacg

SEQ ID NO: 46187 - DNA, 484 bp, Zea mays
  Clone ID: LIB3066-031-Q1-E1-E6
cttggcttggaacctttgggctgatttatgtgcttggctgctgatagttctgttaatcttcttgagtctgcgacttgttgttcgtgtctgtctgtggcggaatatgttaaaaattctgtgccttataaggccgacacttgcgataaagacggaccggaaaaggcccccgtcctaataagacccgacgtcgccacctaccccgtcggatcgaaagtcgccggagaaagcgcataaaagttcccgtcccaccacgattacaacgccgccggtataacaaactcctcggaagcaacggtagtctacggacgcaagaagccagcgcctctactactagtcgtagcccacgggctattcaagaatctatttcgtatcgaagaccccttctctatcttatacaatttacacggtagaattaaatccacggtagaggagacacgttgcgacactcattacccagaactcgaacggaacactaccccgtcca

SEQ ID NO: 46188 - DNA, 389 bp, Zea mays
  Clone ID: LIB3066-031-Q1-E1-E7
ggcttggaaccattgggctgatttatgtagcttgcttatgtgcaatgtttatgcccccgttagatgtgttttaacttatacatataggtgcactacggtactacaatgtacatcaaatgaaccaaatgatccgcacaacgatttcatactgcgacgtaacatctgcttcgtcgcagaggacacgccttatcggaagatacctactacggccttcttcgacagcttacacgtcggatgcgcttacccacataatacctacccctatggatatcatatcgctcagtacttaaaagcactccccaagatgaacgtaccgtacataaatactaacatcgacggaagtacactcgcggataccactcaagattagaggagtttcgtcccgataa

SEQ ID NO: 46189 - DNA, 465 bp, Zea mays
  Clone ID: LIB3066-031-Q1-E1-E8
tggcttggaacctttgggctgatttatgtgcttgcgtatgttcggttcgggtcggttgttcttgattattgcatgcttcttattgtggtggtgctggctggttctcgtttgatttgggtcgttcgtgagggtcctcgacggtttctgatgttgcttcccttcttcagcgtttagtcccaccgtagacttagtttctcgacttctgctcctccctattctcttaatacgaaggctaatattaagactaagtcggagttggctacggtgttgctgctgctttcgttgtagaatgttagtgagtcatttgatttggtgctattgtctagtcttaatatggtgtattattttgctcttgcgtttattatattcaggccgcttccactgcgtctgctgcctgggtatacggcgattttagttattgatatattggtgactatgtctattaagaagtaggatgataagttg

SEQ ID NO: 46190 - DNA, 467 bp, Zea mays
  Clone ID: LIB3066-031-Q1-E1-E9
cttggaacctttgggctgatttatgtgcatgtccaagaagatgacgcctggtgcctgtactaaggtgcctgaggatgttgctcatgcgtctattggtcggaagacttatcatgaggacacggatacggacgatctagttaattttactcctactgatacgaagcatcgttttaataagccgcgcatcggtaatggtgttcctaaagctattgctaaggacgctattcctaagaatactattggtattcttcgtaatttggaggttgccagttcgtctcgtatcgttaagagcttacgtattggtgccattacggacgatgcctatgctcgagcacagtggtgttaataatgagattacggtctcccgtttgaatgttgacggtgagtattagggccgctctaaggagtccggacgtcctcagatttcgtactgatcgatttactccctcaggcaccacccactctcc

SEQ ID NO: 46191 - DNA, 460 bp, Zea mays
  unsure at all n locations
  Clone ID: LIB3066-031-Q1-E1-F1
ggttggaacctttgggctgatttatgtgcttgtttatgtgcttgtggaaaaggggttagtggtcttgcattagctgcttagccattcgatgtaggagtctagtagtaatacggtgtagagaattgttgttgttgttcttctcctcgtgctaggtcatggtgcctagagatttttcggctcaagctcaataatagtttagatgaaacctatgctgtcttggttgccgttgttcctggctgctttcctttacgttcatggtgtgttgttctatggatttgctattgctccctatttgctagtcttctttgcgttgcacttagtgagtaacctcggtggcttcggtagtagtgatgtggcgccggagactgagagtgcgaggcggagtgcggcgggactgaagttcgagggtctggagtgctcgaggagtcgtanaagggtagtagagacggatgttgatgcg

SEQ ID NO: 46192 - DNA, 419 bp, Zea mays
  Clone ID: LIB3066-031-Q1-E1-F10
tggcttggaacctttgggctgatttatgtgcttgttgaggttattgttgatggttcgtctactaatatgccttgtggttctgagggtgctcctgctgatggtcatgtggtggtgtctggaaggaagatgatggtgatgcgccgggttgctggtttgatgcgtgttcttcttcttggcggttcggatgtgggtgtgatggttgtttgtggtaattgtgttgatgctgatgctggttcttcttcgctgcggtctgatgtttgtttggtggtgcttgcgtcgcatgctagtcctggtagttctgtgtagtcgctgtcgaagtagattgctgagtctgtttggggttctgaggtgcttgggtggttgcctgctcgggttactaaggaggttaagcctagtgttgatgcgttggtgccgtcgtc

SEQ ID NO: 46193 - DNA, 61 bp, Zea mays
  Clone ID: LIB3066-031-Q1-E1-F11
tttgggctgatttatgtgcttgtggatgtgcgtgtggatgtgcgggtggatgtccgggacc

SEQ ID NO: 46194 - DNA, 279 bp, Zea mays
  Clone ID: LIB3066-031-Q1-E1-F12
cgtggtggcgttcgttacgtggtagtgaggcgaggttattgactgggtgtccggtcagtggtggagttcattaatgtctaacgagtgacggtctcgctcgtgatgtcatggaccctctccagtgctatggctcccggggtctcggtgcgtgagtccggcgatacttctgaaaataaaaagttcgtctctgggatcatcacttcaggaaaggacgcttatactcgtatgcccttaagagacttgatctccgtgactgggagttcggttaccgcggtatcc

SEQ ID NO: 46195 - DNA, 494 bp, Zea mays
  unsure at all n locations
  Clone ID: LIB3066-031-Q1-E1-F2
gttggaacctttgggctgatttatgtgcttgggttaatgagcctccttcgtagacgtcgcgtgagtgttggtttgggtgtcccgcttagactacggatcttactgttgattcgggatcggaggctattaatgctaatgctattctttatgagagttctgcttctaatgctccttgtgttgttaggtgggataacgaggcggtagcgtaggtggatagatcgagggatctgtcgtcggaggcgacgtgggagttgcatggtgcacggctgctgctggtgttgtttgcggggacgagtggtagtggtactgttgatgcgaagtacgatagtgcggatacgaagtctgacggtactactgatgggtaggtggtattgagtgctgtagcgggggccctagaggactatcatggtggtcataattactcntcntaacattctgtccgactaccacccaaccgtgcctgcctacgccgaaagcctgactaaatcactaaa

SEQ ID NO: 46196 - DNA, 445 bp, Zea mays
  Clone ID: LIB3066-031-Q1-E1-F3
ggcttggaacctttgggctgatttatgtgcttgaaaaaaataagaaaaaaaaaaaaaaaaaaaaccaaaaaaaaaaaaaaaaaaccaaaaaaaaaggagacaaaaaaaaaaaaaaaaaagaaaaaaggataagggtcgctgacccataagacttaagcccatgcatgtgcgaacgtaaagctacagtcccctcacattgcaattcaaaccaaccctatcggttgcatacccataatatcgggaacgtgaaaattccgttgcatttaaatccaccgtttccgacgtataccttttccctcttagccagtgcaacaaggattaggttggcattgaccgttaccattaatatccttctaactcgaacggggaacggtatctctttcgcattccaataccaaatgtcgtggccgccatggccatgtgtattgccattgccgtaaccgtt

SEQ ID NO: 46197 - DNA, 428 bp, Zea mays
  Clone ID: LIB3066-031-Q1-E1-F4
tggcttggaacctttgggctgatttatgtgcttgtcaaccaaataacgagtaaccctccgcccactacgtaaagaaaatacgccccgtatggcacagacgcatcggaggtacgtaaacctcacaacgccccgagaggctaaaccccatacaccgagccgcggatccggatacccgataaaaaagagcgaggaaagaagcgtgtcctagccaccaatccgccagcacggtcggatactctctccgagcggacgtattcaacatatcgtaaaacacgcccccaataaaaagcccgcccgattccgcttcgatttacgattccatacaccgttgcctaagcaactttagtaataggcccaataattgcggcggcccttaagtcggctgaggttgcggttagccttagagtcgggggagaggttgcggctag

SEQ ID NO: 46198 - DNA, 473 bp, Zea mays
  Clone ID: LIB3066-031-Q1-E1-F5
ttggcttggaacctttgggctgatttatgtgcttgggttagaggtcgcctattccggagattcgacgtggccacgagcatgattgggtgcggatggaacctggcttcttggacccctaagggttgttgggggtgtattggatattgtgtgacgcgtggcgtctccttggttgtcggatttcattcttggtcgaattgaccttagggccggtaggttgccaagtagaaaagacaatctcctttgacgtttttgttggtgctcttggatccttcaatgctgttgctcgttgttatgccttggtctgggaaactccaatttgacctttccctgggcgatgtgtgcgactgtgtcactcgttgggccctttttgctttccaagactggtccatttacgcgtaagcgttgcctatacggaattccctcgtctcctggttcctaaagcctctacccgaacacctgtcatcattattaag

SEQ ID NO: 46199 - DNA, 471 bp, Zea mays
  Clone ID: LIB3066-031-Q1-E1-F6
tggcttggaacctttgggctgatttatgtgcttgtggatgtgcgggtgagtaagttccaatttggtaagatcttattattggctcccgtcatgatcgtcttgtttatacgtctcgggctggtgagtgtatttggtagtccgacggtgcttacgcggagccttcgagggggactgttaatttttccggtactaaggcgagtgataagacggagtttggtgagtcggcgaagtcgactgatacatcgaatttgatgaataagtttgggaggactattgctactataaggacgggggtagagaatactagggctaagccattctattccacttgtgtggcttgttaggtcggatagagcgctattcggactatcgatttgacgtatgggaatattactaagatcttccgtggatgaaagatctggttacccgatcttacctcggttgaggcatgggttcctcctgatgcgtatg

SEQ ID NO: 46200 - DNA, 479 bp, Zea mays
  unsure at all n locations
  Clone ID: LIB3066-031-Q1-E1-E2
tggcttggaacctttgggctgatttatgtgcttgtggatttggtggtggtgtcggttgtggtgtgctatgagcctggtgagtatggtggtgcgaatgacgcttactgaggtgctggtgatgcctatggcgacggagttggatatgacgtggtggtcgcctgtgggtgagtcgggttttgattgtggtgatacgcatactcatagttggtatcctaatttgatggcgtcggtgtcggggtggtagacggtggtgtcggagggtatggaggtgggtcatcgtatggtgcttgggacgcttgttactctgcttgcgtcgacgtagtcggcgggtgttggtggttatgcggcggtgctgtggcgttcgcatggtgggatatatgtgtcgtcggtttggccttcgttgtgtgttcctggggcgtgtgttattcctgcggatgttgatgatgaggttgntgcgtgtgttgnggcggcttttggtg

SEQ ID NO: 46201 - DNA, 286 bp, Zea mays
  Clone ID: LIB3066-003-Q1-K1-H12
aactcgtccaagcgtccaagaaaaggaaattgaatctgctaaattctccggaacccccgttgccagccggcgatcgcgccgtgggatctcatcgaacgaagcgggcggcgacggcgatgtcaagggaggcggcgaggacgaggagccgggtcctggtggttggcgccaccggccgcctcggtggaaacatagctcaggccagcctcgccgcgggtcaccccaccttcgcgctcgttcggccccaccacttcgcacgccccgattcccccgtgctcgagccgctcgt

SEQ ID NO: 46202 - DNA, 310 bp, Zea mays
  Clone ID: LIB3066-003-Q1-K1-H2
gaataattttactaatcaaattcttgttgggatatattcctccaattcccctcctccgcccagacaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcaaccgtggggcccggaacccttggcctgtgttgttccgcttcgtcttcttcttcg

SEQ ID NO: 46203 - DNA, 397 bp, Zea mays
  unsure at all n locations
  Clone ID: LIB3066-003-Q1-K1-H3
cccacgcgtccgaacaatccttgcacccctcccctccgtcaccccaccacatccggcgagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgtctgcacccccgccgctgccgctgccccatcgtcgtcgtcgtctaggaagtctggtccagctgccgcgccgaccaccgccgnctctacaccgtcttcttccacggacgaggagttgagccct

SEQ ID NO: 46204 - DNA, 292 bp, Zea mays
  Clone ID: LIB3066-003-Q1-K1-H4
cacgcgtacgcaagcaacggttaagcatcaagctctactcttcttctgtacggaacgtgtgactagataacagcaagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactactgccgcagcggcggcgatgggtacggcaggtccggcggcgacgactactgtcgtggcaccggc

SEQ ID NO: 46205 - DNA, 413 bp, Zea mays
  Clone ID: LIB3066-003-Q1-K1-H5
cccacgcgtccgcccacgcgtccgctcctcctcagaaacccaccaaccccgtccagccgccggctgtctcggccgtcgccgccgccgccgccgccctatcccggtccttcaggtgaaccaggttggccatggccttcaacaagatcaaggtcgccaaccccatcgtcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaagggtaaaggagtttggcttgaaggctatgtggaag

SEQ ID NO: 46206 - DNA, 388 bp, Zea mays
  Clone ID: LIB3066-003-Q1-K1-H6
cccacgcgtccgcaagcaactgcaaagcagcaagctctactcttcttctgtactgaacgtgtgactagataacaacaagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggagacgactacggccgcagcggcggcgacgactacggccgtggcaccggcggcggcgggtacaaca

SEQ ID NO: 46207 - DNA, 399 bp, Zea mays
  Clone ID: LIB3066-003-Q1-K1-H7
ctcgttcgtatctttaagcttgctgctgcagcgtaagaaaaagcagtctgcactcggtcggtcggtcgctctgttcagctagctgcatgctcggccaccatatctcctccagtacgttcgtcgttctccacgccgctatctggtctgcggtaagcagcagctagaggccgttgtgtaggctacacagaagatcatcgaggatgctggtgaagaagaacaacagcacggcgatggcggcgggcgtgctgccgctggcgtcgctgaaccacatcagcatcgtgtgccggtcggtggaggcgtcgctgcgcttctatgcggacgtgctcggcttcgtgcccatccgccgccccggctccttcgacttcgacggcgcctggctgttcaactacgggatcggcg

SEQ ID NO: 46208 - DNA, 95 bp, Zea mays
  Clone ID: LIB3066-003-Q1-K1-H8
accacgcgttcgcaagcaactgcaaagcagcaagctctactcttcttctgtactgaacgtgtgactagataacaacaagcgtgaaccatggctga

SEQ ID NO: 46209 - DNA, 357 bp, Zea mays
  Clone ID: LIB3066-003-Q1-K1-H9
cgcagcagagacgggatctccaggccaacattccagcattgcgtaaactggacacgatgcttctcgactacctggataacttcaaggaacgcaacgagttctggtacgtgaagcgcgactcgtgctcagagagcgagaacgaggagaggtccgacgagaaatggtggatcccgatcgtcaaagtgccccccggcgggcttgtccagaactctaaaaggctgcttctggaccaaaaaggacttgtgaaacaagtgcttaaagcctgccttggccataatggcaacttgcttaatgaaaataaccttccggacaccgattttgacccgcttccttaaaaccggaaaaccaatcttgggg

SEQ ID NO: 46210 - DNA, 254 bp, Zea mays
  Clone ID: LIB3066-004-Q1-K1-A1
cccacgcgtccgcggacgcgtggaaaaaaaaaaaatataataaatacaaaaataaaatgggtatttaataaataaaaacaaacttaaattaatatccgtccatctgattttctgccccttttatctggtgcgcgctcttttactttttcgttctcttacgctgtccttcatcttctttatcttcccattcctcttctgaaccatcgtttctacagcttctatttttaccttgtttcttagtctgcctcttgtta

SEQ ID NO: 46211 - DNA, 367 bp, Zea mays
  Clone ID: LIB3066-004-Q1-K1-A10
cggacgcgtgggctttgccaccgcggcgtacgcggcgtcggcgtcggcgtcgcgcgcggcggccgtcgtcaggggcgcgggcgccccgtcgcagtcggagttggagtcggacccggagaaccagtgcgtgtacacggtgtacgtgcggacggggtccatctggaagggcggcacggactcgaccatcggcgtgacgctgctgggccccgacggcacgggcatccggatccgggacctggcggagtggggcggcctcatgggcgccggccacgactactacgagcgcggcaacctggacatcttcagcggccggggcccctgcatgagccaggcgccctgcgccatgaacctcaccttcgacggcacc

SEQ ID NO: 46212 - DNA, 383 bp, Zea mays
  Clone ID: LIB3066-004-Q1-K1-A11
accgctgacgcgtcggcggacgcgtgggcggacgcgtgggctgacgcgtggggtgaaaatgtgacatgcatccagttcaaccctgttgatgatagatacttcattagtggttcactggatgaaaaagttcgcatatggagcattcaaaaccgtgaaattgttgattggaaagatttgcatgaaatggtcactgctgcttgctataccccagatggacagagtgcactaattggttcccataaaggcagctgccatatttatgatacatctgataataagcttctccaaaagaaacaaattgacctgcaaattaagaaaaagaagtccagtcagaagaaaataactggatttcagttccttgaatagtttctcccagggagtac

SEQ ID NO: 46213 - DNA, 411 bp, Zea mays
  Clone ID: LIB3066-004-Q1-K1-A12
gttacaagtgggctgaagtactgtcagctgatgcattctcagcttttgaagacgctggtttggatgatgagaaggcaatcgaggaaactggcagacgattcagagacactgttcttgcgcttggaggtggaaagtctccgcttgaggtgttcgtttcattccgaggacgggagccttcgcctgaaccacttcttagacaaaacggcttgcttcctgttgctgcctagtgccccaaagatttctctgttatttatgcttaaacagggaccattttcatccggtcaattatttgatgaagatagacatttcgcccttgtttgtttaccctcctctagattattaaataagttagaagacaaacaaacaacacatattattaatgtatgtgttttggatatgtgtctagattca

SEQ ID NO: 46214 - DNA, 431 bp, Zea mays
  Clone ID: LIB3066-004-Q1-K1-A3
aacacgatccttttttacagcctagaagagaagaattgcatcactacgctattccatggctcttgcatcaatcgaccccccttcaattcgatccatcgatctgatgttctgcagtttcaagctgaggagcctcctcttcctttggcgagctctaacgctggcgttggtctccttcatctcccaattcctctggtgaaccatcgctgcgacggcttggatttggttctgggttcgcagtctgcctcttgtgatgcatcaccatcgccggtggagggccgacgacgatgggatcaagggattactatgagatcctcaacgtcgaccggagcgccaccgatgacgacctccgcagggcctaccggcggctggccatgcggtggcaccccgataagaaccccgccggcaaggcagaggccgagacccggttcaag

SEQ ID NO: 46215 - DNA, 427 bp, Zea mays
  Clone ID: LIB3066-004-Q1-K1-A4
accagtcagaaaatagtgggatcgagttgtgtcactgcacgagcacatcctccggcgagcaccgggctcactatgcgtcctctagcgaccgaccaacgcgccgagcgaagatgtcgtggcagacgtacgtggacgagcacctgatgtgcgagatcgagggccaccacctgacgtcggcggacatcgtcggccacgacggcgccacctgggctcagagcaccgcgttccgcgagttcaagcccgaggagatggctgccatcatgaaggatttcgacgagccggggcaccttggcccgaccgggctgatcctgggaggcaccaagtacatggtcatgcaaggcgaacctggagctgtcatacgtggcaagaagggatccgggggcattactgtgaagaaaacagggcagtcattcatcattggcatcta

SEQ ID NO: 46216 - DNA, 254 bp, Zea mays
  Clone ID: LIB3066-004-Q1-K1-A5
cccacgcgtgcgcccacgcgtgcgcccacgcgtgcggcggtcgccctttttttaggccgatggcgttcgcatacccgtcgtatcactttggaacaaattgaactaattccaatcatacattttacacgtgctctggaactacttcccacggaaactactactacctgttctagtaaaattcatgtacttgtttacaccacatgagatagctcatcccaacatgcatctttgaagtatcagcatacgtctagacc

SEQ ID NO: 46217 - DNA, 310 bp, Zea mays
  Clone ID: LIB3066-004-Q1-K1-A6
agcggcagggcggcaagaagaaggcccccaaggcgaagacgaactagggctgcttagagagctgcacgcctcaggtggggtgtatcaggagacaggtctatttcgaagcaggctcagcgcgatgcagcgaatgccatcgagctgcgcttttacatgtttatcatcagattccattttgcggcccgaacaaaggtgtgaccggggtgggttaggcgactagattgcacgattatgtacttgagatttgtttgttgaactgggttgccgacggttaatcttctccatttgattttatcttgttagcagcgca

SEQ ID NO: 46218 - DNA, 424 bp, Zea mays
  Clone ID: LIB3066-004-Q1-K1-A7
gggacgactgcgcataacagaggtgttcctcgcggcggcggtggtgacggcggcggcggtgacaactagtggtggcatggtcgccgcggtgcgggacgacgacttcttcgtggacggctcggtgtaatgcgacacctgccgggcggggttcgagacgaacgcgacgacgccgatcgcgggcgccaaggtgcggctggagtgccggcactacatgagcgcgagcggcgcggtggagcggtcagcggagggcaccacggacgcggcagggaagtaccgcatcgagctggtggacaaccgcggcgccgaggaggtgtgttcggtggcgctggtcagcagccccgtgcccgggtgcgccgagaaggaggttggccgcgaccgcgcccaggtgtcgctgttcacggacgccggggccggcctcgccacc

SEQ ID NO: 46219 - DNA, 401 bp, Zea mays
  Clone ID: LIB3066-003-Q1-K1-H11
gaggtatcctgccctgcagttcctcctcggcggaaaccaagaccctagctctcgtcatcgtcgtcgtcggcggcggcggcgaccgcggcggatccgacagccagccctcgtcgcagccgggccgccatgccgtcgtccagctcccaagacggcgtacctccttatgttctccagatccggaaccgtgcggatggtgttcggggttcggcgaccggaaagaaaaacgttttggcccggtctcagctacgtacttcccttattctttgaccaagcctactgaggagaggaaagagcatgatcgcaagagcccggtgacagcattggaggtctatcccagcaaaaaaacagaccaccgatctttttgagaagaaacctcatcgctgatttacggccagcgtgtc

SEQ ID NO: 46220 - DNA, 356 bp, Zea mays
  Clone ID: LIB3066-003-Q1-K1-F5
agcatggtgatgtgcgatcaggcattctgtgcagccacctttggcggaaagctgccgaagtgcggcgccaatgtgccctgcgaatatagtgtcacctacggtgatggtagctcgacgataggttcctttgtcaccgatgctctgcagtttgatcaggtgactagggatgggcagacacagacggctaatgccagcgtcattttcgggtgtggtgctcaacaaggttgggatttgggaagttcaaaccaagcccttgatggaattcttggttttggtgaggcaaatacatcaatgctatcacaactaactaccgctggtaaagtgaagaagatatttgcccatagttaggataccat

SEQ ID NO: 46221 - DNA, 412 bp, Zea mays
  Clone ID: LIB3066-003-Q1-K1-F6
cccacgcgtccgatacgtacgtgaagaaccaacaggagggccgggctctcgctcgccgcgcgcacccccctctctctatctctcccgccgccgttgatctatcaccgggccgccggtccgtgactgtcgccagcggctgctggttgttgcttggttgcgtcgccgcgggagccgtgtgacccgggcgcaatgccgggagccgtgatcgtgcaccaccacacgaggtacaagacgtaccccggcgaggtcaccggcatcgccatcttctcgtgcttcatcgcctccgtcgccggctgcatcttcggctatgacatcggcctcacatccgggctgacgtcgacggagccgttcctggtcaagttcttcccctccatctacgaggagatgaagaggcaggtggtcgtcaaccagt

SEQ ID NO: 46222 - DNA, 428 bp, Zea mays
  unsure at all n locations
  Clone ID: LIB3066-003-Q1-K1-F7
gttcccatccattggtgtggacgtgtggtggttgcgttgcgttgcgttgcttcgagttggaggttggagttggagtgggccgcgtgcgagaggatctgagcggagaggccatggagtggagtgattagcggttgctgggtcaggagaaggcggcgtgtgttttgatcctactcgcgtttgaggggccccgatttcgagcgggtgttcaattttggtgccggatttttaaggaggatccaatttaggaagaattttggttttggggacaatggttttggactgcctgatattcgattcataggacttcgagtcggcagatccaagggaacgccgaattttgcctgatttcttcgcgatttttggtccgatcaaagaggttcctagcctttttttttcctcgcgagaagcaaggggtctnccttttcttc

SEQ ID NO: 46223 - DNA, 416 bp, Zea mays
  Clone ID: LIB3066-003-Q1-K1-F8
cccacgcgtccgttttttttttgaccaaaaaaaatttatattattcattcacaagacatcaataaccaatgacaatccgaacacatggtgttgtttgctagtagcctcatcaggcgtctcattagaattgaatggaccttaacatattgtgtccaaaaatcacaggtgagaagcataggtagcgacagttattgcagtcttgatgaataggggaggaaagcggcggccgatagaccggcacaaaactttgttcgcgctaatgaagaaacggcaacgaaaacgggggcaggagaggctggcggcggtaacggctcccccacggcttgcatttctcgggcccaaagaattagaagcatttcctgtggacgatggatgggccggactcgtcgtactcggccttggcgatccacatctgc

SEQ ID NO: 46224 - DNA, 415 bp, Zea mays
  Clone ID: LIB3066-003-Q1-K1-G1
cccacgcgtccggccctggagaccagtgcttcctcgtcttcaacgctgttggtggaggaacgggctctggccttggttccctcctcctagagcgcctgtctgttgactacggcaagaaatccaagcttgggttcactgtgtacccttccccccaagtttctacttcggtagttgagccatacaacagtgtactgtccacccactccctcctcgagcacactgatgtggctatactgctggacaatgaggccatctacgacatctgccgccgatcccttgacattgagcgcccaacctacaccaacctcaacaggcttgtgtcccaggtcatctcatcccttactgcctccctgaagttcgatggtgctctgaacgtggatgttaacgagttccagaccaacctggtaccctaccc

SEQ ID NO: 46225 - DNA, 361 bp, Zea mays
  Clone ID: LIB3066-003-Q1-K1-G10
cccacgcgtccggtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttggtggggcatgcatgatcgcagacaactgcgccaatgtgtgccgcggtgaaggcttcttggcccgcaagtgcaacacctttcggcggcggttcatttgcactaagcaatgcttaacaagatcggttgatcggttgccatgcattgacaacctattcttaata

SEQ ID NO: 46226 - DNA, 420 bp, Zea mays
  Clone ID: LIB3066-003-Q1-K1-G11
cccacgcgtccgcccacgcgtccgcccacgcgtccggccaagggcaagtacacggagcgcgccgccgcgtccctgctccgcaccatcgtggagatcgtgcacacctgccactccctgggcgtcatccaccgcgacctcaagcccgagaacttcctcctcctcaacaaggacgagaaagcgccgctcaaggccactgacttcggcctgtccgtcttcttcaagcaaggggaggtgttcaaggacatcgtcggcagcgcgtactacatcgcgccggaggtgctcaagaggaactatggccccgaggcggacatctggagcatcggcgtcatcgtctacatcctcctctgcggagttccgcccttctgggccgaatccgaacacggcatcttcaactccatcctgaggggacaggtcgacttc

SEQ ID NO: 46227 - DNA, 406 bp, Zea mays
  Clone ID: LIB3066-003-Q1-K1-G12
cccacgcgtccgggtttttgtaaggaaaatccccgtcgttctcgcgtctggagctcggcggcggagcagggcggcagggggagggcgatggaattctgcccggtgtgtgggattctgctgcagatcgatccgggcaccggaagccaccgtctgcgcctcttctgccccgtctgcccctacgtctgccccatcctgaacaagatcgtgaagaaggcgaggttggtcaaaaaggaggtggagcccatctccagcacggcggatgagatgaaatcggcccctaagaccgcaattacatgccaaagatgcaaccatggagaagcatacttcaagcagatgcagattcgatcagctgatgaaccgatgacaacaatatacaggtgttgcaaagaagaatgccagcatgaat

SEQ ID NO: 46228 - DNA, 408 bp, Zea mays
  Clone ID: LIB3066-003-Q1-K1-G5
gtcttcaagaaggtatcccgtgcggtctactgcgccttccgtggcatcatcttaggtggcagtggtcccaagggccagaagctggcggacgcggcattgcgccgcatcggcgccaccaaggttgtcgacagggtgttgaaggctgctgaggtgctgatcaaggtggcaacggtatcagagaaggtccacggtccctggtacaaagctctgatagtctgatgtgagcgtgaatgtgaatggtttggcttttgtgaatacagacagtgaaagtgtaaattccttgttccactgggtgggatgggagatatggtgttgtacagcaatttatagttgttggtcagtaggcagttcaggatgtgaagaattctggtgagctgggcgaatatggatgctctttcaccaagattt

SEQ ID NO: 46229 - DNA, 316 bp, Zea mays
  unsure at all n locations
  Clone ID: LIB3066-003-Q1-K1-G6
gtctgctttgtgtggccagtgatattgccgtgagtatttttggatcctattcgagtcgaatgtaccagtaccagagttaatttgctttaattcgaaacaccgttccggttggaattctgttacccgtgttctttgcttgcagttcctctatttcttttttgcatcggatggtggcggttccttttttttacattggctgttgtggttctggtcagactgtgttggtctagattcttgctttgtgtgatcggaaacatgctatcgcgcgtggcagagctgttgggtgaaaaaaaaaataananatatagtgttgaac

SEQ ID NO: 46230 - DNA, 421 bp, Zea mays
  Clone ID: LIB3066-003-Q1-K1-G7
cccacgcgtccgcggacgcgtgggtgactggttttgagatcaatgtattccagctgccagagcctttcggattcattttcacatggtttgctgctttgcccctaatattgttcttagcgcagtcattgactaaggctatagtccaggattttttaatccttaaggggccatgtcctaattgtggtactgaaaacctttccttctttgggactatactgtcagtctccagtggcggtacaacaaacaaagtgaaatgtgcaaattgcagtaccgagctggaatatgactcaaaatctcgggtgatcacacttccagaagcatcaaatgcataaacataggtgactctacatttacgccagtaactataaatggatgctctttggtctatattccaaatgtgggagatatcacaccagctttg

SEQ ID NO: 46231 - DNA, 310 bp, Zea mays
  unsure at all n locations
  Clone ID: LIB3066-003-Q1-K1-G8
gctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgnggcgccggcggcggggaggagctctcggtggaggagcgcaacctgctgtccgtcgcctacaagaacgtcatcggcgcccgcagggcctcgtggcggatca

SEQ ID NO: 46232 - DNA, 412 bp, Zea mays
  Clone ID: LIB3066-003-Q1-K1-G9
ggagttctacagcctctgcgaggaaatggacctgcaggcgctaccgctaccactagaggacggctggaccgtggacgcgtccaatttcgaggtcccctgctcttccccgaacccagcgccgcccccggtggacagggctaccgctaacgtcgccgccgacgcctcaagggcacccgtctacggctctcgcgcgaccagtttcatggcttggacgaggtcctcgcggcagtcgtcgtgctccgacgaagcggcgccggcagtagtgccggccatcgaggagccgcagagattgctgaagaaagtggtggccggcggcggcggtgcttgggagagctgtggcggcgcgacgggagcagcacaggaaatgagtgccaccaagaaccacgtcatgtcggagcgaaagcgacgagag

SEQ ID NO: 46233 - DNA, 406 bp, Zea mays
  Clone ID: LIB3066-003-Q1-K1-H1
cggacgcgtgggctacaacatgggtgtagccatgccgacgcagccaaatgcagttccaaacatgggctggttaccaaatccaggaaacaccagcatgaacatgatctgggctgcaactcaaggccaggggactccaaatgcggctcctatgatgggaggtcagatgcaaggagtcccaatggccccttggggtggtgttgcagcaggaagtgcaaattcttatcctgcctggggaaaccaacaagctggaaacatgaaccaaaatgttggctggagtgctcctgtgcagggaaatccaggtcaggcaaataacaacatgaactggaacgcaccaaatggtaatcctaattggaataatcaacagagagagaatgggggcaggcactctggacaccgcggtgctttt

SEQ ID NO: 46234 - DNA, 414 bp, Zea mays
  unsure at all n locations
  Clone ID: LIB3066-003-Q1-K1-H10
cccacgcgtccgcccacgcgtccgcccacgcgtccgggcggtggccgtggtgaccatggctctgtcagcctcctggtccgcaacattccattgagatgcaggcctgaggaactacgtgtccctttcgaacggttcggccctgttcgggatgtttacctgccaagagattatcacactggggagccaagaggatttgggttcgtggagttcgttgatgcttatgacgcttctgaggcacagtaccacatgaatcgccagatgtttgctgggcgtgaaataactgttgtacttgctgcggatacacggaaaaagcctgaggacatgcgtagacgaactggaccaagaggttattctggtcatgaagggcgtcgtccgaatcgtcatggtgcangacggtcccgatctcgttcatac

SEQ ID NO: 46235 - DNA, 439 bp, Zea mays
  Clone ID: LIB3066-003-Q1-K1-F2
attactatcttcatgtgacgacagctggggatgatcttatgtctgatagctaccacttgagttctgcacctggaaataatgtgttcgtggggtctggagctgcattgaaccctgggaccatattgagccctgtcccagcatgcaaagaggatttctcacggaagaagcttacttcgttcgacaaacttatagaaagaacatgtagttctataaggaatgtaaggcttcattgtgacgctgatctaaagccaagtggaggtgttggaacttctggaatggcaccagatgcagctgagatacagcttaaaagccccaactggttgtttggtcaaaggaagcatacggagacaatttcaaccgcaagagttgccccggttgaaaacgtgaacgaggggaacagagacgagtcaaatgtgtctctttgtggggaactaatttg

SEQ ID NO: 46236 - DNA, 417 bp, Zea mays
  Clone ID: LIB3066-003-Q1-K1-D7
atctctctcccccggctccggcgatggcttcgccttacgccggcggcgtgcagcctggctctcccgctggggcggtgcagcagcagcagcagaaccactctctggcgttccgcgtgatgcggctgtctcgcccctcactccagccagacctggccgctctgctccgcttcgacccacgcgacgtcttcctccctgaggacgcgctcaccggctccgacccgtccgctgccgccaaattcctccacggcctcctccaccctgcggactccgccactgccgtccctggagacttcaccttccgcgaccgcttcctcctccgcgacccagccgacgcgctcgctctgccgggcctcctcgtcctcccccagtcgttcggtgcgatctatctgggcgagaccttctgcagttacatcagca

SEQ ID NO: 46237 - DNA, 324 bp, Zea mays
  Clone ID: LIB3066-003-Q1-K1-D8
gcggcgagggaagggctccgcgtcgagtccgttctcttactcctgctctctccggcggcccatccatcagcgctgccctacgcattgctcttgataccatccagtacatcgattctccccccaagatcaaaggccggagaaggaggaagaaaggctagggagtcggctatggcatgctgttcatgctgctgtgtggcagatgacgacaacgttggcaggaggacgaagcatgacgatccctatgttcctatccctgctcatgtctataatcctggacctagccggttcccatgcccaacccctgtcatctccactggcagagct

SEQ ID NO: 46238 - DNA, 321 bp, Zea mays
  Clone ID: LIB3066-003-Q1-K1-D9
cagttacatggcgtgtatagacaatgcaatgagagccttgttccttttagcgggcttgtgtgtcgtgcatggtgagaaggcaaagtcaaaggacaacgatgcaaaagcgtccgggcccggtgggtccttcgacatcaccaagttgggcgccttcggcaatggcaagactgatagcacgaaggctgtgcaagaggcgtgggcatcaacgtgcggcggcaccgggaagcagacgatcctcattcccaagggcgacttcctcgtcggaccactcaacttcacaggcccatgcaagggcgacgtgaccattcaagtgaatggcaa

SEQ ID NO: 46239 - DNA, 342 bp, Zea mays
  Clone ID: LIB3066-003-Q1-K1-E11
aaaaagaaaaggcaaaggcaaaggaatcccaatcaggcaagcaaaaggaagaacgagcggctgcggagtgcggagatgtcgtcgcagctgatcgaggagcaccggtcgggcgcggaggtgcacgtcgggcacgagctgtgcgagcgcaagtcgcgcgagttcatggtggagctgggccttcccgacgggctcctaccgctgcccagcctggacgaggtgggctacaaccggtcgacggggttcgtgtggctgcagcaggccgccggcctgacccacaccttcgggttcatcggcaagcaagggtggtacgacagggaggtgacggctttcgtggagccggtg

SEQ ID NO: 46240 - DNA, 371 bp, Zea mays
  Clone ID: LIB3066-003-Q1-K1-E12
ctccgacgccatatcatatctcactcgacctgcaactgcaaagactccttttagcgcgctgctgatgcgtcgtcgaacgcggcacgcggtccttaaagcctgcatgcgaaagccaggcaggcgtggacgtagtgattagaaacggttcgggttagatgggtcgagaaaacccaggtgcggccgtgcgggtgccgggtggtgcttgtcgcagctggtgcggttcgctcagctggtttgatgactgatcggctctagcgagtggacgactcttcctcgtttggatctttactcaaggaattacgaacagcatgaagatcttgggtgctcttctacgcgtcgtcacatgctatggctaacaaaaatactttacg

SEQ ID NO: 46241 - DNA, 410 bp, Zea mays
  unsure at all n locations
  Clone ID: LIB3066-003-Q1-K1-E2
gcgcgccacgcggcgacatttcgaataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgtggcaacgtccccatttcaaaggccggcaagggttccggttcatgctattangtgagatgcaaggaaaaacctgagtgctcgggcaatccagtcacggtgtacatcactgacatgaacta

SEQ ID NO: 46242 - DNA, 103 bp, Zea mays
  Clone ID: LIB3066-003-Q1-K1-E3
catggtacccgccctgtatcggagcattaagcgcatctgatgtggtattgacacgcaccctgatccgtacaatttccagcgccctatgtgcctgtcacttcaa

SEQ ID NO: 46243 - DNA, 317 bp, Zea mays
  Clone ID: LIB3066-003-Q1-K1-E4
cccacgcgtccgcggacgcgtgggcgctcctaggggcggaaggccgccgtgccggatgttgggatatgcagcaagggggcagtgcgcacggatgcaatgcatttgaatggctgcacgctgggctctggtagctctgactatcgtgaaggcgagatatgcgcgagatatgtttcgaatgacgcctgcgatcttcaaaatcatgagcgttacacatagctattgtcgatgatgatatgatgcactaatggagcctaatggtggcataaagtatagcagtagttgttatatgatgtatgaaggtgacgttgactacagca

SEQ ID NO: 46244 - DNA, 414 bp, Zea mays
  Clone ID: LIB3066-003-Q1-K1-E5
gaagaaggtcgggcgttacaagcaaatcaagcgaacagaaggtgtctcgagcactgacgatagttgggaggatattgctaacattcaggcagaaagatgctggcactgatttaagtgttgtcattgctgagaagtctggagagaaatcaaatgatgaagtgaaaagtcagctatctcatttccttccaacttctcgccggatcatgcagttttcaaatgggcaggctccttcgccaggtgctcgtgttgtctatgtagatggcacatttgatcttttccacgctggccatgttgagttcctcaggagtgccagacaacttggtgactttcttcttgtcggtatctatgacgacgagtctatcagggatagaagaggctgccgtcctataatgcatctccatgagcgtactctta

SEQ ID NO: 46245 - DNA, 421 bp, Zea mays
  Clone ID: LIB3066-003-Q1-K1-E6
gttgccaaagaattccctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtag

SEQ ID NO: 46246 - DNA, 413 bp, Zea mays
  Clone ID: LIB3066-003-Q1-K1-E7
cccacgcgtccgcccacgcgtccgaccagagctcctgactgttcctctctccctcctgacgggcgggctccgtctgttccgtccatccaccgccccggtcgtctcccggccagatccctctcctgcaaggtttctttgcgagtggccggagaagatgatgggcgggttcctctccagggtcctgctgctggcttttggctatgcctatcctgcctatgaatgctacaagaccgttgaactgaacaaaccacagattgagcagctcatattttggtgtcagtattggattttagttgccctgttgacagctttggagagattcggagattttacaatatcatggctaccgttttactcacaagcaaaggcgttgatctttgcatatatggggtaccctacgacaaatggaacta

SEQ ID NO: 46247 - DNA, 423 bp, Zea mays
  Clone ID: LIB3066-003-Q1-K1-E8
cggacgcgtgggaggcacctcaagtgacatttaaaaagcctattgggagtgtcagcgtctctgggcacaagtttgtcggatgccccatgccatgtggtgtccagataacaaggttggagcatataaatgccctttctagcaatgtggagtatctggcgtcaagggatgcaacaatcatgggaagcaggaatggccatgcccctatcttcctctggtacaccctcaacaggaagggctacagaggctttcagaaagaagtccaaaagtgcttgagaaacgcacactacctaaaagatcgcctcaaggaagcaggaatcggagcgatgcttaacgagctcagtagcacagtcgtgtttgaaaggccaaaggatgaagaatttgtccgaaggtggcagctggcttgtgaagggaatatagctcacg

SEQ ID NO: 46248 - DNA, 367 bp, Zea mays
  Clone ID: LIB3066-003-Q1-K1-F1
aattcatagaagcctgggggtgcacatatctaaggtaagatctgctaccctggatacatggctgccagagcaagttgcatttatccaatcaatgggaaacgaaaaagcaaatagccattgggaagcagagctgcctcctaactatgatagggttgggatagagaatttcatccgtgcaaaatatgaggacaagagatgggtaccgaggaatggaacattgcgaccttcctccggtgttcgagatgagaagagccaagagtctccagctagtgctaataggagtggacatcatagatcttcatttgagcaaaaccgtgcttcaccagctcttccgagcaaagttgcacatgtagcttcaaggataccc

SEQ ID NO: 46249 - DNA, 339 bp, Zea mays
  unsure at all n locations
  Clone ID: LIB3066-003-Q1-K1-F10
cccacgcgtccgcggacgcgtgggcttcagcctcgacttcgagaagctgcagcgcgtgacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgctccgcggcggcngnctnatccggtccctctagcgcaccagcgccatcgtcgtcgtctgagtcc

SEQ ID NO: 46250 - DNA, 331 bp, Zea mays
  Clone ID: LIB3066-003-Q1-K1-F11
cccacgcgtccgactagttctagatcgcccagaaatctggccaccctcctcgcgcggagcgacccgagggtgccccgtccactctcgtgtcggtcccgcgatgggcatgttcgcatcggccgcaaagagatacagcaacggcaagaattttctccgcagcgcgggcgtgtgctgttgttcgccgtccgcctccgcccagcttggtggtgtgcgcggcaaggaagagacatcgacctcggcgccagctttcgcgccggatagcaacaagaaaaggtggaggaagaagaagttctggagaaagaagatgaaagccaagaaggagatcggcggg

SEQ ID NO: 46251 - DNA, 325 bp, Zea mays
  Clone ID: LIB3066-003-Q1-K1-F12
ggccaccaggatggccatcgaccacgccgccagcaccgagtccaagatcgacgacctggcggagctggaggcggcgtcgtcgtcggatccgcaggcgcgcgcccgcttcaaccactgcctggagcagtacggcggctccgccgacctcctccgcgacgcgctggacaacctcaaggcgaagatctacggcaaggccatggagcagctgaccgccgcaatgggcgcctcctagagctgcgaggacgcgtggaagggcgaggaggaggatgtccctgtcaccgcgcacgacagggagtacggtaggatggcgcacattggcttcgga

SEQ ID NO: 46252 - DNA, 385 bp, Zea mays
  Clone ID: LIB3066-003-Q1-K1-D6
cccacgcgtccggaactgtccgctgtcgtgactgacgttggggaggtcggcctgattgttgatggggcgcggacctgggcgtcgcgcagccgcctgtcccacgtggcgacgttgcgggagcagtgcgggagacgacatcatgagtgcggaaggtggaggggaatcaaccactgcattggtgtagattggcgggcaacctgtccgggctgccatcgtcggacggcgaccaaatctaggcagcgcgtgtgttggtggcctgcaacgaggcctctactcgactgacgtggtggacgcgacagccatcgagcgcaaggtggaaataatggtgatcttgaggatcctcgcgttgcgcagcacacatagttaatctaatctcgggacacgc

SEQ ID NO: 46253 - DNA, 438 bp, Zea mays
  Clone ID: LIB3066-029-Q1-K1-D7
gcaacaactcctcattacaatccttcaagagagcagcactacactacactacattagagagaggtcgagcgcccctcctccgatccgccggcccgccgagagctagctgctgatcggtcgaggagagtcatggcgacgtcgacgatgcgcgttgccgccggcgtgctgctggtcgtgtcggcgctggcgaccttggcccgggccgaggacccctacctgttcttcgagtggaaggtgacgtacgggaccaggtccctgctgggagtgccccagaaggtcatcctcatcaacggcgagttccctggccccaggatcaactgctcctccaacaacaacatcgtcgtcaacgtcttcaaccagctcgaccatccgctccttttcacctggaacgggatgcagcacaggaagaactcgtggatggacgggatgccaagcacg

SEQ ID NO: 46254 - DNA, 440 bp, Zea mays
  Clone ID: LIB3066-029-Q1-K1-D8
cccacgcgtccggtctctttccccgtcgtggtgggttccgatccaatcgacgtcgacgactccgcagccaccgctcctctcctctcgtcgcttcttccgtctctcggcgtcgaatctcatccggccagtgaccacactctactagccgcccggaaggagttcttccgggattcgagccttgctgccctcacctctgcaggcccagcgtcgagcggagatccaatcggaaattcaactgacttcgtcttttgtcgcatccccgtcaggagaagcaatgtcaggagtgatcacaaagttcgcggttacatccatggtgatgtggatggcccctgttgcgatcatgtatgggttttactaccaggtgtttccaggtgtgagtcagatgtcatcctcggcgcagacacttgccagtgggttcctggctgtcatatcggttaatc

SEQ ID NO: 46255 - DNA, 432 bp, Zea mays
  Clone ID: LIB3066-029-Q1-K1-D9
ctgtcctctcgtgtctacagcttcccttgctggctagggtttgcagatgacgacggcggcgtgccccacctaggcgccggccaagggcggcaacgagcaggggggcactcgcattttcggcccctcccagaagtacttgtcccgcgacctcgccgcgcatacctcgctcaagcccagaaaagacggtcaatagacccaagaggagttacagaagaggaatctcagggaggaacttgaggaacgtgagcgcaagcactactcttccaaggataagtcctatgctaaaaaaagagaccggcggaaaagctcaagccagctactcctagaaggttcaaagagagaggcagaggataagatagttccacaagaaattgatgcagatgactccgatgtggagcctaaaagtgacgatgagagagaagacaacacaac

SEQ ID NO: 46256 - DNA, 430 bp, Zea mays
  Clone ID: LIB3066-029-Q1-K1-E1
cggacgcgtgggcggagcagagagagacttcctcgcctccatcccatcccgccgccgccgtctctacggtcgctaataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttggttgtttttttt

SEQ ID NO: 46257 - DNA, 406 bp, Zea mays
  Clone ID: LIB3066-029-Q1-K1-E10
gacaaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgc

SEQ ID NO: 46258 - DNA, 423 bp, Zea mays
  Clone ID: LIB3066-029-Q1-K1-E11
ggatggccagcttcagttacatggtgggttcttaatataactggtttggcaaccatggctctcctgggtgaatacctatgcatccggcgggagttgaaagaaattccaatatcacggcttcgtgcaagtgtttaagctcacatgctaaaagattataggtgatttcaaatggtgttatcccaggaggtgcttgttaatatgttccttaaggaatacagtgactcacaatgaatgctttattctgtgatttccaatggatacttctcaaacttcgcatatagcgttcatctgatgcccaacctcccagttgaccatgatgaactgattgatcctagaggttccaccaacggaaatggcagctcactttctaaatcatacattcaacaagtcctcccttgccccttattataaaaaagagttcct

SEQ ID NO: 46259 - DNA, 426 bp, Zea mays
  Clone ID: LIB3066-029-Q1-K1-E12
gaaaatgagtaatccccctttaccctcaaaagaagggaagaaaaactaggctgttcagggcacatggataaaattcgcttctcttctctttcttcgttgcagcattgcatcctacaaaggtagcatcgtaaattctattcaaggatgctaatgtgctatcacctttaattcatcctctgaccaaaggctacatggtcctctaccgcaactatttctgcaaacatcgagctgatctcggagcccggagctgcaatctgacaacagtgcgtgtcgcaacaggagatcgggtcaccggaatcgatagaaaggacgattagactatggtgccccgaattaccaatcgagttacacgccacagatcgcggcttgggatttgggacgtccccaaatcagaaccccggacttagctgcataggcagagagaaa

SEQ ID NO: 46260 - DNA, 443 bp, Zea mays
  unsure at all n locations
  Clone ID: LIB3066-029-Q1-K1-E2
gacgatggcccggccgcgcctcctcctcaccttcctgctcgccgcggcggccgtgctgaccacggtgcccggcgtcgcgctcgccaagtcgaagctcgccaagaagagcgacgacgtcgtgaacgggcccctcctgaccgagaagatccaggcgaagaagacgctgatcgtggggccggacgaggagttcaagaccgtgcagtccgccatcgacgcggtgcccgccggcaacgccgagtgggtcatcgtccaccttcgctctggcctgcacaggggcaaagttgtgataccggagaacaagcccttcatcttcgtgaggggcaacggcaaaggccggacctccatctnccacgagtccgcctcttccgacaacgccgagtccgncgcgttcaccgtgaactcggacaacgtcatcgtcttcggcgtcagcttcaggaacagcg

SEQ ID NO: 46261 - DNA, 443 bp, Zea mays
  Clone ID: LIB3066-029-Q1-K1-E3
cgccaataactgggtcgtccacatggagggaggagggtggtgcaggaatcctgatgagtgtgcggtccgcaagggcaacttcaggggctcctccaaattcatgaagccactctcgttttcagggatattaggcggcaaccaaaaatccaatcctgatttctacaactggaatagagtaaagatcagatactgtgatggttcatcatttactggtgacgttgaggctgtggacactgtgaaagatctccgttacagagggttcagagtctggcgtgccgtcatcgatgatctacttactgtgaggggaatgagcaaggcgcaaaatgctcttctttctggatgctcagccggaagtctagcagcaatactacactgtgacagattccatgatctgtttccagcgaaaacaaaggtcaagtgtttttctgatgcttgatattttt

SEQ ID NO: 46262 - DNA, 443 bp, Zea mays
  Clone ID: LIB3066-029-Q1-K1-E4
gggatccaagcctggccacctgatcctcacccccaatgttgcaaccatatccgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgctgacgacgtcatccccgctgatttcaaggccggcaccacctataagaccacactcagcatctaatcagcctctgatgatgaattatatttcaaaagagctcacctggtgctcatgttagcaagacaatattttttctatggttattttgtggcaccaaaccacccaagaaatatgtgatgctacatgtcccttctgatgccttgttgtgttgggttgatattattacataaactaaataaat

SEQ ID NO: 46263 - DNA, 424 bp, Zea mays
  Clone ID: LIB3066-029-Q1-K1-E5
ggaaaagttatatgatgctggcaaagctcgcgctattggtgtgagtaacttctgctcaaagaaattgggcgacttgcttgctgtagctcgtgtacctccagctgttgatcaggtggaatgtcatcctggttggcagcaaactaagctccatagcttttgtcagtcaactggtgttcatctcactgcttactcaccactaggttcacctggtacaacttggatgaatggtaatgtccttaaagaaccaataatcatctcaatagctgagaaactcgggaaaacttctgcacaagtggctctgcgctggaacattcagatgggtcacagtgttcttccaaagagcacgaatgaagaaaggataaagcaaaaccttgatgtatatgattggtcaattccagatgacttgcttgcaaagttctctgag

SEQ ID NO: 46264 - DNA, 437 bp, Zea mays
  unsure at all n locations
  Clone ID: LIB3066-029-Q1-K1-E6
ccacctcttcctccggttgcctccgccctcgggcctcgccttcgctccatcgtccccgtctccatcctccaggaccggcaaccccacgtagcgcgacagctcgtcgccgtagtccatggcggctacggaggtgtactcgccgaccacggcggcggcagcgcagcagcagcgggggaaggcggcatcgcaggcgtggcgagcggtggtagggtggatcggcttcttcctccaagtcctgcttcagatcctccggggcacgccctcctgcgcacagctcctgtccttcgttggtttccgctatccgctcctctccggacctgcggtctcggagccgttgccggaggtggccttcatgccgctccactccgagatccctgctgacgcggcgcctgcgccgaaacctgcgtctgagcccctgggccgnctcacggtagtgc

SEQ ID NO: 46265 - DNA, 151 bp, Zea mays
  Clone ID: LIB3066-029-Q1-K1-E7
agtctgattaagtactagtaaatcattcatgtcatgcatggcacattaattaccttattattagtccttgctgagatggatcagatcttgtgagttaagtaaagcatgcaagatatgtcgacagacactacatgagatgacacggttctac

SEQ ID NO: 46266 - DNA, 81 bp, Zea mays
  Clone ID: LIB3066-029-Q1-K1-E8
gtggtgacatcggtccccacctacattgatggtcatagagtctgcccttcgtttgtcagtcgggcaatttttcttgcatac

SEQ ID NO: 46267 - DNA, 66 bp, Zea mays
  Clone ID: LIB3066-029-Q1-K1-E9
accacgcgtccgcgaacatggggcaatcctttcaggccgtcaaggctcatgcccagggcgagtgcc

SEQ ID NO: 46268 - DNA, 424 bp, Zea mays
  Clone ID: LIB3066-029-Q1-K1-F1
gcagcagggaacatcgtccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgaccacgccggcagcaccgagtccaagatcgacg

SEQ ID NO: 46269 - DNA, 428 bp, Zea mays
  Clone ID: LIB3066-029-Q1-K1-D4
atccccatcttcaaggatggtctgggttgtgggtcctgcttcgagatcaagtgcgatgagcctgtggagtgctccggcaagcccgtggtggtgcacatcacggacatgaactatgagcctatcgcggcgtaccacttcgatttagcaggcacggcgttcggcgccatggccaagaagggcgaggaggagaagctgcgcaaggcgggcatcatcgacatgcagttccgaagggttaagtgcaagtactactccaagggcaccttccaccttgaaaaggggtgcggccccaactacctggcactgctggtcaagtacgtcgacggcgacagtgacattgtggcagtggacgtcaaggagaagggcttcgacacgtacgagcctctgaagcactcctggggcgccatctggaggaaagacagcgacaaacc

SEQ ID NO: 46270 - DNA, 419 bp, Zea mays
  unsure at all n locations
  Clone ID: LIB3066-029-Q1-K1-C12
gacgacgagttctccacccatccctctctcttcttcctccctctcgtcgctctctccgtcggcttcgcgtcggtcgtaagccgtcccagccggtgaggcgaggagcgtggaatatcgcgatgctcgattcaagctgcaacaatggcctcacccacggtcgccttcatccccaccgccgcgcccttgccggcctccccgtcgctgcgcctcgcatcagcgtaatccatcgtcgatgcgtccgggtcctcctccccggcctncacccactccggcctccccaatccggttgagccccgtcgacatccccactgtcgcgcccttgctggtctccccgtcgtggcgtctcgcgtcggcaccttccgtcgtcaacgcgttcgggtcctcctctccgaccttncgccactccggaaccagctctt

SEQ ID NO: 46271 - DNA, 432 bp, Zea mays
  Clone ID: LIB3066-029-Q1-K1-C2
gcacaagatggacgtcgccgatctcagcgaagggggctgcacggttgacaagaccggcaactgcgtccggctgactgagcctgaggaccccgccttcgtgctgacgagcgtcctagatccactatgagactatcagcaagcagaacctccgctagctaactaggattcacactaagaagtgtccactcatgatatgcaccaccgatgctgcctgccactggatcgtcaacgacgcgcgatgaccaaacatgtgcatcaactgctccactcctgctgccgtgaacctgtattgctgtgccaacatcccatgcaccagagtaaccatggacgacgaccgcatcatgtacagtgacgccaactacaggaccatgaacagttgcacaatcgctgaaggctgctccacagtgatcctaagagacctcgtatgctgat

SEQ ID NO: 46272 - DNA, 421 bp, Zea mays
  Clone ID: LIB3066-029-Q1-K1-C3
atctgactggcgaagcatcttgtagaatctgtcaggaaaacttcagcacaactgttaatggtatgccaaacctatgtataaaactgtaccggttgctcctaatttcacttctatgaattgtactaatttgcatcgaagaaagtttggtcccaaacaactcgtgaactcgttttcttattattgggctgatggacaaggcaacgtgaaatttttcatggtacctgtgaacagaacttagcctacaaactgcagaaccattcccatttcatcttgtagtcttgtctagctaatactggactttgtgggctgtctgatccctgtgtaattcatttgaccatgacagttcttgatcatgtgatatcatagaatgtgtcaaaaaccgcatcacatcaaaattaaaactggatacaacactatacat

SEQ ID NO: 46273 - DNA, 361 bp, Zea mays
  Clone ID: LIB3066-029-Q1-K1-C4
cggacgcgtgggcggggctgacctggaagatcaccgtggacggctggagcgaggagaagaagaactaccactacgactcggacacctgcgaccccggcaagatgtgcggccactacaaggccgtcgtctggaagaccaccaccagcgtcggctgcggacgcatcaagtgcaacagcggcgacaccatcatcatgtgcagctactggccgccggggaactaccacggcgttaagccatactaaaatatatatcgacccattgcatatatatatgttgcagagctttttattttggcaacatatctagtgcatatggactgctggtatacatcatgcacatattaaatcctatcctttaattt

SEQ ID NO: 46274 - DNA, 422 bp, Zea mays
  Clone ID: LIB3066-029-Q1-K1-C5
ggaaaagttatatgatgctggcaaagttcgcgctattggtgtgagtaacttctcctcaaagaaattgggcgacttgcttgctgtagctcgtgtacctccagctgttgatcaggtggaatgtcatcctggttggcagcaaactaagctccatagcttttgtcagtcaactggtgttcatctcactgcttactcaccactaggttcacctggtacaacttggatgaatggtaatgtccttaaagaaccaataatcatctcaatagctgagaaactcgggaaaacttctgcacaagtggctctgcgctggaacattcagatgggtcacagtgttcttccaaagagcacgaatgaagaaaggataaagcaaaaccttgatgtatatgattggtcaattccagatgacttgcttgcaaagttctctg

SEQ ID NO: 46275 - DNA, 431 bp, Zea mays
  Clone ID: LIB3066-029-Q1-K1-C6
atccggtggcgccagtgcaggtaccagtgctaccgtgggtgctggtgtctccggaggtgccaaagttggtggtggcgtaggaggaaatgcaggaggaagtggcaacgtctatactggaaccggtgccgatgcaagcgtttctggtggaggatccggtggcgccgatgctggtattggagctaccataggtgctggtgtctccggaagcgtcaaatttggtggcggcgccggaagaagtgtaggaagaagtggcagtgctgctgcaggtgcttctggagggagtaaatcatcagggggtggctcagattttggatatggttcaccgagcaaggagttatagaggatgatgaccacttaccaccgtaagatcgatatgatccgtcccaaggaatttattcctgccctttttgttatcgcgcgttgttttatta

SEQ ID NO: 46276 - DNA, 409 bp, Zea mays
  Clone ID: LIB3066-029-Q1-K1-C7
ctagttctagatcgcgagcggccctttttttttttttttcgcactcatattatctcggtattctctccttaccaaggtcagaaccccagaagcagcaaagtcgacaagtcacgcacccagaacatgaaacgaaggcatacaattacaacacataatactagctactgtcttccacaacgcaacaggtaccctcctatagctccccagcatgtaacttgtgccaagagcacccaccagtcctccacaccaagcatcaacaaataaacatgcgtaatctttcgagtcgccgcaactatccctctaccttctctgttcagcttcggctacttagaaagccagtggtggcagaggcaagctgttgttgagccccgaccgcatcctcctcttcctgagcctctctgcaatgatg

SEQ ID NO: 46277 - DNA, 440 bp, Zea mays
  Clone ID: LIB3066-029-Q1-K1-C8
gaattaggcaagcgattattcgcatcgttgcttaggtgctctaacaagccgcaattggttagagattggatcaagttccaggctttttaaaaagtgccttccagcttacttaattgactcgcatgggctttctcgctataaacgaactaaacgaagcgcctaaagagagagatccgcgggacaccagtcaatacagtaaaaagagagtattctcttatgtagtcttattccttcccacccccttgtgggtgctgctcaagcagctcaagaggcgccaaccccacaaccacaggtagaatgagttccaggtgctgcgtccagatcagggactagtggcccagtcctgttcggatgtaaaggaaagatgaaaaacttttctcaaacagtggggaaagggccccatacgtcaaagccagatgaagaatctccaacatgattcg

SEQ ID NO: 46278 - DNA, 448 bp, Zea mays
  Clone ID: LIB3066-029-Q1-K1-C9
agaacggcgacaaggacgacgtcgtcaacttcagcctcgacttcgagaagctgcagcgcgtcacgctggacctgatcaccgaggcatccggatccatgtccgcaggcatcgccctgccaccctccaacgccggagcgccctcctacggggcggcggcgccgttcggaggcgccgcggacgcacccgccggcacctccgagggccctgccagcgccagcgggccatcggctggtgacgccccggcgtatggcgccagcgccagcgccagcggcccgactgctgatgctccggcgacggcgacggcggcggcgtcgtccgggccctctagcgcacccgcgccatcgtcgtctgagtcctccggcgcaccagggccgtcgtcgtctgatgggtcctccggcgccccggcgccatcgtcgtctgatgggtcctccagcgccccggcgccatc

SEQ ID NO: 46279 - DNA, 385 bp, Zea mays
  Clone ID: LIB3066-029-Q1-K1-D1
gtttggactatacaattctcgtgtctcgccctcccccgacgcgccgtctagggtttgacagccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggagcaccgggatcgggataaggatgacgggaaggagaaggagaggagccgcgatagccgcgggaaggacagagacagggaagggagagaacgggagaaggagaggggggacaggcacc

SEQ ID NO: 46280 - DNA, 425 bp, Zea mays
  Clone ID: LIB3066-029-Q1-K1-D10
gtttgtggcggacgatggcgacatcgtgctgatggaaatccaggacaagttgtcggctgagtggaagcccatgaagctctcttggggcgccatctggaggatggacactgccaaggcgctcaagggccccttctctatccgcctcaccagcgagtccggcaagaaggtcatcgctaaagacatcatcccggcgaactggagacccgatgccgtctacacttccaacgtgcaattctactagactttgaattgccttcgattcatccggcgcggcgggctatggacctgcagcaacaagctaattaaagtggcccatatatatataatatataatggaaaccctgggctttgattattggggaagccccaaccagaatgcggataggccaccaccccgcatgattacgttagcatttatgctggta

SEQ ID NO: 46281 - DNA, 429 bp, Zea mays
  Clone ID: LIB3066-029-Q1-K1-D11
gttcagttgtagccgttgagacttgggaggcaggcgacatgggtggcgggaaggacgacggccacgatccctcgaaggcggacaagggattccacggaggagggtacccggccgccgccggtggatactacggcggccagtaccccggcggcggctaccctgctccaccgggcggcggtgcgtaccctcccggccctgggtacccggtaccacctggtgggtacccgcctacgggtggctaccctcagcctggcggatacccgccgtcgcacggggcgtacccggcgccgggtgcaggcgcgtatcctcccagcgggtacccccatcaaccggtctacccacagcctggctatccatcgatgcccggtcatggtggcatgtacggaggaggccacggtgcaaggggctctgcatgccacggggcgatgc

SEQ ID NO: 46282 - DNA, 430 bp, Zea mays
  Clone ID: LIB3066-029-Q1-K1-D12
ctgtgtttatctatttctggattttctcgactccagttgtttctctcatatttggtagttacctatacatctgcatcaattggttccacatacactttgatgaagccttctcgtcgctgcgcatcgcaaactacaaatccttcacaaggttccatgttaagaaggatggtgatctagaaatatttactcttgcagttgacaaggtcccaaaggactggaagttggatccgaggtgggaatcagagggacgagggtctcatcagctcagccatgaccggaagcatccgagcaagtggaggtcagcctcatcaactgaccctgtgagatctgtacgggttggtgatcatttcaccatcgaaagaacaagaaccccagatatggagccctcttcctgattgtgcagcccttactattacaaggagttgcgact

SEQ ID NO: 46283 - DNA, 441 bp, Zea mays
  Clone ID: LIB3066-029-Q1-K1-D2
gtagcgtggcgggcgtggacgcggcggcgatgctgcggtcggcgctgcggcggggaggggcgtccgcgaggcaggtcgcgttggcgggagaagcctcgccgagagacctcctccggatgcgcgtggcggagcgggagcgcgcgaggcggcggcgtcgcgacccgggccgcgacgagttcttcgtgcccacgccagagtcgctggcgtggctcgactcggtctccctccccatggtgctcaccgccgccgccgtggccctcttcaccaagctcctcatgatggaacatgaagctacagatcaagaaaggagagagcgcaagataaagaatagccaccctgatcaaggaacagtaaggatgctatctcgtgaagaatgggaggaggtccaagaagtcaggccaaggaccccttttgaatcaaagttagctcgtccacatgccc

SEQ ID NO: 46284 - DNA, 420 bp, Zea mays
  Clone ID: LIB3066-029-Q1-K1-D3
caccggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggggcggcaacgttgggatgcatcgtgtttggttcatccgattaattaattgttttttttatttacgtggtttgcgattg

SEQ ID NO: 46285 - DNA, 421 bp, Zea mays
  Clone ID: LIB3066-029-Q1-K1-C11
ggtgcaggaattgtttattccgggggcaggaagaaggaggacgaggaggaggaacacgcgagagatagagagagcgctctcctatcttcttttgcttttggtattgttatcttgggatctgattttgtccccatacataccgagcgggagggaagggggcttgggttttctttctcctctcttctcttcttctaccctctcaccctcttctcctcccaaggctgactggccgtcggctcgggtctggggacagcaatccctgccgtcttgccatgctccccacgaggagcacaccgtcagagtgattctgcagaagtattcattctactggcgtgctgagcaggtgcatgagctctaataagcctagtgcgcacttcagtcatcagccaagtgattgaaaagggcacgtcagctgaaatat

SEQ ID NO: 46286 - DNA, 439 bp, Zea mays
  unsure at all n locations
  Clone ID: LIB3066-029-Q1-K1-A6
cacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgcagggagcacgccgaggccaagcatcccaagacagacgtgtaccagtgcttcccccatctgaagaagtgaaaggcctgaacttagcaaccagtgctggtttggccagngggcgttccttgtgttgagggtgttcattccgtggtatcttcccgtcagtcatgcgtcctgtcctatgttaacctacataaga

SEQ ID NO: 46287 - DNA, 409 bp, Zea mays
  Clone ID: LIB3066-029-Q1-K1-A7
aagatggcaaatgctctcctaggtggcctgtgggcgatcgtcgtcgtcgcggtggtcgtcggcgtggtcgccaccgtcacccactccggcaagaaggccggcgacgacttcaccgtcccgggggaagcctccattgccacgtccggcaagtcggtcgagtccctgtgcgcgcccacgttgtacaaggagtcgtgtgagaagacgctctcccaggccaccaatggcaccgagaaccccaaggaggtgttccacagcgttgccaaggtggcgctggagtcggtgaaaacagcggtcgagcagtccaagacgatcggcgaggctaatgccagcgactccatgaccgagagcgcgcgggaggactgcaagaagctcctcgaggacgccgttgacgacctcaggggcatgctcg

SEQ ID NO: 46288 - DNA, 365 bp, Zea mays
  Clone ID: LIB3066-029-Q1-K1-A8
gttatggcaccagtgttggtacaggcaacgcagcacggcatcgagtcaagccagttagcaagcgatggaacaggctacactgataggagagaacggctagaggagggatcggaagcgcgactgccatgggcatgggcatggagaccgcggatactgcccgtgcattctatacggacgtaaaacgaatcattatcaaggtaggcacggatgctgtcactggaatgaatggacgatcggccatgggcaggctagtctctctatgtgaacaggtgagacaactgaatgtttacgggtatgaggagattctgctgacgtaaagatctgttggtgtatgcaggcagatgatctagtactgtagacttatc

SEQ ID NO: 46289 - DNA, 436 bp, Zea mays
  Clone ID: LIB3066-029-Q1-K1-A9
tcctcgctggcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtacaagtacccggtcatcgacaacctggccgtgctgaacatgcaggtggacgcgttcgccaagcgcaccgcgcatgcgcgcaagcacgtcgcgaggtcggcccgcaccatcccgccgcagcagacgcaagcgctcacgttctgcgacaccatgtacatgaacacgcatgacacc

SEQ ID NO: 46290 - DNA, 406 bp, Zea mays
  Clone ID: LIB3066-029-Q1-K1-B1
aagatggcaaatgctctcctaggtggtctgtgggcgatcgtcgtcgtcgcggtggtcgtcggcgtggtcgccaccgtcacccactccggcaagaaggccggcgacgacttcaccgtcccgggggaagcctccattgccacgtccggcaagtcggtcgagtccctgtgcgcgcccacgttgtacaaggagtcgtgtgagaagacgctctcccaggccaccaatggcaccgagaaccccaaggaggtgttccacagcgttgccaaggtggcgctggagtcggtgaaaacagcggtcgagcagtccaagacgatcggcgaggctaatgccagcgactccatgaccgagagcgcgcgggaggactgcaagaagctcctcgaggacgccgttgacgacctcaggggcatgc

SEQ ID NO: 46291 - DNA, 218 bp, Zea mays
  Clone ID: LIB3066-029-Q1-K1-B10
cccacgcgtccgtttaaacatttgtttcgttcttggtgcttagcaaatatgcatcgtgagactaacaatcagttacatagctagtgttgatgcttgtgtaacaaagatgaatctgttggagctgctagggtgccaaaggtggggtcccctattcggcagagctctggcagacggtaaattctatgaatcgattcgtttaggctttgttcggttatttc

SEQ ID NO: 46292 - DNA, 418 bp, Zea mays
  Clone ID: LIB3066-029-Q1-K1-B11
ggaaccagaaagcatacgcaaacaagagcatccagcatggcccgcgcctgcgtcgggctgtctgctcctgctagccgtcgttccatggcgccgttcgcgggcgcacgcgcatcgacgtcgtgagggcaggtccatggcgtccgcggacgcaccggaggccgacgtcgacgctcccgctcctgctcctggccccgactcctcctcgaccccgtcgccggcacccttcagcagcagctcttccgactagccggccggcatagatatctacggtgtccgatcaggctttggcgccacctataacctatcggatcctgcaaagctatatatgattctatggcataatgcgtggctgcggcaaacgcccggaaataatgtgcttgcgtgatcgattgtctctgtctctgtctgcttaataatg

SEQ ID NO: 46293 - DNA, 386 bp, Zea mays
  Clone ID: LIB3066-029-Q1-K1-B3
cccacgcgtccgcccacgcgtccggaataattttactaatcaaattcttgttgggatgtattcctccaattcccctcctcctcccaacaaggcaacaacaatctgttccggccgccaaacaaaaccaaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcg

SEQ ID NO: 46294 - DNA, 383 bp, Zea mays
  Clone ID: LIB3066-029-Q1-K1-B4
cccacgcgtgcgcagacacgtgcgtcaacacgattgttcagaagggaactatgaggcgggcctacgaggcagacataccgactaatatgactctattggacggcatcttatcgaactaacgaactaacgcggactactacgcaatccgaacagagcttacgacagctacctaggatacagatcgagatgaatacgatcctcttcgacttcactgtatgaatgggcgactgggtcagcacactattgggatgaccaaaggccggaatcaacggcgcctcaactacttccgagtattactactacgctaccgatagcactggcgctaaagcatcctttggcaccaccgtactaacggacttcaccatgaactgtgcactatgaat

SEQ ID NO: 46295 - DNA, 404 bp, Zea mays
  Clone ID: LIB3066-029-Q1-K1-B5
ggccgcccgcctggggcccgcccgcgccattgctcgaatcgggaggcattcgtccgcgcgcgctgctgccccgcgccgtggcggtggcgttggcggtatgtacgaccgctagaaggaaggaggaggcggcattagtggtggggattaggcggcggcactgctggtgccgggaggaggaggaggcgtagcccatgaaggcgacggcgccgccggcgaagcggcggaggggcccgcggctggcggtgctggcgctcgtgttctgttcgctgctcgtgccgatcgccttcctcttcaaccgcttccccgccgtatatgtgacagatgagcgccctcagcaggagattgacttgccttcgttcgatcgtgtggtatttgaaaatggtggctctgtaattgaagatgtg

SEQ ID NO: 46296 - DNA, 347 bp, Zea mays
  unsure at all n locations
  Clone ID: LIB3066-029-Q1-K1-B6
caaggttaaaaacaatatctcagaaactgcagaagttgcacaggcagaggatacctctcctatggatatcaatagtcaatccaaccagaagcaagaatcatgtggaccgaatggatccaaagatcgtatactaagatcaacttctcgttcatcatcttccagagaaaaaactatggagaaatcatgcagttcagcacacaagggcaaaagaaccttatggggccgtacttcagcaagaaaagacctgtcaacagaggagattgaatgctgcagcgatgatgaggcccttgttgagaaacttgagagtaacaagattgatctncaatcaaaaattgcaaaggaggcca

SEQ ID NO: 46297 - DNA, 395 bp, Zea mays
  Clone ID: LIB3066-029-Q1-K1-B7
ggacaggatgccccgcagcggcatttcggggaccctcaggtcgccccagatcgacgtggtcatcgacacggggaaccccttcctgaaccgcaccgtctacggcttcctcaagatcggcgttgtcggcgcctgcaaggtggcggccgaggagaccttcgactgcctccacaggggggatgtttcaaagcgcaaggttgagcatgccctgaagaagatgtgcaaggagggcgcatattgggggactgttgctggcgtctacgtgggcgtggtgtatggcgtggagagggtccgtgggcgcagtgactggaagaacgcgatggtctgaggcgccttgtccggcgcgctggtctacgacgacagcagcaaccacggagacaagatcgtcaaggacgcca

SEQ ID NO: 46298 - DNA, 144 bp, Zea mays
  Clone ID: LIB3066-029-Q1-K1-B9
agctttcgttatcctcctcgatcttaattacaggtcatagctaagcaggtctgacaggatgtcgtggcagacatacgtcgatgagcacctgatgtgcgagatcgagggccaccacctgaccttcgctgccatagtcggccacga

SEQ ID NO: 46299 - DNA, 416 bp, Zea mays
  Clone ID: LIB3066-029-Q1-K1-C1
cggacgcgtgggtgtcagtcattgctattcactgccttcccttggccagtacgggtgaaaatatcgtattcttttataagatgaaaggtgactactaccgttacttggctgaatttagcactggaactgaaaagaaagctgcctctgatcagtcacttatggcctatcagcatgccatggttgtcgcctccagtgagctctcacctgctcaccaaatccggcttggccttgccctcaatttgtcggtcttcttttatgagataatgaactctcatgagagagcttgccaagtggcaaaacaagcatttgatgaggctcttactgagataaattctggtgagggagtttacaaggatagcacacttatgatgcagcttctgaaggacaacttagcattgtggacatcagaactaact

SEQ ID NO: 46300 - DNA, 424 bp, Zea mays
  Clone ID: LIB3066-029-Q1-K1-C10
cccacgcgtccgcccacgcgtccgcccacgcgtccgcccacgcgtccgagaaaatttgacagctgtattgttccattacgacgggaatgtcaatgggtggaatgatctaccatggagcaaaagtgtgatacatatagctgcttctaaccagactaaatggtggtttgcaaagaggttcctccatcctgctgttgtgtctatgtaccagtacatctttctttgggatgaagacctggaagtagataactttaatccgagaaggtacttaaatatagttagatcagaaggactggagatatcacaaccaggtcttgattctaagctttctgaaattcatcaccgaataactggtcgtaaaaatacagggacctttcatagaagagttagtcgggcttacaaacgttgtttaagagaaggaccgcct

SEQ ID NO: 46301 - DNA, 401 bp, Zea mays
  Clone ID: LIB3066-029-Q1-K1-A5
cacgcgtccggctatttcttctcgcctctcccaccggcccggtcgcccggagtagcaagcgtctccgatccgatccatcgtgcgagcatatccacggcgatggaggcgagagcggccatgagctggtactgcggctcccttctggccgtggccatcgcgctgttcctgtccgtgtccctcggcgtgcgcgccgccggcgccggcgccggcgtcgacatcaaggtgtcgtgtgcagcgacgccggacccggacgtgtgcctacgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgtg

SEQ ID NO: 46302 - DNA, 254 bp, Zea mays
  Clone ID: LIB3066-021-Q1-K1-C2
cccacgcgtccgccatcatctggtatctagtctcatcaacaggggcatgtccactatccaggctatgttcatcacagtggtgtcagtgtacctggttttcttctgcaacctattctctgatgagctggatggactatgtaacatatcggattacaaatctatccaatatcactatgccggtttctgtactaaaacctctgagtgtcctagctatgtgaacctgggcgcattcctcatttggcctaatggcgtat

SEQ ID NO: 46303 - DNA, 454 bp, Zea mays
  unsure at all n locations
  Clone ID: LIB3066-021-Q1-K1-C3
cggacgcgtgggcaagaattgccaacatattcttggacaatcttgttaacagagttttaaggtttcccagcagagaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaacacgtggcacacatcggttgggatggtcctggctccaccaacaacaataacaacaacagcaacaacaatagtggcggagcacctagctggatgaaggattaccactcggcaccgcttgactcgtcctcttttaggagtgagagntggggcacggctgctgcaaatccctgggcttctcaagagatagtcatggatgggagcaagcgtcga

SEQ ID NO: 46304 - DNA, 291 bp, Zea mays
  Clone ID: LIB3066-021-Q1-K1-C4
cgacaagatggcgtgcacaaacaatgcgattagagccttgttcctcctggtcctcttctgcgtcgtgcatggtgagaaggaagagtcaaagggcatcgatgcgaaagcgtccgggcctggtgggtccttcgacatcaccaagttgggcgcctccggcaatgtgcatgacagacagcacgtatgctgagcacgaagcatgtgcatcggcgttcggcatgcactgggaagcagacaatgctgatacccaacggtgacttacttgtctgacatctcaacttctcaagcccttgc

SEQ ID NO: 46305 - DNA, 321 bp, Zea mays
  Clone ID: LIB3066-021-Q1-K1-C5
cccacgcgtacgtccacgcgtccgtttaattacaggtcatagctaagcatgtctcgcaggatgtcgtggcagacatacttcgatcagcacattcttatcgagatcgagcgccagttatagaccaggcctcatatactcagacattacgaaaccgatcctgaaaacacttcgctatatctcaaccattatggatagtaaagaggctgaaatgcgaattgcgttcacgaccgatgtttaacacgtggcacacatattttgtgatatttctgtctctacctacaacactatcaccaacatcgacatcaatattggcggagcacc

SEQ ID NO: 46306 - DNA, 255 bp, Zea mays
  Clone ID: LIB3066-021-Q1-K1-C6
tcactgctaacatatcagttccaatttatctttagcacggccaataagctcaaatcggccgggattacttcatatacatgccaaaaattcaaccattcaaaatcatacttcaatcatatgcatattcaatcaactaattaacccatgacaacaatatacaagtcttacaaataataatgccaacattaatcgatagattactgatcatatcatttctactttgcttacatttttattcctaatcttctctaattt

SEQ ID NO: 46307 - DNA, 345 bp, Zea mays
  Clone ID: LIB3066-021-Q1-K1-C7
ctcccgttcttggggggcaatcgcgaatcgcgctcctcgcggtagcggtcgattagccgggtccgcccagatccgccgcggctgcgctccagttccctgtcgcgataccctggatttcgtccgtggcgagtggctaccgcttgtgctccttttgtgacagctgaatctttgtggttcgaaggcgattgacttgggttcactgacgcggtgacgcccaatgagctcccacgtctccacatcgcggggtcttcatcccccaagcaagcttgggacgttggactcacccggtgcgtggcagccgccagcacctatggctcagcccgaagcatgccgcggtgatgacca

SEQ ID NO: 46308 - DNA, 365 bp, Zea mays
  unsure at all n locations
  Clone ID: LIB3066-021-Q1-K1-C8
cccacgcgtccgcgcatgtagtttctgcagaagctagccaggcagacgagagagcgagtcaccgcgagaaggggatcgcggaaagtgagagcagaatcaacaatccacctgctcatcgagtcgatggagatgaaggttgctgcctcacggccaggatgcaagaaacgccccccgagccgtctccagaagcatgcgccagcgtcgctgcaactggagcaggctgtcgccagtgcggggacgggagcaccgtccgcggtgtggggtgacgggagggcgccgatcccgctcctgtcgccgctcgtcgtgtcgcccatggtgccggtctgggaggcggaccagacggggggcgccaggaagganggagg

SEQ ID NO: 46309 - DNA, 408 bp, Zea mays
  unsure at all n locations
  Clone ID: LIB3066-021-Q1-K1-C9
agcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaacacgtggcacacatcggttgggatggtcctggctccaccaacaacaataacaacaacagcaacaacaatagtggcggagcacctagctggatgaaggattaccactcggcaccgcttgactcgtcctcttttaggagtgagagtgggggcacggctgctgcaaatccctgggcttctcaagagatagtcatggatggagcaagcgtcggagaaacctncttcagggacacgaaaagcgaggc

SEQ ID NO: 46310 - DNA, 453 bp, Zea mays
  unsure at all n locations
  Clone ID: LIB3066-021-Q1-K1-D1
caactatctcgccgcatctggacacagactgacatggaacatgtgagggaaagtgccgctcgtgtcataaaattggtagaacatctggagaaggggcaagccatcaaggaaatgtttgggttaagcttcacattgaaccaacgagctatccgaagacctttcagctgggttagtgctaactcctaaagcaagcatcgagacaaattatgattatgatggttgatagttgcatgggacaacaaacaatgccatgatgaaatacatagtagaggagacctcttgtcagtcacccatacgagcattgattttcactgatgcccctgtatatntcgtatcacttattatgtagatgtacatgtgatggattttgcattgtggaactgttaaaatgaaccgacatgagatgccaaatctttgcaccanacagtatgatgtattggtgatctgattttt

SEQ ID NO: 46311 - DNA, 333 bp, Zea mays
  Clone ID: LIB3066-021-Q1-K1-D10
ggcgtgatcatcgcccccatcctcgtgatgatcccgatgatcatttaccggaagcggctccgggtcaacctcgcactcctggcgctcttcaccgtctgcatcagcttcgccgaggggctaacctgtgtcactcgcaacgtacaagacatcctggacgcggtcacggtcgggccgtgtaaacccgtccacgcaaccttctacggcggtcgtgacggatcctacaccaccgcggtcgcgtgcggctacaaggacactcgcacgcacgggtactgtctgcatactgtggccgtgagcactgtgcttgtcggcgactgctcggcctgcgtagggtgc

SEQ ID NO: 46312 - DNA, 444 bp, Zea mays
  Clone ID: LIB3066-021-Q1-K1-D11
aacagctattattgtaggtgaccgtttgcttgttgcaaatgttggagattctagagccgttatttctaaaggaggacaagcgattgcggtttcaagggatcacaaacctgatcagacagatgagagacaaagaattgaggacgcagggggctttgttatgtgggctgggacatggcgagtgggtggtgttcttgctgtctctcgcgcatttggtgataaactcttgaagcagtatgttgtcgctgaccctgaaatcaaggaggaggtggtcgacagctcccttgaattcctcatccttgctagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgt

SEQ ID NO: 46313 - DNA, 454 bp, Zea mays
  unsure at all n locations
  Clone ID: LIB3066-021-Q1-K1-D12
accacgctgccgatcctcgtcaagggagtgctcaccgctgaagacacgaggcttgcggtggcgaacggcgcggcggggatcatcgtgtcgaaccacggcgcgcggcagctggactacgtgccggcgaccatcagcgcgctggaggaggtcgtgaaggccgcccggggccagctccccgtgttcgtcgacggtggcgtccgccgcggcaccgacgtcttcaaggcgctcgcgctcggcgccgccggcgtattcgtcgggaggccggtggtgttctccctggcggcggcgggcgaggccggcgtgtccaacgtcctgcgcatgctgcgggacgagttcgagctcaccatggcgctcagcggctgcacctncctcgccgaaatcacccgcaagcacatcatcaccgagtccgacaagctcagcgccatcccgtcgcgcttgtagatgaggcaaaatc

SEQ ID NO: 46314 - DNA, 357 bp, Zea mays
  unsure at all n locations
  Clone ID: LIB3066-021-Q1-K1-D2
tcttatacatcggcagacgcgtacgcagactcttgggcagaatacgtcttgctgctcgtccgaagatggcctcatttccttggttccttgtgactatctctacggtttgtgcgcgcacgcatatgtatttgcattattcctgatagcatctattcgctggccagatgattagagagctgaaaatatattaagaacaataccatagagagaagttcctcagtgctctcgcagcttaaggagcaaacagcgacactttacttcgttttttatactttattatagccgcactagttattactcgggctacatttgtgaacagcgactgtaatatttntctactctatattcgtagtgcga

SEQ ID NO: 46315 - DNA, 315 bp, Zea mays
  Clone ID: LIB3066-021-Q1-K1-D3
caaatacatccacccatccttacacagactttcatttaacacatgaggcaaagctcctagcggcacgtacaatttgactaacatcctgataactatcaagacattacgtacacgcacgcattaaccttcacattaaaccaactagctatcataagaccatataactatcatacgagctaactactaatgcaagcctttacacaaactattaatatgatcactacattcttacatcatacaacaaacattcccatgataaaatacatagcatactagactacactacaaccactgatacaatcatctactttcact

SEQ ID NO: 46316 - DNA, 358 bp, Zea mays
  Clone ID: LIB3066-021-Q1-K1-D4
cgcctggcctgggctggccgcctccgaccatcgtacgtcctccaccgcgtcgccgccggcgggcctgtgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgacgtcaccgttcagctccaacacggcgcaccacccagtctacgtgcccaccacacctaggttgtccttatcgggctcgtcgttc

SEQ ID NO: 46317 - DNA, 263 bp, Zea mays
  Clone ID: LIB3066-021-Q1-K1-C12
accatcttcactgcacatttcaagacggtgcgttaaagcacgctccactacagacttattcggcgtcgtactcgttcctaagagcttggattccacatccgggaacatcctcctcgttataactctcatacgggtacgctcgcttacgatcatgcgagctaccacggtcacacttgcgtactcggatgtaaagctcgatcaacttgaacgggtattcgcatctgccaaccttgtggttcaacctaggcactctgtgatgtatg

SEQ ID NO: 46318 - DNA, 296 bp, Zea mays
  Clone ID: LIB3066-021-Q1-K1-D6
cccacgcgtccgggcgggcaaggccagtcttaagctcacgccgccgccgtcatcgtggacggcgacagctccgacctgacgacgaccaagctcgacgagctccgagcctatctgcagcacctgcagctggaaaaggaaagtcgcaccaagaaggtggcggaactcgtggctcagctgcactcgtcatccttggctctcggcatggatcccacagaggcgaacagtgtcatccatgttagcgccgaacgctcgcatgtgcagcccggcgacatataccaccgctccatatcagtgct

SEQ ID NO: 46319 - DNA, 224 bp, Zea mays
  Clone ID: LIB3066-021-Q1-K1-D7
accacgcgtcctcgcgctcacagtttgccttttagctcacgccaactactaccttgtgcacggacacttctcccaccggaccactacatacctcaacgacctactaacctatctgcaacacatgcagatgaaaaaggtacgttgcaccaacatggtcgccgatctctcggctaatctgcacttgtcatccttggttttcgacatgcatcccacagaggctaaca

SEQ ID NO: 46320 - DNA, 352 bp, Zea mays
  Clone ID: LIB3066-021-Q1-K1-A4
cccacgcgtccgcccacgcgtccgggaggagctgaaagctactgtacaaggtgtcctcaagtgttgctcacactatttttgcttcgcatgcatcatggaatggtctagggttgagtcgagatgcccattgtgcaagcagcggttcactacaatcaccaagtcatcgaaggtagatcttggtcttggattgagaagagctgtaatcaaggtcgaagagcgtgatcaggtttatcagcccactgaagaagaaataaggcgtaggctagacccatatgaaaatgttgcttgtatagagtgcagtcaaagtggcgacgatactatcatgctactatgtgacattagtgattcctca

SEQ ID NO: 46321 - DNA, 292 bp, Zea mays
  Clone ID: LIB3066-021-Q1-K1-A5
cacgcatacgagaccgctgccatcaatcacttgttcaagtttgggttccatgacaacattacgtggctgagctaactctccaaactgaccaagcttcaccacgagaacatcgctacatcattatctactacgccgacggaaaccatcggactcttgcttacgattccgtgccttgccgcaccttagaacatcacctgctcgatctaccggcagacaagaaaccaatagactcgtgcactatgatcaaagtggctcacggcgcaacacatgagctacagtacctgcacgagac

SEQ ID NO: 46322 - DNA, 432 bp, Zea mays
  unsure at all n locations
  Clone ID: LIB3066-021-Q1-K1-A6
ataaagcatcgatcacgacaagatggcatgcacaaacaatgcgatgagagccttgttcctgctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggntaatggatcgagattctacgcgtggataacctggtcatcaccggcaagggaaa

SEQ ID NO: 46323 - DNA, 426 bp, Zea mays
  unsure at all n locations
  Clone ID: LIB3066-021-Q1-K1-A7
agaccgtggccatcaagcagctggacaagcatgggttccaggacaacatggcgttcctgagcggggtcgccaagctgagcaagctccaccacgagaacctcgtcgacatcattggctactgcgccgacggagaccagcggctgctggtgtacgagtccgtgcccgccggcaccttagaagaccacctgttcgatctgccggcggacaagaaaccgatggactggtgcacgaggatgaaagtggcgcacggcgcggcacaagggctggagtacctgcacgagacagcgaacccgccggtggtgtacggggagttcaagggcctccacatacttctcgacgagaggtccacgcncaagctctccgacttcgggctcgcgcagctcggccaggcggggggcagcatgccagtggcgtcgcccatgatgg

SEQ ID NO: 46324 - DNA, 187 bp, Zea mays
  Clone ID: LIB3066-021-Q1-K1-A8
ataccgcgtccatcaagcagctgttcaagcttcgattccaggacaacatggcgttggtgaggggggtctccaatctgagcaagctccaccacaagaaccttgtccacatcattggctactgcgccgacggagaccaacggcttctggcataccaatccttgcccgccagcaccttagaagaacacct

SEQ ID NO: 46325 - DNA, 449 bp, Zea mays
  unsure at all n locations
  Clone ID: LIB3066-021-Q1-K1-B1
gtcagaaaatagtgggatcgagttgtttcactgcacgagcacatcctccggcgaccaccgggctccgtctccgtcctctagcgaccgaccaacgcgccgagcgaagatgtcgcggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaagatttcgacgagccggggcacctcgccccgaccggcctgatcctgggaggcaccaagtacatggtcatccaaggcgaacctggagctgtcatccgtggcaagaaaggatccgggggcatcactgtgaagaaaacagggcagtcactcatcattggcatctacgacgagcccatgactnccgggcagt

SEQ ID NO: 46326 - DNA, 199 bp, Zea mays
  Clone ID: LIB3066-021-Q1-K1-B10
ggaagactttgacgaggagcctgatgaatagtctatacataaaagcacctacgatctcaccgagatcgaggatcaagacttggtgaaagcccagaatataaacgacaacgtagtcgattatagctagactcgctacatctcatggcgcgaaatgacacgacattgttaaacacatagctcaccaacgttatatgaagct

SEQ ID NO: 46327 - DNA, 451 bp, Zea mays
  unsure at all n locations
  Clone ID: LIB3066-021-Q1-K1-B11
cccacgcgtccggtaagtcctcgaccatccctgcaaattaccgcgatggctcccaagatccgagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcatcctncccacgctgctctccgtcaccgacaagaaactcggcgtcctcaactacaccagggccgacgacgggcagatgtacttcggcgcttccg

SEQ ID NO: 46328 - DNA, 458 bp, Zea mays
  Clone ID: LIB3066-021-Q1-K1-B12
ctctcgcaggcgcagctcccgcctaggcgcctaacacctcacggccaccgccgctgcggcctgaacactccgcagcgtatccgcctcccgccgcggcttcgtcctcttcgttccctcgctcgccgccgcatccgccgtcctccgcccgctcccgtccgccgccaccgaggccgatgacaccgaaagcccggctccacatccaccgcccaccgaagaatccctctccccgcagcccgccgcggatgcggcggagacgaagcctgaggccagcgagtcggccatgtcgagggtgtacgacgcgacggtcctcggggagccagaggcgttggcaggggacgcgcgggggcgggtgtgggagaagctggcggctgcgagggtggtgtacctcggcgaggccgagctcgaacccgaccccgacgaccgtgtggtcgagctcgagatcgtcaggggcctcgcgg

SEQ ID NO: 46329 - DNA, 317 bp, Zea mays
  Clone ID: LIB3066-021-Q1-K1-B2
gaggcgcgggccaggagccagcgctacgtcttaccgaaacatgtgcctcccgaataagggcgaacgctgtcacacaatctatagccatgcactggacatctaacgatatcatcgacctctccttgctgaatgtcgacagcaatttcggcatcaggaacgtctatctctgatacgcatcagcatgtacccttgcatgtcctgacatagcacacaatgtcgtcgagaccaacgggatatcactagtcgagattgacaaggatctaattcgaacagattgatgactatgcctagtcatactgactcgccaaggacactat

SEQ ID NO: 46330 - DNA, 336 bp, Zea mays
  Clone ID: LIB3066-021-Q1-K1-B4
cgatcacgacaagatggcgtgcacagacaatgcgatgagagccttgttcctcctggtcctggtctgcatcgtgcatggtgagaaggaagagtcaaagggcatcgatgcgaaagcgtccgggcctggtgggttcttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggc

SEQ ID NO: 46331 - DNA, 338 bp, Zea mays
  Clone ID: LIB3066-021-Q1-K1-B6
ggaagaaggaatggatatggatggatggataggaagtggccgccatatgggcatgggccaaaccaaaccaaatcaattggtgggtttgtatcgtgccagcggcccatatgtagacttccaccagaccaagtccgtctgattccgcggatcatgcttacaattaattaattggtcttggggccaagaagaataagaagaagattaatgggccttcttgaagctttgggccaactagcccaacgtacataaaagatgaagaagatgaacatgcatgctcagcaaggctttcttcgtggggtggtagctgtcgaagaacacgtgctgcgagacgttgtcgc

SEQ ID NO: 46332 - DNA, 447 bp, Zea mays
  Clone ID: LIB3066-021-Q1-K1-B7
gagcgcgagctcttaaacgggcgcacgccgcgtgcgcgcccgacccgcttgccccgcgctcggacgcgtcccgatgcgcctgcgccggccggaaaacccctactagtcctagggctcgcctcgccgccctgatggggggccggccggggtatctcaccctgccgatcttttccgtggtcgcggcgatcgggtacgtctactacaccacggtgttcgtggccgtgccgcggtggctggacctgtccacggctgcgggggtagccaacgccgacgcgttcacagcgctagcagctgcctgcctcgccacctacgccgtcgccgttcgcagggaccccgggcgggtgcccccgggttttgtgcccgacgtcgaggacgccgagagcactgtccacgagatcaagcgcaagggtggtgacttgagatattgccagaaatgttgccactata

SEQ ID NO: 46333 - DNA, 384 bp, Zea mays
  unsure at all n locations
  Clone ID: LIB3066-021-Q1-K1-B8
caaatttcacgaagatcttagaattccatcttcaatatttgttaagtgtgatgttagtaatgcagataatcttgctgcttgttttgagaagcatgtacagacatacaatggactagatatctgcatcaactgtgctggaattgctaataaaacactagtttatgatgatacatctgatggaactagaacatggaggcatgctgttaatgtgaaccttgttgctgtcattgatggtactcgcattgcaagtcaaataatgcgaaaccaaaagaagcccggtgtcataataaacattggttcagcggcaggtctttatcctatgttcctcgatcccgtatatagtgcggcaaaagggggtgtggntatgtttacaagatcactttc

SEQ ID NO: 46334 - DNA, 177 bp, Zea mays
  Clone ID: LIB3066-021-Q1-K1-B9
caccacgaccagatattcttctccgacaattctatgataaccttgttactactaatcctagaatacatggaacattgttagaaggaatagtcaaaagccatagatacgaaagcgtcctcacctgttggatctatccacatcactaagttcagcacctgcgacaatggcaacacagac

SEQ ID NO: 46335 - DNA, 421 bp, Zea mays
  unsure at all n locations
  Clone ID: LIB3066-021-Q1-K1-A3
gaagaagggcctcctgtctcctctcacttcctcagtcctcgtccgtctctgctccctcctggctctacctagctagctagccagccttcctgtagcgcggcagagatggctgcccctgcatccaccacggcggcggcggcggcggcgctgctgcttctgctcgtgtcgctcgccgcggcggcggacatgtcgatcgtgtcctacggggagcgcagcgacgaggaggcgcggcggatgtacgcggagtggatggcggcgcacggncggacctacaacgccgtcggcgaggaggagcggcggtaccaggtgttccgggacaacctccgctacatcgacgcgcacaacgccgncgncgacgcgggcgtccactccttccgcctcggcctcaaccgcttcgccgacctcaccaacgacgagtacc

SEQ ID NO: 46336 - DNA, 453 bp, Zea mays
  Clone ID: LIB3066-021-Q1-K1-C10
ctgccatcctctccaacacgaagatggcgttcatcagcaatgtcgcagtgaaggcggcggcggtggccgcgctgctgctggtcgcagcggtgtcgcctgccgcgcgcgctgcggcggtggcggtggcgggaggggcgccgtcggtgccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctacatcatcatccgtctcgacggcaacctgctcggcaccggcgacctcagcgcgtaccaaaggaactggatcgagatcgagaacgtcgagaacctgtccatcaacggtcacggcaccatcgacgggc

SEQ ID NO: 46337 - DNA, 431 bp, Zea mays
  unsure at all n locations
  Clone ID: LIB3066-021-Q1-K1-C11
cagaaataaaaatcgccgtggaggcgagtcgccgccggcactgcccggcacggccttcttcggcggcgaaggcggagctcgttacggggattccacatccgttaatcggtcccaccggatccctcgccgcctcccacgggccgggccgcgccgtggcgcgcgcgcaggccgagatgcggaagaggatggagagcgtcgacgatctgatcgaggaggcaaaactgcgcaccgtctggtgggcgctctgcatcttcgccgtctcctacttcctcacgcgtgagcacgtccccttctgtccctctctgcttccgtgcctcatttgcgaccgaattggttttgcggctcgtgtgggccgcgagaaggacgggccggggcataaatctgggtcgaggagacctggttacgcgtgggctgcctangggatgtggcgt

SEQ ID NO: 46338 - DNA, 298 bp, Zea mays
  Clone ID: LIB3066-020-Q1-K1-G4
cccacgcgtccgcccacgcgtccgcccacgcgtccgcccacgcgtccgagatgatctgtagagactgagccttcctttgatggttaccacatatgaatatgaggagaagctatgcactgctttaactgttacagtggatgcaaaagatggcacaactactgtagtatctgccaaggacagggcataaacagtcatgactctagcattttcggactctaatcctgaggatctcaaccggcctggtcatattttatctttgaaatacacatatagtggtgatatgaaacagtctggacac

SEQ ID NO: 46339 - DNA, 182 bp, Zea mays
  Clone ID: LIB3066-020-Q1-K1-G5
cactttatgcttacaaggatctttcttctccaatggataccctacataagtgcgatatgtgtgacataccacgctggagttgcaactgatgatgccgctcgatgacttgacctcaaatccattaaaacaggttgcaactctgaattctcacattaaatcgatatgcatattcacccaaattg

SEQ ID NO: 46340 - DNA, 429 bp, Zea mays
  Clone ID: LIB3066-020-Q1-K1-G6
gcaagaacgagaaggacgcgtcgaacccgcccatgtacaacgtggaggccggcaagacgtgccggttccgcgtgtgcaacgtgggcatcaaggcgtccttcaacatccgcatccaggaccacatcatgaagctggtggagatggaggggtcccacaccatgcagaacgactacgactcgctggacctccacatcgggcagtgcctgtcgttcctggtgaccgcggaccagaagcccggcgactacctgctggtggcgtccacccggttcatcaaggagaagagcagcaccacggccgtgatccgctacaagggctccagcgccccgccgccggccaagctgccggagggccccagcgggtgggcgtggtccatcaaccagtgcaagtccttccgctggaacctgacggccagcgcggcgcgggccaacc

SEQ ID NO: 46341 - DNA, 70 bp, Zea mays
  Clone ID: LIB3066-020-Q1-K1-G8
aaaagacatacataaacaaaaaaaaataaaatcaaaaaaaaaataaaaaaaaaaaaacatggggcgtcgt

SEQ ID NO: 46342 - DNA, 386 bp, Zea mays
  Clone ID: LIB3066-020-Q1-K1-G9
agatggcgtgcacaaacaatgcgatgagagccttgttccttctggacctcttatggatcgtgcatggtgagaaggaagagtcaaagggcatcgatgcgaaagcgtccggacctggtgggtgcttctacatcaccaagttgggcgcctgcggcaatggcaagacagacagcacgaaggctgtgcatgaggcatgggcatcggcgtgcggcggcactgggaagcagacaatcctcatacccaagggtgacttccttgtcagacaactcaacttcacaggccatagcatgggcgacgtgaccatacatgtggatggcaatctgctggcgaccacggacctaaactagtacaaggaccatggtcattggatcgagattctacgtgtggat

SEQ ID NO: 46343 - DNA, 278 bp, Zea mays
  Clone ID: LIB3066-020-Q1-K1-H1
atcggagactcggagccggcaaaaccctaaggggaaggtttctgcaaggaggagggagatggagggtgccagccacatgctcctggaggagccctttccgctcgcctccgtcctctcccccgccaagcctaaagtattcccatcactcaccaagatagttgggacgctcgggcccaattcacactcggttgagattattcaggaatgcctcactgctggaatgtcagttgcacggtttgatttctcatggatggatgctgcgtatcaccaggagaccc

SEQ ID NO: 46344 - DNA, 212 bp, Zea mays
  Clone ID: LIB3066-020-Q1-K1-H10
cccacgcgtccgccgggaacaacaactgcgagatggccacggtggagacctcgggcacgtgtatagggtcctccgggagatgggcactacacggcaagacagccctcgtcaccggcggcacccgcggcatcgggcgtgcggtagtggaggagctggcggctctgggggcttgccgtgcacacatgctcccagatggcggtctagctcgaatg

SEQ ID NO: 46345 - DNA, 367 bp, Zea mays
  unsure at all n locations
  Clone ID: LIB3066-020-Q1-K1-H11
gctgttcactggagggaacagtcaagatattgttcaagagaggaataaatggcgcagacagatcaaggagaatctcatggctgctgcagcaaacggaaaagatttagaagagacagcaagcgatgacgataccttggatgtgagtgatgatgacttctttatgtctggaagttcaagtgatgaagaggctgatgatgagtggactgacaagagtgctaaggaaccagcatccagtgcttcaggtagggcagcatctggcatgtcaagtgatgaaaagaaccagcgtcagagagatgctcgagttcttatgccgncaccacgctcattagccccanataggagcagacatgcagataaccgtgcgata

SEQ ID NO: 46346 - DNA, 468 bp, Zea mays
  Clone ID: LIB3066-020-Q1-K1-H12
cccacgcgtccgcagtcaactgacagaattaaagagagccgaagaactatgttggagacagaagagcttggtgtgtcaattcttcaggaccttcaccaacagcgacagtcactactacatgctcatactactttgcacggagttgatgacaacattggcaagagcaagaagatcctggctgcaatgtcaaagaggatggataggaacaagtggatcattgggggaattatcacggctctcgttctggccatccttctcatactctacttcaagctcgctaattaagcctctgcctgcaggtaggttccccctacatatctgtgttcagtaattgtgtgatatgagttgtctgaatgccgtgtattgagcaacacgcagctctccgagcgtcatttgttccccctcaaacctgtaaactcaaaatggcttattctgtgtatagtctggtattcccaactatgtaaaatg

SEQ ID NO: 46347 - DNA, 462 bp, Zea mays
  unsure at all n locations
  Clone ID: LIB3066-020-Q1-K1-H3
gtacaacctgctggacacggtgagccggcacacgatccaggtgtacccgcggacatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacgccctacgctgcggcaaggtcgtggggctgccgatgccgccgtcctacgcccncgcgcgctaagacgacgaaggcctcgatttctcctcgtggtctgaccatgcaatccaaactcaaaagaacaaatacgaaagaagcgtagtgaaggggaacaaatgaatggatatatgtaatcttgagatgcatgccctctcagatcactgtactggggttctcaaaaaaatcattggaatgggagttatatatataactttatc

SEQ ID NO: 46348 - DNA, 333 bp, Zea mays
  Clone ID: LIB3066-020-Q1-K1-H4
gtccaactacgcgcagatcctctacgagttcgacatggacatcgacagggcggagatgtacttcaagcaggcggcggccgacgagccagcggacggggaagcgatgcggaggtacggcatgttcctctggcacgcccgcggcgacattggcggcgcggaggacatgtttaccggcgccattgacgaggagcccgagagcagccaccaccggagcagctacacgtggttcctatggatgaccggcggcgtctagacctgcctgatcgacaccaccggaaagcagaacaatggcaacgacgttgaatgaaccgtagcccttcgatcggaattcgg

SEQ ID NO: 46349 - DNA, 288 bp, Zea mays
  Clone ID: LIB3066-020-Q1-K1-H5
catccgagacctacgcgtccgcagaaaccctaattggaagggcactgcacggacgaaggagatggcggaagacaatcacatgctcctacacgagcccttacaactcgccttcgaacttttccccgccaagcctaaaagattccgcatcacttaccaagatagttggtacgctcgggcccaattcacactcgggtgagataattcaggaaagcctcactgctggaatgtcacatgcaccgtttgatttctcatggatagatgctgcgtatcaccagaagacccttgata

SEQ ID NO: 46350 - DNA, 195 bp, Zea mays
  Clone ID: LIB3066-020-Q1-K1-H7
agactccacgcgtccggtatttctggtttgtattaacatttaccgatcgatttttattgctgagaagcatataaacattatactcacctttaaaaaaaataattaaaaaatatataaaaaaaaactaactaaaaaaacaattaataataaaaaataaaataaacaaaatcaaataatatataaaaaattttaaaa

SEQ ID NO: 46351 - DNA, 314 bp, Zea mays
  Clone ID: LIB3066-020-Q1-K1-H8
ggattctaacgtttccctcgttgttttgccacacatggggtggcccaatcaactaacttggttgcagttttcagcgaaaaatcgtctgcggcgcaagagaagcgtacaactcaatttgcatgatccggattacagatgcagtcgaaatagatatttattcttttgggtcaactttataggattgttattgtacaaaatgcatttttcatagtacatcggaatacttcgtccaaaaaaaaaaaaaaaaaaaaaaaaaaaaaaaaaaagacaaacaatagggcggacccaaagctaaacatacaacgtgcatgcaa

SEQ ID NO: 46352 - DNA, 217 bp, Zea mays
  Clone ID: LIB3066-020-Q1-K1-H9
gataggcgtacacggaacccgacagctgacacatgcacgaagcagacacctaatggaccgcgcactgggtcctcctcgagatgctcattatacccgacgacagcatgtcgccagctcgcggacgcggggcatatcgactgcggctatggcagatctatgcgcgtctgcggacgcaccgtgaagacatgctcgacgatggcggtcgagctcctggagc

SEQ ID NO: 46353 - DNA, 425 bp, Zea mays
  unsure at all n locations
  Clone ID: LIB3066-021-Q1-K1-A1
ggcccttgcaagggcgacgtgaccatccaggtggatggcaatctgctggcgaccacggacgtaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggngacagccncaacacggatggcatccacatgggcgactcatccgggatcacgatcaccaacaccgtcattggcgtcngtga

SEQ ID NO: 46354 - DNA, 354 bp, Zea mays
  Clone ID: LIB3066-020-Q1-K1-G3
gcgcagctacacttcatgctaaccacgatcaagcgccaggaatgaagacgctgttttatcggtaatatcgatctggccagggacgagaatgaacacatggccaagctcgatgaacaggcctaaaggtattaagaactggttgaaactatggtgaaggtggctaaaactgtatacgttggtagacctatctgatgaacagcgcaagctgttgacagacgtataccagaatgcgatcggagctctcacaacttgatacgccattgcgtcttacattgtacaaaatgaagagctgcttgccaacgaatagcctgtgaaccttatgaacgagttctgaacgatgatcgatgctgaact

SEQ ID NO: 46355 - DNA, 129 bp, Zea mays
  Clone ID: LIB3066-021-Q1-K1-A10
tcccactcgtctcggttctagatcgcgagcgtattacattttgcagacgtctactacaccatggggatatgttgctcgattaggatgcctgcactactaccatacatgtctctaacctttcaaacacca

SEQ ID NO: 46356 - DNA, 395 bp, Zea mays
  Clone ID: LIB3066-021-Q1-K1-A11
cccacgcgtccgcatcgatcacgacaagatttcgtgcacaaacaatgcgatgagagccttgtgcctcctggtcctcttctgcatcgtgcatggtgagaaggaagagtcaaagggcatcgatgcgaaagcgtccggtcctggtgggtccttcgacatcaccaagttgggcgcctccggcaatggcaagacagacagcacgaaggctgtgcaggaggcatggtcatcggcgtgcggcggcactgggaagcagacaatcctcatacccaagggtgacttccttgtcggacaactcaacttcacaggcccttgcaagggcgacgtgaccatccaggtggatggcaatctgctggcgaacacggacctaatccagtacaaggaccatggtaattggatcg

SEQ ID NO: 46357 - DNA, 350 bp, Zea mays
  Clone ID: LIB3066-021-Q1-K1-A12
aaaagctcaagaacacgctcaaggcctttggagtattggcttggtgaaagattactatatgggcctatacatgacaatttgcatggagctattggcatcaaagcatactctcctggccaagatggcaagagatcattgaaagtgaaatctttcgtgcctgaacagtattcagatcttgttgctaaatctgcaaggtactgaagccaagattttccaaagaggatcacgccttgtgacctgttgctttgtcacctcactatgggatgttgacatgtattggtagaactgcagtactgcacaacgaaatgcatgttaacttaggcaggtatcaaatggatgagtatctatct

SEQ ID NO: 46358 - DNA, 269 bp, Zea mays
  Clone ID: LIB3066-021-Q1-K1-A2
cgtatatagttcagttgtagccgttgagacttgggaggcaggcgacatgggtggcgggaaggacgactgccacgatccctcgaaggcggacaagggattccacggaggagggtactcggccgacgacggtggatactactgcggccagtaccccggcggcggctaccctgctccaccgggcggcggtgcgtaccctgacggctctgggtacccggtaccacctggtgggtacccgccttcgggtggctaccctcatcctggctgatacc

SEQ ID NO: 46359 - DNA, 226 bp, Zea mays
  Clone ID: LIB3066-012-Q1-K1-F11
gttcctgtcgccattgcctcctgctggcaggaacaggaactctctgaagcacggggggagggtagttcatgttgcttcgattcgatcgtaggggagataatgccggatggcgctgctcatgctttgtaaagtttgggaggacatgcatcataattgaagtcaagtgataggatcctgttttttaagtacacgatacaacacaaatcttaacatactccctttgttt

SEQ ID NO: 46360 - DNA, 343 bp, Zea mays
  Clone ID: LIB3066-012-Q1-K1-F2
tctactgatgtttggagatgaaagtagaggaccgaaactagatgcatctgagagcaattttggtagcagcgtttctagtttcgaaggagatcaaagcaatgcatcacaacattctttcactaatattgggcaaaactgtaatgagaatacctacagaactccccatgattttgttgaggctgctgcttttcaatcaaacccatcaaatttcagtgggctgaactttaaattcggtgtgtcatcctctccacaaatctctgctgcggcagcggcacaaagacgtagcacaagaaggaagttaagaacaaagggtagtctagcatcgaaaccttcaactatcgac

SEQ ID NO: 46361 - DNA, 134 bp, Zea mays
  Clone ID: LIB3066-012-Q1-K1-F4
ctcacgcgtccgggcgccgagtcggtcatcatcatgctgcaaagtatcggcacggggagcgcgctgatcctcggggctctagtcgtggcattgctcgtggagatgaaacgtctgagagctgcaacggacgcctg

SEQ ID NO: 46362 - DNA, 400 bp, Zea mays
  Clone ID: LIB3066-012-Q1-K1-F5
gtttgtttgtattgctacgactagcgcgaggacacgtgtcatctgaaaagcaagtgggtacctgaaatctcaagtgccaggcaagttgtgcccttgatcacttcttttacccactcatgttctaattaatcataatgatctgcataggttaattttgatgggacctaataggataccctagtttgtctatctttatgccttgtttaccactgaactttttgggtagtacttgctagtgctatatgtggttttgggcattgagatacacattattcatgattatacttttgttatccgttgttatttactgttcatgtcaagatcattaatgttaattggaacatagagcttaacttgagaaacacgtgccaccacaagggtttatggacgcccttggctg

SEQ ID NO: 46363 - DNA, 352 bp, Zea mays
  Clone ID: LIB3066-012-Q1-K1-F6
cacctgtaatggtcgacatgtgcttacaatgactagaaatcttgagcgcgcaggggggggctcacttttgcagagcatgtgcggggtttcacccacacatctgtcatggagtcctgagcatcatgccacagatgttgattacacttggagcactgtacatacaccatttggtcctttttcatagaccaaatcactgtcttttgtgcagaatgatgcatctcgtaagaatgtgcttctgacaaccctgaactacacaattaccaacacaatagatgttttggagtccatggtagcacatggcggacagaattatcttataaagaatatgcatgttgaattcattcaaaggttg

SEQ ID NO: 46364 - DNA, 407 bp, Zea mays
  unsure at all n locations
  Clone ID: LIB3066-012-Q1-K1-F7
ggaggaggcgatgcggaacgccatcgagggcatgaacggcaaggagctggacggcggcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtntgttgttgcccatctgtg

SEQ ID NO: 46365 - DNA, 410 bp, Zea mays
  unsure at all n locations
  Clone ID: LIB3066-012-Q1-K1-F8
agcgatgcaccagcacgagatactagccatcatgcgcctgtcgtccctcctcctgggcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggccctggagctggagtgccccggngtggtgtcctgcg

SEQ ID NO: 46366 - DNA, 417 bp, Zea mays
  Clone ID: LIB3066-012-Q1-K1-F9
catcgatctccccccagcggcgaggagagccggcggccacaggaaggagaaatgggggccgcacacaacgctctccgggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaaggggagcaacatcgccatccagctggatggcaacctgctgggatcaaacgacctggacaag

SEQ ID NO: 46367 - DNA, 413 bp, Zea mays
  Clone ID: LIB3066-012-Q1-K1-G1
tgccacgcgtgccaatggtggacgcgttcccctcctgcacgcaacctcatctcgtcctgcggatccaggatggccagtgctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatcgcgaagtcgtcgtcgctcggttcggagcggatctgaggcgacgatagatggacgcggcgggatctctcggtctgcagtcctgctccacctcgatggatgatgtctctgc

SEQ ID NO: 46368 - DNA, 255 bp, Zea mays
  Clone ID: LIB3066-012-Q1-K1-G10
aatatcgccgccgccgctgctggcactgcggtggacgatggcgagccgcctcatcgttgctctaccccggtgagcgtggaggaggcgtgccgcggcgcgtccgagacgcacgccggcgtggcctacgaccactgcatggcgtcgctgggcgccgactcgtgcagcaaggatgccgtcaacaagaacatgcacggtctggctgttctgacctccattatggacatagactactcccttagtatggcttccaaaatc

SEQ ID NO: 46369 - DNA, 419 bp, Zea mays
  Clone ID: LIB3066-012-Q1-K1-G11
cccacgcgtccgcggtgcttctgctcgccggcccaaaatcgcctcatcgaccacgcgcccttccaggctcccggctccatgggtctcctctcaaacaggattgggagggagagcctcaaggcgggggatcatatctactcctggagggcggcgtgggtctacgcgcatcacggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacagagacgaacggcgtggtatcctcctgcctcagctgcttcctagctgggggtgctctctaccgtttcgagtacgcagtcaacccggc

SEQ ID NO: 46370 - DNA, 414 bp, Zea mays
  Clone ID: LIB3066-012-Q1-K1-G12
ctcacgcgtacgcggccgcatttaagctcctagttaatgatgaactggatacacagagtttcatgaagtttccagatttaaaccctgctccagcaagagcaagttctggggcttcaaggaagatgatgcttaattctaaagatcttagctttgtggggtatacatacaagaattttgaggccgtgaaaggtttgcatcagtttgcagatcttcagagaagttcctcatttacaaggcactctgctggctccccatctgatacagcagacatggacgcctcgatggaagctaacgggaccgacacacacatgcgcactggttcagctggcgaccctatggcgccataatctgccctgttgttttcgtgaagtaccctgccctacaccggcatcatgcatgcacctcgacaacatg

SEQ ID NO: 46371 - DNA, 412 bp, Zea mays
  Clone ID: LIB3066-012-Q1-K1-G2
tcccagccatgcaccagcacgagatactatccatcatgcgcctgtcgtacctcctcctcgtcgattccgaactctgggggcgcgccgcggcgcagcaggtgccgtcgtttggcggcagcgctctgaagccggactactacagccagtcgtgcccgctcgcggagcggatcatctcggaggtgatgcatacgaagcatatggcgaacccgacgactgccgcgggcatgctgcgcgtcttcttccacgactgcttcgtcaccgggtgcgacgcgtctgtgctgatcgcgtccacccagttccagaagtcggagcacgacgcggagatcaaccactcgctccccggggacgccttctacgccgtggtgcgcgccaagctggccctggagctggagtgccccggggtggtgtcctg

SEQ ID NO: 46372 - DNA, 402 bp, Zea mays
  Clone ID: LIB3066-012-Q1-K1-G3
ctgcagtcatctcctccatcaccaccaaactcaacaacagccagctcgcgaaaataagggagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtga

SEQ ID NO: 46373 - DNA, 415 bp, Zea mays
  Clone ID: LIB3066-012-Q1-K1-G4
cgccgcagaggcccaaagacagccacctttttactcacctatctccgcaactcaaaggtgcttccatttcctaccggcgccgctgcagctccaccccattccgtcgacaccatgagggagtgcatctcgatccacatcggccaagccggtatccaggtcggaaacgcgtgctgggagctttactgcctcgagcatggcattcaggctgatggtcagatgcccggtgacaagaccattgggggtggtgatgatgctttcaacaccttcttcagtgagactggtgctgggaagcacgtccctcgtgctgtttttgatgaccttgaaccaactgtcatcgatgaggtgaggactggcacctaccgtcagctcttccaccctgagcagcttatcagtggcaaggaggatgcagccaaca

SEQ ID NO: 46374 - DNA, 411 bp, Zea mays
  Clone ID: LIB3066-012-Q1-K1-G5
cgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgc

SEQ ID NO: 46375 - DNA, 221 bp, Zea mays
  Clone ID: LIB3066-012-Q1-K1-F10
cccacgcgtccgattctacaacaatgtcacgtacatgcaatgtaataataaaaaaagtatgtgatatatttaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaatacaaataaaattcaacatacaaaaaaataaaaaca

SEQ ID NO: 46376 - DNA, 396 bp, Zea mays
  Clone ID: LIB3066-012-Q1-K1-G6
gagccaccgtctgacggccgctcatctcgccatcggtagggcttcggcaatcccaggtccattcgccacctgcgcctttcctgctcccgcgccgcgaccatacacctactccacttcaccacctactcccgtcacaccacctcctatgcgactacgactactaccgctacccttcccgtctgccacccggtcacccccgacatcttccacgagtcgccgtcaccgcatctacaccattttgtgggccaccgccacaacggcaccgatgtccccatgccacattgccaccccagccgcatgcggtggcatcgctggaggagccgcttggcacggagatggaccaggctcatgtgctgcttgcgcaggaccagcggttgacgcacatggcgctcgtgc

SEQ ID NO: 46377 - DNA, 408 bp, Zea mays
  Clone ID: LIB3066-012-Q1-K1-D5
gaaatcgcatagaagcgaaagagaggacacacacattaggctaaagcgtcggttgagggcctcctacaccgctgcacggaaccagtctcgtcctcactgtcatcgccgatcacatgtcacaggctcgcagatccctggttttagatgttaccaaagaagtatcttttcatgagaagcaatggatatgatggagttctattctttattaagcatgcgctccctcgccacgccccgtctcgcactctcgccacacctcaccaccggtggaggagcagcagggggagaccgggttggaggcccgcaggaggcggagcccacgatgcctatgtccgtggggaaccagttgcagcggccggccgagtgcccgccagcgccgcggaagctggtgtgggcgcctccgcttccgtc

SEQ ID NO: 46378 - DNA, 341 bp, Zea mays
  Clone ID: LIB3066-012-Q1-K1-D6
gggggtctgtcgaccccgctgcactgtcaaaccacttccggttcaagcgccggttgcgggactgcaagaccggagcacacatccagctctctgagcacatcatctacccactcacatgctactacactgcactatccgatccaacatccaattaccaatgacgtatcacactttgagacactctgggccgcttggtacgtgctatattgtcttaatcatgctctggatcaacacacattggctcacactctagatacacatcaccaaccacttatgaacatctactggagacctattttgaggctgatattatgccgaacctacattgcctattagcatgg

SEQ ID NO: 46379 - DNA, 255 bp, Zea mays
  Clone ID: LIB3066-012-Q1-K1-D7
taataaccgaatacccagaccaaatctctcgtcaccttcgccttcacatcgcatcatgagcattctaaacttctgggaccgaatacattttcagacactcaattccaagatccattgttagatcctaccatacttcttcttcttcttcttgctcatctgatctctttttatattcatcaacaattctatccaactaatcttttttattaatcatgctctacctctccaaacatactctcgcactctcgacacacc

SEQ ID NO: 46380 - DNA, 409 bp, Zea mays
  Clone ID: LIB3066-012-Q1-K1-D8
aatccaagacaaaacatggctgtgaatgtgagaaccatgtggtcgtcgatgcgggcgcaggttgcgatggttgtggcgttggtgttcttggtgagcggcgcatggtgcggtcctaccaaagtcctcccaggcaagaacatcacggccacctatggcaaggactggctggacgctaaagctacatggtatggcaagccgacaggtgccggtcccgacgataacagtagctgctgcgggtacaaggacgtgaacaagccccccttcaatagcatggtctcatgcggtaacatcctcatcttcaaggattgactgggttgagggtcctgcttcaagatcaagttctataagcctgttgagtgctccggcaagcccgtggtggtgcacatcacggacatgaactatgagccta

SEQ ID NO: 46381 - DNA, 354 bp, Zea mays
  Clone ID: LIB3066-012-Q1-K1-E1
gcaaaaaaaaaaccatcacacaaaaaaaacaaaaaacaaaaaaaatttttaaaaaaaaaaaaaacaaacaaaaaaaacgggaacttttaaaatcttgtggttacctaaaaacatacctacatttctatccatccaccgttttcatacaccaccttcccacattataatttttctatacactaacttcaactcatttcaaagccccctctctttaaaactcttactcttctaaaaaacctttccttttcccatctcaatcccctacatccacttccccttttccccaactgtctttctcccaaaacccctccctacattcccctttccatcatttttacactcctaatttccctt

SEQ ID NO: 46382 - DNA, 366 bp, Zea mays
  Clone ID: LIB3066-012-Q1-K1-E10
gaggtgtccggggtcacgctgctcaactccaagttcttccacatgaacatgtaccggggcaaggacatgctaatcaaggacgtgaccgtgacggcgcccggggacagccccaacacggatggcatccacatgggcgactcatccgggatcacgatcaccaacaccgtcattggcgtcggcgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtac

SEQ ID NO: 46383 - DNA, 409 bp, Zea mays
  Clone ID: LIB3066-012-Q1-K1-E11
ctgaccaatgacatcggtgttgttgttgtttcagatgatgcaggagaacctattgggggtaacatctatgttggtggtggcatgggaaggacacaccgagtggaaactacattccctcggctggctgatccattgggttatgttccaaaagaagatatattatatgctataaaggccattgtcgtcacacagagggaaaatggaagaagggatgaccgcacgtatagtaggatgaagtatatgattgaccgttggggaatagataggtttcgggctgaagttgaaaaatattacgggaagaagtttgaaagtttccgaccattgccagagtggcagtttaacagctaccttggctggcaagaacagggtgatgggaaattattctatggagtgcatgttgataatggtc

SEQ ID NO: 46384 - DNA, 367 bp, Zea mays
  Clone ID: LIB3066-012-Q1-K1-E12
cccacgcgtccgatctatgggtgcgtgcgtttgttgtccgttggggttcatctgtgcttgttaatatgtactgggatcatgttgtgcgtatgtgtgtgtcgtcgttgttggttgattctttaatttggttccttttgctgtacttttgtgggccatgaaaacgggggaaacttggtaagaacataggatttctgatgtttctttaaagatcgactaaaaatttagtgttcatgatagacagacagtaacgattggatgggcttaaaataggggtctcagcaatgcacgtaaaataggggtctactttatatttttgacattgctggaagtaggatataaatggtatagatattattggtgtatactc

SEQ ID NO: 46385 - DNA, 413 bp, Zea mays
  Clone ID: LIB3066-012-Q1-K1-E2
cgacgcctggccgggttgcgacgcttccattctcctggacgagtcgcccgccggcgagctcccagagaaggagtcgtccgccaacggcttcaccctggtcgggctcagaaccatcgacatcgccaagtccaccgtagagggcatgtgccccggcaaggtctcgtgcgcagacatcctggccttcgcggcgcgcgacgccgccgtggccgcgggcctcccgagatacgaggtcgcggcggggcgccgcgacggcatgcgctcgaacatggacgacctcccgggcaacttccccgtgccgggccaccacgtgccgcgcctcaccgagctcttcagccagcgggggctctcccaggaggacctcgtcctgctctccggcgcgcactccatcggcggcgcgcactgcttcatgttct

SEQ ID NO: 46386 - DNA, 296 bp, Zea mays
  Clone ID: LIB3066-012-Q1-K1-E3
catctatatctactaacaatactggtactttatataattttgcgttcctcaacagctaaacattttttctactcacaactattactatcaccaaataaccttaatcgacatttttcacttaaaaccctcatctcatacctccacactatctaataaccccacaccacctttttcccataacataccatatactacattttcaacattataaatcaattctattcgctataacatctactacctacaaaactattactccgacctacctaatacattctcattcaacaccaatctat

SEQ ID NO: 46387 - DNA, 406 bp, Zea mays
  unsure at all n locations
  Clone ID: LIB3066-012-Q1-K1-E4
cgggcccaancggccgaaccttttggccttaagccccggccccaaacctcgaggcgggggagccgccgaggtcgatgccgcgggcgtgcttgcggatgcagcggaggcggcggcgtcagtgccagcgccgttcccaggggaggtagccgccgcggctgcggactcattcccccctgttgccgcacttcagcacattatcgacgctatccatacctttaccgggctgaactggtgggtgtgcatcgcgctgacaacatttattatccggagcgccacagtcccgttgctcgtgaaccagttgaaggccacgacgaagctaagagcaataaatccagagatggaagtcattaaagaccagatgaatagtatggatccaaaatcagtgcangagggacaagctaaaatg

SEQ ID NO: 46388 - DNA, 296 bp, Zea mays
  Clone ID: LIB3066-012-Q1-K1-E5
aaaaaaaaaaaaatcaaaaaaaaaaattaaaaaaaaaacaaacaatataaaaaaaagcgagaattaataactcttgcgtgcgacaatatacactctcactcccctcttacctcccctcatttccttcaccttctttcttacaacttcattcctttttattccctttacattaccctactttgtcccctttcttcacatcccccttttgccaaaccccttactttcccaaattacctcacctatcttccttcccaacttttccacattctcattctttataagaacccccactgtat

SEQ ID NO: 46389 - DNA, 410 bp, Zea mays
  Clone ID: LIB3066-012-Q1-K1-E6
actccgccaacccatcacaccttctcatccttttccccctaccccaacctcaacccaacgccgatcttttacaacgatgcggcggacatcctttcacattcatccgactcataaccatcaacaccagcacctttcccatagaaggtatcctccactactacggactcattccccactttttccgcacttcagcacattatccactctatccatacctttaccccgctaaactagttcgtgtccatcacccttacaacatttattatcaccatcgccacactcccgttcatcttcaaccacttgaacaccaccaccaatctaatagcaataaattcaaacatcgaaatcattaaagaccagatcaatactatctatccaaaatcaattcaatatgcacaagctaaaattaa

SEQ ID NO: 46390 - DNA, 306 bp, Zea mays
  Clone ID: LIB3066-012-Q1-K1-E7
atttcgaataacacagttgagcgcgactatgggatccctcgctaataacatcatgggcgtgggtgtcgtcctggcagcgctcgtcgcctgcatgtcatgcgggccctcgaaggttcagcccgttctcaacatcatcactaactacaacgtcaagtggctcatcgtcagggacaactggtacggttagcctaacagcaccggctctcccgacttcaacagcgcgtacatgatcaacatcatgaacgtcttatactagccagggcagattgcgcctacaagcctgttcatctgacctaccgagtacat

SEQ ID NO: 46391 - DNA, 304 bp, Zea mays
  Clone ID: LIB3066-012-Q1-K1-E8
cccacgcgtccgcccacgcgtccgcgtacgcgtgggtttagcaccaggcaaacggggcgactatgccaacgcagtgtctctagagcactgtaggctctagttctccagaggcccgccacaaccacaagccaaggccacagccagtgccctcgccatggctcccaacctcagcaagaagacgcctgctggcctcctcggcgacgaggtggccccggtggagggactcaagccgtcgcggttcacccttaagggcaaggacctgtccgtggacgggcactcggtcctgctggacatgccgggcaag

SEQ ID NO: 46392 - DNA, 415 bp, Zea mays
  Clone ID: LIB3066-012-Q1-K1-E9
aggaccgcgacgagccggcgctggggttcaagatcaacgtcacccgcgccatggacgggccctcgctctgcagcgaccccgccaccttctccgactgccccaagatcctgggcatgtcggccgacgcccccgaggcggagatcttcaaggagtacgcgaagaagcacgagagcaacaacggcaccaccattcctgccgctgcaaccggcgccgccgcggcgaccgggaagagcacgagcgcggcgccgacggcggacggcgccgggaggcagcccggcacggtcttcttctacgtcgtgtcggcgctgctcgtctccgtcgcggtcctgctgtgctgatggcttaacggccggccgcggcagcgcatgcattcatggccggccggccggcagggagatggaggtgctactgcacg

SEQ ID NO: 46393 - DNA, 355 bp, Zea mays
  Clone ID: LIB3066-012-Q1-K1-D4
ggacgccgaggaggccagcggcgagaagaagcaccaccacctcttcggctgaccgggggccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtggctcccct

SEQ ID NO: 46394 - DNA, 310 bp, Zea mays
  Clone ID: LIB3066-012-Q1-K1-F1
cgaagcaactgaaaacaagccagcgatcctcttttccttttccttttcgatccattctggggcgcaacgaaataaacatgtctgaaccggcaaagatgtcgtggcaagcgtacgtggacgaacacctgatgtgcgagatcgaaggccaccacctcgcggcggccatcgtcggccacgacggtgccgcctgggcgcagagcacggcgttccccgagttcaagaccgaagacatggccaacatcatgaaggacttcgacgagccaaggcacctcgcgccgacaggcctgttcctcggacctaccaagtacat

SEQ ID NO: 46395 - DNA, 414 bp, Zea mays
  Clone ID: LIB3066-012-Q1-K1-C1
ctggatcatccggagcaggcacgactctgtgttcaagttttagagcatcatgccaggtgcgtttgttgcactgaaactgatgttccagactacatacatcgacgaaggcaatagatccaagtgttgcgtattcaaaggtgatcctgcaaaggttgctcatcactgtggcagcagcaaagaagttaaagagaaaataagcatgataatggatgaacttgcccttgatggatatcaggccatagctgtaggacatcaagtagactcttgttgggactttattgcccttctgccttatacagatgaccttaaaagcgatagtgctgatgttgtcgatagccttatcgatctaggtttagatataagagtcctcacagaaagtccattgtcgaccacaaagcacgtttgtggaaagct

SEQ ID NO: 46396 - DNA, 411 bp, Zea mays
  Clone ID: LIB3066-012-Q1-K1-C10
gcgagcggcgcttttttttttttttttttttcttgttcagcatgaacctgacaatggaacatcagcccctaagtcatcgtcgatacacaagatgcgattgcgaaaggtacaagccgatttccaccatgggcaacaagcaaacgtaaggtttgcctgccctctagggtcaccttggtgacacgcccaatcaaggaactttcagccctctttacatctagcaaggcgttcgctagctacatcgctcctccatagcatgccctcacgaaacagggatctctccagcacgtccaccaccggttcacttcctcatgtgttcaggaacgatccgatggacaagctcgattgggagcccttcgagttcggctgctgtgaagtcgaacagcgctggcagcggtcgtccacttggcaagc

SEQ ID NO: 46397 - DNA, 281 bp, Zea mays
  Clone ID: LIB3066-012-Q1-K1-C11
tgccacccgcgcttttttttttttttttttttcttgttcaacatcaacctgacattgcaacatctccccctaagggatggtcaatacacaaaatgcaattgccaaatgtacaacccgatttcaaccatggccaacacccaaacttaaggtttacctgccctctatgataaccttgctaacacccccattcaaaaaactttcatccatttttacatctatcaacgcgttcactatctacatcgctcctccataacatgccctcactaaacaggtatctctcc

SEQ ID NO: 46398 - DNA, 262 bp, Zea mays
  Clone ID: LIB3066-012-Q1-K1-C2
cgcacgcgtccgcccacgcgttcgcccactcttactgtctagctgcttcatcctaaggggccctatataagtgtccatctgttgcatcctaaatccttcgctagttgcaacatgaacttctagccgaaagcatattcgtcgtcaaaaagggactccgagaggtccagaattaggtcctcggcggtgatctccgaaggtgccacattttccgactaagcccttgactgatatgggtcacacatcagtcccataagccgttcat

SEQ ID NO: 46399 - DNA, 412 bp, Zea mays
  unsure at all n locations
  Clone ID: LIB3066-012-Q1-K1-C3
gccaagccttcggccaagccttccggttccccgtttccttttcaaactcaaatcatggggctccacngatcggctccaagcccgcagaagacgagcaacagcagaagcgcccgtctctcttctcgccgtaccagatgccccgcttccgcctcacccaccggtgagcctccatcgcggtggtgctggcgccgatgaccaggtgcagggcgcccgacgcgatcccaggccccgcgctcgcggagtactacgcgcagcggtccacggagggcggcttgctcatctccgagggcaccatcatctcgccgtccggccctgggttccctcgtgtccctgggatatacaatcaagaacagactgatgcatggagaaaggtggttgatgctgttcatgccaagggagctatctttttctg

SEQ ID NO: 46400 - DNA, 407 bp, Zea mays
  Clone ID: LIB3066-012-Q1-K1-C4
cggacgcgtgggtggggataggatctcagctcatctgggaccgtgcccttgtcctggggcttgataggcccaagagtgttaccatggagtggctggagaactactgctagaacaaggctgcttgaagcttttcacacatgctgctttttggcaaccttggctgttaataatttaaacgcgagttatagaaatagtcattttcctttggccgatgaataacgcaagagcaatatgctcaggcggaagaattttgtatcttccgtaacttggtgaacatccagatacttgatctgcggcaacaatgggcagaagagattaggacatgctgattgatctttatacgccaacacttgcttttctttaacattacttgttcgctgcagtttaatccagctgtttgtaactgc

SEQ ID NO: 46401 - DNA, 411 bp, Zea mays
  Clone ID: LIB3066-012-Q1-K1-C5
gatcgttggagctcggccgagctgagcacgcacagtgtgattgtgtgtgtgtgtcggacatggcgtcgctctggctagcgagagcgtcgtcccagctggcgcgccgtgccgccgccaggaggcctcctccgcgtcctgcgcgccacggctccgaccaacccaccagttcgtggttcctgggctcagtgccgccgccggcccttgggtcagcagcggcggacacctgccgccgcggcttctgctccgtccggcgcttcgcaggggagagcagcgctgctgctgctgcggcggctgtcgtcgacgaggagccggagagcgggttcgcagccggcgatcagcaggcagttgactttcctggagggaaagtatcctttgtggcagaaatgaacttccttccagaatcgacgaggg

SEQ ID NO: 46402 - DNA, 409 bp, Zea mays
  Clone ID: LIB3066-012-Q1-K1-C6
cagacgcaggcgctcacgttctgcgacaccatgtgcatgaacacgcaggacacggtgggctcggcgcagcgggccatcacgttcaaggacaccggcaccgccaagatcatgctgcagctcgccgtccaggacttcgactcgtgcgaccgccccttcacccaggccggcgtccccaaccccatggggaagtttgacaaggagctcaaccagatggccaacaactgcatggctcttgcaaacatgatatgaaccacgcatgcaaccccagcgtgaggtgccatcgcatgcacggaatgcttgcattcatttttcatttaattaagaattcattgaaattatgagttatatatattgagtaactctatgtatttgttcctgacctgcactatttattcaatagtatgtcatg

SEQ ID NO: 46403 - DNA, 408 bp, Zea mays
  Clone ID: LIB3066-012-Q1-K1-C7
gattgaacgtggctgcatcatttttcctttcattggtcttttcagcaacagcgatcgattctcgtgggagggagagagagagagagagggagagaaatcaaagaggagagtgatcatggagcatgtgattggagggaagtataagcttgggaggaagattgggagcggatccttcggagagctatatctcggtgttaatatacagaatggagaggaagtgggaataaaattggagcctgtgaaaacaaaacatccacagctgcactatgaatctaaagtttatatgctgctgcagggtggaaacggtatcccacacctcaagtggtatggtgttgagggggagtacaatgttatggtgatcgatcttcttggcccaagcttggaagatttgtttaattcctgcaacag

SEQ ID NO: 46404 - DNA, 404 bp, Zea mays
  Clone ID: LIB3066-012-Q1-K1-C8
cgctctctcttcctctgctcttctctgcctgcctgagctcaccgcacctcgcctgcgcaccgcgtttcctccgttaatccggtagaaaatggccgatgccgaggatatccagcccctcgtctgcgacaacggaactggcatggtcaaggctgggttcgccggcgacgacgccccgagggccgtcttccccagcatcgtggggcgcccgcgccacactggtgtcatggtcgggatggggcagaaggacgcctacgtcggtgacgaggcgcagtccaagaggggtatcctgaccctcaagtaccccatcgagcacgggatcgtcagcaactgggacgacatggagaagatctggcatcacaccttctacaacgagctccgcgtggctcccgaggagcaccccgtcc

SEQ ID NO: 46405 - DNA, 421 bp, Zea mays
  Clone ID: LIB3066-012-Q1-K1-C9
tactccactcatcctcccttttttttttttttttttttttttttttatttttttttttttttttttttttagtttttttttaatttttggtttatttttttattttttaaatttattttttttttttttttatttttaaaaaaaaaaaaaaaaacataattatcaaaaaaatttttaaaaatttttaaaattaaaaaaaaaattttttatctgttttttttataaaaacttaaaaaaaaattaatttcaaaaataaaattttaaccaaaaattccttaaaaaatttttgccttttgtacactttttcaaaatttaaaattattattttaatttaaaaaaaattttaacattcaaataaaaaaattttatttttatgaaaaaaaaccctttaaaaaaaatacccacattttttatttttttt

SEQ ID NO: 46406 - DNA, 415 bp, Zea mays
  Clone ID: LIB3066-012-Q1-K1-D10
acatatccaccaatggacgtgaaactcccacacgaactgaatgtgtatcaggatatgtttaaagagttctatttgagcaagtacagtggaaggcgtttaatgtggcagaattctttgggacactgtgtcttgaaagcagactttcccaaaggcaaaaaggaactcgcggtgtcattgtttcagagtgtggttttgatgttgttcaatgacgcacaaaaattaagcttccttgacatcaaagattccactggtatcgaggataaagaattgagacggacactgcaatctcttgcatgtggtaaagttcgggttctccaaaagataccaaaagggagagatgtagaagataaggatgactttgtattcaatgaagattttagtgctcccctctatcgcataaaggtaaatgcaattc

SEQ ID NO: 46407 - DNA, 292 bp, Zea mays
  Clone ID: LIB3066-012-Q1-K1-D11
cccacgcgtccggtcgactgctgctgcgttctgttccgttcggaagatgttcttggagagcttccgggtggagagcccgcgggtgaagtacggcaacggcaagatccattcgaagtaccgttacaacaccaccaaattcttccggccgggaattgccgccgccccgggttggttgttcccccaaaggtcgtgaacttacactctaaggaccagcacaaacttccaaaaatctggggtgaacgctcgccatatggcgcggacacaacggcaccactctcaggcccggtgatat

SEQ ID NO: 46408 - DNA, 413 bp, Zea mays
  Clone ID: LIB3066-012-Q1-K1-D2
cccacgcgtccgcccacgcgtccgcccacgcgtccgggtccctcaaccaacactcgtgagatgatttggaagcttgcagagactggaatgaatgtagcgcgccttaatatgtcccatggtgaccaccagtcgcaccagaaggttattgatttggtcaaggagtacaatgcacagaacactgatggcaatgttattgccattatgctggacacaaagggtcctgaagttagaagtggggatgttccagagccaatcatgctcaaggaaggtcaagagttcaacttcacgattaaaagaggggtgagcactgaagacactgtcagcgtgaactatgatgacttcataaatgatgttgaagctggcgacatactattagtggatggaagaatgatgtcgcttgctgtgaagtctaa

SEQ ID NO: 46409 - DNA, 412 bp, Zea mays
  unsure at all n locations
  Clone ID: LIB3066-012-Q1-K1-D3
cggggaacccctggccgaccccttggccaataaggaaaaccagcagcctccaataagagcggggcagagaaactaataaaactctcgccgncgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgncgnctcggggccctccgccagcagcggcgcgcccgccctcgccgccgcgcccgccgcgctcctcttctccctcctc

SEQ ID NO: 46410 - DNA, 396 bp, Zea mays
  Clone ID: LIB3066-012-Q1-K1-B9
atccaatggaaagcatgtgagttcattgccaccaaagcccttgaatagtgctgcagcggccttgcagtctaaggctagtgctactccaaaggatcagtttgttactgctcggcggcaagatttgcctgtaagttcaaagcatggagcagacactaagtccgagaaggataatttcacagtattacataaggctggcaatggtcctgttgtcaaagaacaatcacttgatgcccatgcaagcaaaagtaaagctcaaaatgtaaaggccttgcctaataatggtggatcgctcgctaacatgttacgccgtgcatcaacaaaacctaagcctgcaagtaccactaattttacagctgtagcaagtgttacagctactgctgatgcacaaatttgtgc

SEQ ID NO: 46411 - DNA, 447 bp, Zea mays
  Clone ID: LIB3066-033-Q1-E1-E12
ggttggaacctttgggctgatttatgtgcttgtcctgatactgagactgatggtaagttcgtaggttggactgcgtcgggatcgccgggggatattgccttcaaaatcgtagagaatccttgagtatcccgtataggggagaaaggaaccgttaagcttggtaagttctcgcggcataaggggctgatgccttataggactactttggggcctacgacttagggaggtgatcctattaatggtaatggtatggggggtgagcttactcatggtagtattactcctcttgatgagaatcctaagtatatttatgtcaaagttggcatgtcgcttacggtcaatcatgggtttgatcttaacggtctttagcctcctactattattgcagatgaaaattggccgtttaagaagtcggatgggtgttatgcggcgcctggtaaggcggcg

SEQ ID NO: 46412 - DNA, 264 bp, Zea mays
  Clone ID: LIB3066-033-Q1-E1-E2
atgaacatccatcagttatgaacattcgcgaaaatagtaaaataaaaaacgggtattgtccgttaccacatacggaaatcctgcaaccctccaggaacgctatgcggtctgactgaggttaagttacgcatgcataagccgactaatcacccacgtacgtcgtcgtacgctctacacatgaaggtattacttctctgttgcttagtttcgggcctttctgcgctttcgggacacataggggtggttgtctcagaggacttaagt

SEQ ID NO: 46413 - DNA, 376 bp, Zea mays
  Clone ID: LIB3066-033-Q1-E1-E3
tgcttgtttatgtgcttgtttatgtgcttgttttgcccattctcctaatcttaacttacggttcgtgtggactgtcttatgttggtggaggatgagtaatagtagaagtgtttgctctctcctctgttgcattagacgttttgtccttgttctatttattgggcggcgtcggtgttgacgattaggcgtagggtgtttgatgtgactttaggttttgtgtctgtggagcatcatgtgtagtggcctatggagggtggtccgtctactcttgagggtattactactctgttgcttggtttcgggcctttctgccgtttcgggacacataactcagaatagatcgacgtacggaggaaaggggatgacgtcgtctacg

SEQ ID NO: 46414 - DNA, 465 bp, Zea mays
  Clone ID: LIB3066-033-Q1-E1-E5
gttggaacctttgggctgatttatgtgcttgttcgtattaagaagcatgatcgtaagacttcctttaatctgtcggcgacggatcctgcgagataatggggaggcgcttggggctatgtcgtctaatcttaagcctccttatacgaatacgcattggcgtaaggatacgtcgactaaggatgcgattgcgatggtgtttggggatagttttaatatggacggtacttatacgggtgatctacttgggactatgactattaatattgctaccggtgctggcgatgatcgtactcttactggttttgggattcttaaggcgaatactattggtgcgattcgtggtttcggttatggtactagtactggtagttcagggtggcataaggatgagaaggatgctatggatactaatgctaaggaccgtatctccaagaagatgacgcctggtgcttgtactaaggtgca

SEQ ID NO: 46415 - DNA, 466 bp, Zea mays
  Clone ID: LIB3066-033-Q1-E1-E6
ggttggaacctttgggctgatttatgtgcttgtggatgtgcgggtggatgtgcgggtctgactcgattttctttcttaaacttcgcccgatgtttctcttaaactacgtcagttgaaatgttttcttctaaactcgagtactaaactgatcttctactccttcgaaattacttatcttctttcaaacttctctagactaaacgttttcctctaaacacggagggtcggaggatgagcgaactgaaagaagaggttgagggggcgaccgggaccccctcctccaccccgttaaacataaactagtcatccgtcaaatgacacccgtctcggacaactcaaagcaatgatgagtaaacacaagactggcggactctagaaaaaggaaacaaccgacgagaaggactccttataataaataaaaaactaaaagggcttaactctaaaggaaacgcaaaaaatgacgaac

SEQ ID NO: 46416 - DNA, 465 bp, Zea mays
  Clone ID: LIB3066-033-Q1-E1-E7
ggcttggaacctttgggctgatttatgtgcttggagtattattattattattagcatgggttgctcttgttgtagttgacgcatgtgcggtgggatgggtagttgttgttgttgttgttgacgcattagtagttgcatggatagttggcgcatgtgctgttgcatggttagttgttgttgttattggtgacgcatttgttgttgcatgtgtagttgttgttcttgttattatggaagattggtgtactgcctgtggaaggacgtcgcgtagggcccgttgtaactcgccgtcgtcgttctacggatgtgcgtcctcgactgcgcggctgattataagtttaagaaatgatgctccttcttcggttcgggctagggcgtttactagtgaggagtcgagactaattattgtgccgagtagtcggcggcagttcggtgttgcccgtactcccgtattgggaatgaagt

SEQ ID NO: 46417 - DNA, 177 bp, Zea mays
  unsure at all n locations
  Clone ID: LIB3066-033-Q1-E1-E8
ggcttggaacctttgggctgatttatgtgcttggcaagagctgctcaacctaaccggcctccaccatatnttcctccacccttctcgcgtngcacccccacaattggtcggcgactcataagaatcaattaaacatcccacctacccacccatcgaccgccatgttcacccaaaccc

SEQ ID NO: 46418 - DNA, 450 bp, Zea mays
  Clone ID: LIB3066-033-Q1-E1-E9
ggcttggaacctttgggctgatttatgtgcttggcctcctcctttctaacttaccgtaagtaataggaggagaaaaaataaggagtgagagtggcgtatcgatgtgtataaggtaaaatttaactggagttgcggattgggttggagacagggtctgaggttacggtaagtggaggtgagggtgtagggagtggtgagcttttatttgtcgttctagcggaggtggtagtgggggaggtgatgtcgtatacttggcgtgtgaatggtctcaagcctatggcgtagatggattcgggtgttatggcgggtgggcctaaggaggctgcagttgggagtcgtgatgcgttggtgttgtagtagtgctcgactcataagggttgtacttctaaggatgagtaaatttcagaaagtcatggtgccgagatagactatataacctatccggcgtgc

SEQ ID NO: 46419 - DNA, 297 bp, Zea mays
  Clone ID: LIB3066-033-Q1-E1-F1
gggaaggggccgttcccaaggattaggggaaaaaaaaaggttcgaaatctaagaccaaaggcggcaactactattctaagaagtcgactaacggagtatctgtaagtatagcgctaagaatccgcgccgtattccccgagatgactagaatgtacccgacggccgggagcaacgggaacctgctgatcgaggcgccttagctcactacgaagtacgagggacggatcgggccgccttgcggcaatcccgccaacgctacttgggcagtttttagtaaggtaactgagtcccccgtcc

SEQ ID NO: 46420 - DNA, 450 bp, Zea mays
  Clone ID: LIB3066-033-Q1-E1-F10
ggaactttgggcggatttatgtgcttgtgtagacttttattcgtcttgttgttggttattgtgccgtcttttctggtagttgaggcggtagaagtattacgctcgttgtgcgagaggtctcctaagtagtaataccatccttagaatccgattaagtatattcattcgaaagggtgtcctgatgcgactattcttgctgttactttttccgtatctgtcgttcttagtacgcctacgaccgggtgcggagcccataatacgctctacggggccgggaagaaagagcgactccttatcggccaatcaccgccctcgtccggtacggaagctacattgctgagatcgtgaagcttctcctgtccgtaaaacaacatggttaaacaataacctgatcatacccctgtaactaaccctcgcccgcacccgcgggcgcgaagcggtagcaatccg

SEQ ID NO: 46421 - DNA, 444 bp, Zea mays
  unsure at all n locations
  Clone ID: LIB3066-033-Q1-E1-F11
tggaacctttgggctgatttatgtgcttgtggatgtgcgggtggatgtgcgggcccggttgttttttataaggttatctatttggggggtcttatcttctgattgtattgagtagaggactatacggtacttgttgccctgtcctcttctctgtttttgtgttcgtcttattgtgatggtatactttgttcttctagtactttgtactggtgggcttcttctgttgtttttaataatgtgattttctgctggtcttcggtttttgtgttgtgtgttcttaataataatgataatagtggggttgcggaggtgtttgattgttctgcggttgtggctgttcattcacatttgccttctgatggtgtgtattatgggtgtccntcctctatgtagccttttcctcctggtgtgtcgtcttgtttgtcggtttttgtggtctggtct

SEQ ID NO: 46422 - DNA, 428 bp, Zea mays
  unsure at all n locations
  Clone ID: LIB3066-033-Q1-E1-F12
gttggaactttggggtgatttatatgcttgtttatgtccttgtcgacccgaaacaacccccaacaaacagcctgcgaactttcgtagtnggtccacacacaccttcgttaagacaaangcaacggagctgctatgtacgccttagttggttgctacttcgtcctcttcgtctaccgcgcttattgacacggtataggtaagggaacgtgagaagcatagcgagtgacccgccggggtacgtacgactgtagataatcgtgttaacgcccgttgtggcgagggtcctccggttggtaggcgtagtattccttgttgttgtcgtactcgtatcaggtagcgtcaaataagactgtctgactgtctgctacgtaccgataattcacctccaacaatgcctaccactctgcctccacccacgatcaacgcta

SEQ ID NO: 46423 - DNA, 445 bp, Zea mays
  Clone ID: LIB3066-033-Q1-E1-F2
tggttggaactttgggctgtttagtgcctgtgctaccaaatacgacgccgttgggttgagggaatatctccaaattgaacagtctctgcgttctcgtacacacataattgcgccccaaatccccttctcctaagtcccccgaatttagaggttaaattatttcctaaaggcacaacgtaaggtccgaagcacgataagaacccgctagacctgctatttcggaggcgttcacgccgaaccgtatgatttttaaagacggtactaagcctaatcgctccgacggtcgtagctttagtcctactccgatctggactccctttaacttagaagcggacactgtacagactggtattattcccagcataggctgctcgtagaatcacgcacgaactcctatagcagaacccattacaactagaccccggtggcgtaatcggtccaaaac

SEQ ID NO: 46424 - DNA, 268 bp, Zea mays
  Clone ID: LIB3066-033-Q1-E1-F3
ggggcggtggagtattcagtcggacgaaagaccattatctggtattgtccgatctgcttctccccaagagcgagagcgggggtatggtcgtcgtaaactttcgggtcctctaagagacagctacggacggagtaagtgctggagaaattcttcctagggatatgaaaagtgaggtaggtgctgatgctggtgggggtgatcttttattgctttttgttatttgttggctgagatggtattgtctctggggtcttggtaatctacttac

SEQ ID NO: 46425 - DNA, 363 bp, Zea mays
  unsure at all n locations
  Clone ID: LIB3066-033-Q1-E1-F4
ggcttggaacctttgggctggtttaatttgcttgtttatgtgcttgtttatgtgcttgtggatgtgcgggttcgctttattcgttgtgggcgcgtgagtcggatngtcctgagcatcgtcataggcggattcctgttggtgatggtgcggattcgatgtataatgcgatggcgtttaagccgatggcggagacggttggcggtgtgaggtcagagttggaagttaagagtgcggcgacgttggaagcagcgtttggggcggtgcgttcggttcccaggaagtcgttgtggggagggttcgggactccgggtaatgcgtctacgtaagagcatactcgggagactgattatngaaaggggaaga

SEQ ID NO: 46426 - DNA, 297 bp, Zea mays
  Clone ID: LIB3066-033-Q1-E1-F5
cttgtttatctgcttgtttatgtgcgtgtggatctcctcattcgccttattcattaccatcgcgtgagtccgatcgacctgagcatcgtcataagcgaattcctgtttatgatcgtccgaattctatgtataatccgatagactttaacccgatggctgagaccgttagaaatgtcagctcagaatttgaaattaaaagtacgtccacattctaggcagcgttttcctcgattcgttctgttcccatgaagtcgtagatgggagggttcctgactccgtgtaattcgtctacctaat

SEQ ID NO: 46427 - DNA, 479 bp, Zea mays
  Clone ID: LIB3066-033-Q1-E1-E11
tggaacctttgggcgtgatttatgtgcttgtttatgtgcttgtatagagatattaagtgccgaatctgttcaagtagtcactaattggtttcacaaagtcagatattgcatttacggtctgtgtcagtgctgctcccgctaccgttgtctcttctcctgctgttacggctgcagtattgacggttgaggtaaagcttgttgacgttttcgcggtcgatgtgttagttgacggattcagtgggttggtcgtcgtattcggtttttagggcgctgaaggttcgctaggtaacgaggacgatgacgacgatcttattaaccgaggttatatatgctggtttggccaaacccggaataagatacggaagaaaaacgagagtaacgctcccaaaattacgacaacgcgcggctacttatctacttacggacatacttccgtctctttctccccctccctcgccggacccctaacgcgccactac

SEQ ID NO: 46428 - DNA, 184 bp, Zea mays
  Clone ID: LIB3066-033-Q1-E1-C7
ggcttggaacctttgggctgatttatgtgcttgtctacctccccccccccccccacacccccccccattattaccacatacaataatcgcggcggccccccacaaaaccaagagttaaaataaaatactactacccacatcactatatcaaaaaaaaaatcagcgttacccacccttttacacc

SEQ ID NO: 46429 - DNA, 399 bp, Zea mays
  Clone ID: LIB3066-033-Q1-E1-C8
tggaacctttgggctgatttatgtgcttgtttctgctgctgctctatctattttgttcctatgttctttctattaaacaaggcttggtgtccccttgatacctataggggggataggaaactagtggttacggttctgaccttggtgatgattcctgttgctactccacttgcttctcctcgcgttgtggtcggtattgttgctgataatgattcttttgatcatgctacttagggttgtgctcatcgtgatattcgttgtgttgggcctgcgattaacgctattgagcatactgtgggtgttaaggcgaggtcggagcgtaagtatcctggtattggtaagtctgagtgtcttactgatggggcgattgatgtgaatggtatgcatatgactgagtct

SEQ ID NO: 46430 - DNA, 402 bp, Zea mays
  unsure at all n locations
  Clone ID: LIB3066-033-Q1-E1-C9
ggcttggaacctttgggctgatttatgtgcttgagtaggagtcataaccacccttaacaaacgaagtcatctccaagttacccgagaagggggacccaccagatagtttcaccgttagatcattcgatacagagattataatatccggagttatacacgccgtcagtccagacgtaggagcccggattaaggaataagcacccgtaggccagtataaggagaatgtgataactccctgtttaaaatcagacgaggcgtataagaagagggtcgacctacggcataagatggccctaagactacctgacccggtcgattccctctcgcaaacgccctccgctggtaccgactcactcgcccccggaagacgtaaacgaacaaaccggctcccgtcggcttcna

SEQ ID NO: 46431 - DNA, 405 bp, Zea mays
  Clone ID: LIB3066-033-Q1-E1-D1
ggaaatttgggctggttgtagttcttgtccttttaaaaacttatcgtagattcctttaatctgtcggcgacggatcctgcggatgaggggaggcgcttggggctatgtcctctaatcttaagcctccttatacgaatacgcattggcgtaaggatacgtcgactaaagatgcgattgcgatggtgtttggggatagttttaatatggacggtacttatacgggtgatctacttgggactatgactattaatattgctaccggtgctggcgatgatcgtactcttactggttttgggattcttaaggcgaatactattggtgcgattcgtggtttcggttatggtactagtactggtagttcacggtggcataaggatgagaaggatgctatggatactaatgcta

SEQ ID NO: 46432 - DNA, 398 bp, Zea mays
  unsure at all n locations
  Clone ID: LIB3066-033-Q1-E1-D10
ggttggaacctttgggctgatttatgtgcttggtgagtggttgtctgtgactcagaatccgatgtgcggggtagacgtagttaggtgcgaggctcatctatggggcgcgacctgccctatacgacgagattcggaacttcgcgattgcgacggtgatgtgagatggtcaggtgaggtgtttcttaacttaagaatgggaaatttgcgctgttcgccggcatgtgggtagaagactgggcctgttacccttaagtccggcgttctgttgttcgggctctctgctctgggtcttgaagttgtttgtgtcggctcaccagggcaacccggcctagctcacctggacncacgaaaccctggggctcgaaaaacgagaattgaaacccttaaaaacaccccag

SEQ ID NO: 46433 - DNA, 415 bp, Zea mays
  Clone ID: LIB3066-033-Q1-E1-D11
ggctttggacctttgggctgatttatgtgcttgtttatgtgcttgtacatcttctggctccaattcaataaaataaatttctacatactcgtgggccacacaccactaactggctcaaacacccagtcatctatccttttattcatcgcataacataacaccataatcaacataaaacgaataacgctcgttccattctccaatcatgacatagcctaaatctttcatctatacaatttcacttctcgaccacctctcacatatcacccatactaactacttacactatagcacgtacatacactctattatctcactccatcactcctgtacacctatgctaattcaccacaatatatccacccactactcaaacgccactacataaacctaactacaaattccctacaactac

SEQ ID NO: 46434 - DNA, 478 bp, Zea mays
  Clone ID: LIB3066-033-Q1-E1-D12
tggaacctttgggctgatttatgtgcttgtttatgtgcttggcgacccgaaacaaccggcaacaaacagcctgcgaactttcgaggtgggtacacacacaccttcgttaagacaaaggcaacggagctgctatgtaggccttagttggttgctacttcgtcctcttcgtctaccgcgcttattgacacggtataggtaagggaacgtgagaagcatagcgagtgacccgccggggtacgtacgactgtagataatcgtgttaacgcgcgttgtggcgagggtcctccggttggtaggcgtagtattccttgttgttgtcgtactcgtatcaggtagcgtcaaataagactgtctgactgtctgttacgtactgataattcacctccaacaatgcctaccactctgcctccacccacgatgaacgctacgcacgcctcggcgatcgctacgcacacctcgacgatcgctacgcactccg

SEQ ID NO: 46435 - DNA, 349 bp, Zea mays
  unsure at all n locations
  Clone ID: LIB3066-033-Q1-E1-D2
ctttctgtggtggtggtggaatttgagttcgagcttcgtttttttgggtcaggccggctcttgttcttgtttcttagctctcccggtataattcgtagttgtcggtgtaggcggatacggactcgttaagttctgttgctgcgtcgtgtgttgtgtctagctatgccttcgaagagtgtaaagtcgtagaggagagctctaattagccttagcctatattatagtacccggcgagaccgccatagactaccgctgacggaagccgcgacacggtcgcaagataggccgtaagtacctaccctaagaaccccaccgtgaanaatccgctatctaacgacttaaacgagct

SEQ ID NO: 46436 - DNA, 404 bp, Zea mays
  unsure at all n locations
  Clone ID: LIB3066-033-Q1-E1-D3
gcttgggttcggttataaccgtaagtgttgcttgccgtttttcggggcgctggacatggcttttagggtattggacttagtggtttangtcggtattgtcgttgttgctacggacgcggaggaagaagtaagacgaaggagtctctttgtcactcttccgttcaagtttcaagtacgggtaccggttgctgtcgtcgttgtttaagtagatgattttgtcgagttttatgtagacgatgtgagagtatgatttgctgttttttcattgttcgtattataaaaatatgaggaagagttttgttgttactttggtcagtcgtacggttacgttgatggttcttaatagtagtacgttagtacggcgggagtanatctagggtctagggttgcgcacccacgtcatg

SEQ ID NO: 46437 - DNA, 183 bp, Zea mays
  Clone ID: LIB3066-033-Q1-E1-D4
cagtaacgtcggaataacaccgtcctcgacttatcacgttagagggaggctcatttaaatcacggctaacgagaaaacggcactaagctaatttgtatgccgctcgtttattaagggactaaagtatccgccatcgacaaagaccagcgaaaaagcgttttccatcaccacacatccgaaccg

SEQ ID NO: 46438 - DNA, 396 bp, Zea mays
  Clone ID: LIB3066-033-Q1-E1-D5
cgttggtgtcttcgataatggtggcgtgcgtgggactaagaatgcgaattcgttatttcatagtggtacgatggtgcgtggtaatgcttttactcctaaggatggtaagggtcgcggtctacgtcatgaggcgagacgtaaggaaaaattcgagcgtctgggtaacttcgctatggcgcctactatagatacgaatcatgagttcactgtctttcattatcctgatccgagtggtaaggttcctggtctttcggtaaagtttgggtctaatgataagtcctgttatcgtggtactacggatgctgagcctagaagggcgtggcgtaagcattttgtcgggtagaagactgcgccttatactgagaaaggtcgtaattttaatcattcggttgcgtc

SEQ ID NO: 46439 - DNA, 466 bp, Zea mays
  Clone ID: LIB3066-033-Q1-E1-D6
tttgggctgatttatgtgcttggtaacatgaatgctgcatgagaattccctcctccttcttagtccctcttcccctccgttgtggtaaaatattcctgttggtgagagtacggtgacggtgcattgcgcttcggaggctatttcggcgctggtaaacgattctaagaaagcgctgtctcctctttggatctgtactcatgttgcggtccttactcttggacctgattcttgtactttcctttatagtatttaagtagattatagtaatggtcgtaattttcgtcggaatgttgcggcatatccttttactttggtcgttgtcgatatttgtggttctgtatcttatgcgaggtcttgtgtttagtgctcacattcgggtgactgtgatactggtgaggcgcccgcgtttactgatgattcttcggttggtgttgataagggcggtgacttgaggtttgcgagtcat

SEQ ID NO: 46440 - DNA, 471 bp, Zea mays
  Clone ID: LIB3066-033-Q1-E1-D7
tggcttggaacctttgggctgatttatgtgcttgggtaagaattggaagtgcggaaagaatgaggtcgatgatgataagtgtgagtctgcgcggaaggaagatgggtaggagcacgtgtaggcgatttggacgtctggtaatgggtggcgtgaggttattcgtgcggatggtatgtgttgttctcgttacacttggggtaagacgtataagaaggcgcggactgtggttggggatactgcttctgctggttcttgtgatcattaggatgataaggttgatgctacttctaagcatacgaatgatgaggtgtgttcgtctaaggttcatggggagtcctttgagatgtctaggtctaatgagggtgctgatgctgacgggtttgaggagggtgaggagaatggtgatcataatcatacctagcctgaggatgaggatactgataagactcaagaacctcgctctcttccctc

SEQ ID NO: 46441 - DNA, 268 bp, Zea mays
  Clone ID: LIB3066-033-Q1-E1-D8
ggcttggaacctttgggctgatttatgtgcttgaaaaaaaaaaaaaaaaaaaaaaaaaaacaaaaaaaaaaaaaaaaaaaaaaaaaaaaagagatgccccccctaaaaacacttatttctttccttctctccccttcttatccaatcctccccccccctcatttcaaaataaactaaccatttttttcccactaacccaacctttctgaaaactaaaaattcactcttctcaaaaattccactgccatataatccacctctcccctct

SEQ ID NO: 46442 - DNA, 465 bp, Zea mays
  unsure at all n locations
  Clone ID: LIB3066-033-Q1-E1-D9
tggcttggaacctttgggctgatttatgtgcttgtttatgtgcttgtttatgtgcttgtttatgtgcttgagtccaaccgtgttatcggcggggacttcttctccgtaccgtaccgtaggctgcanccgagtagtagtaattatcgtataggacgctgcggtagatgcatgctgacgagtattctacgcgtgagactgagggttattattcgagtctcgttgttacagctggttatgatggtgttgcccgggtttagagtattgtacctttatagcctaagttagaggagacgattaatactaccaaggatcctgatgagttcgggccctcggttttgactggttctccttccggttttattaagcatacggctacttaaggtgagtttggtgtcgctacctgtgggaagaagggactcggaggtacaatcgcgaagaagattggataggtgtcggcgactggta

SEQ ID NO: 46443 - DNA, 481 bp, Zea mays
  Clone ID: LIB3066-033-Q1-E1-E10
gttggaactttgggctgatttatgtgcttgtacgaatacgcataagagtaaggatacgtccactaaggatgctaacgacatactggggggggatacgttcaatatggatgggacgaatactaataatctacgtgttgctactaccatcaatattattacacgtgctggccatgatcgaactcttactcggtttcggattcttaaatcaaatacaatttgttcgattcgacgttatggttatggtacgagtaccatcagttcaaggtggcttaaggatgagaacgatccactcgacacgaattcacaacatcgtatgtccaataagatcgttaatggtccttctacacacgtacacgaagatatatctccttactctattagtcgtaagacttatcacgagaacactaagacggacgatctcggtcatttcactacgactgatacgaaccatcgttttaatacgacacgtatttctaacggc

SEQ ID NO: 46444 - DNA, 450 bp, Zea mays
  Clone ID: LIB3066-033-Q1-E1-C6
ggttggaaccttttgggctgatttatgtgcttgtttatgtgcttgttcgtagctactcttcttattattattattaagtctaataatagttagtgtgtgaaaacaacgaagagttgtagtacggtactactggttgtgtctccggcgtcagtttctgtgtcagcggtggttattgttttataggcagtggaggtaaagaagaagagagtggtggagagtggtgaggtggtggaggtgaagaagacttaggatgatcctcgtctgatgtcgcgtgagggtaagaaggggatggattcggctgcgcgtaaggagcttcgtgtctctctttagtagcttaattcggcgtcgcatggtaggacttagcgtaagggtaagcgtattgagtagaagggtactatggtgttggttacgaaagctcgttaggaggagcgtgataaggtgcatgcggcg

SEQ ID NO: 46445 - DNA, 408 bp, Zea mays
  Clone ID: LIB3066-033-Q1-E1-B11
ggttggaacctttgggctgatttatgtgcttgtttatgtgcttggaaataataagatcgatagtgatgacgacgttatagtcgtgcagggcggctctgtcggcttctgcggttatggttacagttgttgtctttggtgccgggcccgctgctattggttgtactcatcgtgataatcgttgtgttgggcctgagataaatgcgctttatgttacttaaggtgtgatggcggagacggagcgttgttatcctgagctgtagtaggcttatgataaggtggacgtgatgatgggttttggtggtcggcataggacggagactagtggtgattattaggatgagactcgtgatgcgtgttcgtctaagagttttgaggtggatcgtgttgagactgattatctttgtgatt

SEQ ID NO: 46446 - DNA, 244 bp, Zea mays
  Clone ID: LIB3066-033-Q1-E1-B12
ggttggaatttgggctgttttgtgctgatgggacctatattagttccctgggttcgtttccccaagtcctgtggggtgtgtacgtcggtcggaatcgctcctagactacggtcacgtggtcgctagaatttggtctcctcgatctctctacacgtacgaatggaattacggcgctacgactctgctgctatttgggtagtggtgctggaatgagtcggtgtaatttaggtgtggctctggtcac

SEQ ID NO: 46447 - DNA, 332 bp, Zea mays
  Clone ID: LIB3066-033-Q1-E1-B2
gcttgggcgaagtaagtagtatatgagatgacacagagggagggactacggtctctccttgcgttgttgtgctaggagggcctgtgtcgacttcctctgtgcgtcgtagttctactacgtcggtggtggtgctcggtggtggtggtgcggatgatgatggtgctggcggcgataggtcgacgacggattggccttctagtcggtaggtgatgcataattggctgcatttgatggtggaagagaggtagtggtggccttaggcgcattgttgtaataccgagtatactgaggttattaattgggtgggtaattcgatgcatatgtctggtgag

SEQ ID NO: 46448 - DNA, 455 bp, Zea mays
  Clone ID: LIB3066-033-Q1-E1-B3
gttggaactttgggctgatttatgtgcttgtggatgtgcgggtggatgtgcgggtgtctgatattaaggttttgtctaagcatttttccggtagttgtcccgtcgctaagcttggcggtcattgtactgtcgatgatgctacttttgtcgaccctaaggttggtattattcacaagattatatctagtactcaactagttctcgacgacgaaccacaccctaaaagagtctattcggcgtctacgccagtaagataacacccccctcacggtcaccccgcggtattaaattatttaagaaacacgcgacgtcatacgctttcctcgacgttccgccgcgccgggccgacaccaccatacaaatcaaacaaaccacccacccaagaccccaaaaaaaaaaaaaaaagggtggttgtctcagaggacttaagtccatgcatgtgcgtacgtgatgct

SEQ ID NO: 46449 - DNA, 377 bp, Zea mays
  Clone ID: LIB3066-033-Q1-E1-B5
gttggaactttgggctgatttatgtgcttgcaaaaactagaaccgaaaatggcccgaccaccgcccccgcccgaaaacatacgacacttggccccaccgatatctgctagatcgtctcctaccttttgccgtcgtaccagggtacgtttttgctacgcagtagcacccgactcgtcctcgtcctacgggcttatacttcggcactcccaccttacaacgacacacacaccaaccaataaatcaaaatacgcacccaccccaggggcccgctgattggacgagtccgtctcggtcggcgtacggacggaagaagtgggactagtcgatgttgctgaatccgtcgtctactagagataaggctgtgtctggtagtattt

SEQ ID NO: 46450 - DNA, 386 bp, Zea mays
  Clone ID: LIB3066-033-Q1-E1-B7
tggaacctttgggctgatttatgtgcttgtttatgtgcttgtggatgtgcgggtgactatgataagacggtacgtataaataacgtgaggagagttccgccttcttcggcttctcctcgtactgcgtacggcgagaaggaagagctaaagggtactgacgtgaaagtgcttgggttcggcgggcttcctgatactattaagccgggtgttcttggtaacggtaagatagatagtatgaaggtcgcgtaggaagtacgggtactggtgcgtggtggtatcgggaagtagataacttctacatttaagggtgatccttccgctggataatctaatcctataggtttccgtaagggtgatgcgattacctaggcggacggtaactcgtc

SEQ ID NO: 46451 - DNA, 383 bp, Zea mays
  Clone ID: LIB3066-033-Q1-E1-B8
tggaacctttgggctgatttatgtgcttgtttatgtgcttgaattaccgccggatgtgccttttcttcgtatgtaattctactcggctggttagacttaggacggttgcttcttccgagattccgttcttttgagcgtctctggcgagtcatcccgccctgacccactaggaaacttgcccgtcctacgccgcgtaggtctacactcgaccgtcggacctggtaaatttgtgccggacttcgcactggccagcttccgttcgtaaggcctccgccgccccgccccggcggctgagtactgtacgcctcgtcctcggacttagactcggagaaactgtgaagctgctgctgcctggcctggagtggactcgaggtgatgacaga

SEQ ID NO: 46452 - DNA, 379 bp, Zea mays
  Clone ID: LIB3066-033-Q1-E1-B9
tggaacctttgggctgatttatgtgcttgttagagggtgttgttgtacgcttatgtggttttaaggaaggcggtggtggggtgaggggggctcgtcccggctgtgctcgtttggactcagctgggccttaggaggcgggggtgatgcgcgcggggtggtgatttcctgttggtgtggtctggttctggtggtacttcggtggtagcgagtgtggtgcctgcacgctatccttgggtgccgtgggcttcggtcgggcgcttgtgtagtaagggggtacgtggttggttgcgggctgtacgtgtgaagaaggcgtcgctcggtgttttagggtagggagtggtgttgtgtgcggaggctcggaactcggcgtgtgcggggc

SEQ ID NO: 46453 - DNA, 416 bp, Zea mays
  Clone ID: LIB3066-033-Q1-E1-C1
gcgctggtaagttgttgatgatccgatgcggggtgggggaaataaaataatgtgggtagtgttatggtaagtgtgctttcgttatggtgtggatatagagagcggaaattggaaggggggaagagagacggaccttcttattctggtggtggtggtaggggaggtggttgcgttgttggaggatgatgctcgtcttgctcgttatgattgtccttggactttgcgttaggtgaatcgtctttaccggcctcgcggagagcgtactacttgtgcccggaaccacggattcttcgcataggtccgtaagcgctttacccgctgttgttccacaaactcatcggcgttcgtcgtaccactagggtaggaggacggcttataagtctaatgcacctcaggagagacctagtatcacaatc

SEQ ID NO: 46454 - DNA, 467 bp, Zea mays
  Clone ID: LIB3066-033-Q1-E1-C10
ggcttggaacctttgggctgatttatgtgcttgtttatgtgcttgtttatgtgcttgcgtacaagggatcacaaggcgttacgacaactgaggaatccgctattaggatccgtaaatataataatcaaaccgaataatagtttaagttgcaaagtgcccctagcctaggacaagtctcggctaacccacgtcgttggtaatatcgcattaacattaccctccaaggtaaccgataccctattatcagtctcagcactagaaaacgaactaggaaacggttcggtcgggctaagcataaacgacgtcccggaggtagccagggagtcgcctagcggcgacgggtaggtaaagaaaggatggaaagggtaaaatgaagctttctccttcttgggcgcgtactataggtcgacgataagttttataccgacgaattcggtttaagtctcagtccactataaaatgcgtca

SEQ ID NO: 46455 - DNA, 464 bp, Zea mays
  Clone ID: LIB3066-033-Q1-E1-C12
tggaacctttgggctgatttatgtgcttgtctggatggatggcttgttgggtggtcgtgttgtcaggcaagcaggcagtcagaggggcgtgttaattatgatgcagtatacgtaacggtatctgtggttgcggtgtcgttgctgcttctgactgctggttcggcgctcagtcgtatggaattgtagttacgtagatgactctgattgcatgttgcgcgcagttggttttggttattgtttatcgtcgttaatcgtttagcgacgatgatttggttacgcttgttgcatgtatggcttcgttctctgactgcatgttgcgagtaataggagcctcgcttggtgtcggaggctggcttccgcttcggtcagagtcagtttgtttgttggctatatggactggactctcttacttatctttagtcgcaacccgcccttgtcgtacccaaccggcccggacccgaaaa

SEQ ID NO: 46456 - DNA, 391 bp, Zea mays
  unsure at all n locations
  Clone ID: LIB3066-033-Q1-E1-C2
acccaaaccgcaccccaacaagcaaaagaagctaggggagtaccaaagtcacgcccacattgcgcactaacggctaagaaggccttaccggaataaccaccacccaccctaagtcaccctggtctccctccaactcctaaaaagaaacgaaccttgcaacggcaatatgaaaaaagaaaaaaaaaggaagcgcggaaaaaacgataagaagacaccggaatactaacccgaaagagacgacagaagtgggagcctaccccggctacggcaccaagaaacggaactttaaaacggttttccatactctggtaaagtgcaaaggcatctacaccacaaactccgtcagaatagtctgccccccactagaagtcngcgacccagcccccgacgt

SEQ ID NO: 46457 - DNA, 420 bp, Zea mays
  unsure at all n locations
  Clone ID: LIB3066-033-Q1-E1-C3
tgcgggtcaccccttcttcctatcgtattgtccgagcccgtctcatacgggaataaacgacacgtaaacatcgcccttacacgtcatcgtatccaagaagccagattcctagcccataccttcccttatagaggactaccgctagacagcctaatgtcgtcttaactcggaaattccagaggcgagggacgctacaggggactgcggatcataagccgccgtatagattcgtaagaaaccgtacaggtctagagcagagagaggagacgacgactaaggaggctccgaggacgaataaggcaggaccctataggcggggccgacggtcacagtttaaggtcgtttcgagccgatacatcgggtgacatacgcactagataccataaacgtagtcccagaggtagncggcatacgtagtaa

SEQ ID NO: 46458 - DNA, 454 bp, Zea mays
  Clone ID: LIB3066-033-Q1-E1-C4
tggcttggaacctttgggctggtttaagttgcttgcccccccgatattctccattcctaaatcttgaaggctcaaaggactgacaggttatgtccggatggcctgcacctgcatcggaaactagaactaaatgagtccccatttccccgccttatatgagaccctcgcctctgccgagtctactccaagatattcgtgccactccccaatagacgcgttgttttagttaaatcttttattcgataacgctccttgtttggactggtttggtgaggttgggttccggagttaaaaggaggggtggcgttttgtccttgatttatggaacaagcaaaacaatgccaaaagcagcggcaccctatccgtgtttggaggtctttatccacttcatattctctaagctaccctataaagctggatcagagctaagtctaatagggctcctcccttttgt

SEQ ID NO: 46459 - DNA, 434 bp, Zea mays
  unsure at all n locations
  Clone ID: LIB3066-033-Q1-E1-C5
cttgttaatttgcttggcgaatggcaagtcaagtgaggagttcgggccggcgaatgtaagtttggcttaaaaggggcggaccactaaagctaagtctagtgacctangtgagtctagcctgtctacggacggcgataagcatctgaaacctcgtgaggaagaagatggctaccgaagaaactagagggctcctcgaatattaaggattcgcgctctaagtctcactagcgtccctcggctcggagattcgtcgcgataaacccaaaccggtaaggcctaccgtacggaacaaaccagccaggacccgtttcaccttattaaggtccgggaaacttgagtccgcgccgcgagcggtgcggctaagcccgaccactctcccccagccgcaactctgcgacccttcctccccccccaaaaaaaaacccactcccccg

SEQ ID NO: 46460 - DNA, 391 bp, Zea mays
  Clone ID: LIB3066-033-Q1-E1-B10
ggttggaacctttgggctgatttatgtgcttggtgtattgttcttttgcgcttttctccctctgtttggtattgctgagtctggtcgggaggtagaataaatttacgagttacggtgaatctggtgctggggacggttgcgagtgatgagcgtaagtctaagccttaggagtctaagctgaagtgaagtccttggcctactatgcctaagactaatgagtagatgtagtaggcggcggcggataggtcggggtagttgggtgatattcatgatgatcctattggtcttacgtttgagagtgagcgttgtcatgttgctcctgatcctgatcctattattgatgagaatcgttagaagagtaagactccgcctactcttcggcctttggata

SEQ ID NO: 46461 - DNA, 378 bp, Zea mays
  Clone ID: LIB3066-031-Q1-K1-E7
cccacgcgtccgcccacgcgtccgcgccggacgcgccccgatccagatccaggggcgtaacatggcatcaaaacgtatcctcaaggaattaaaggacctgcaaaaggaccctccaacgtcatgcagtgctggtcctgctggtgaggatatgttccactggcaggcaaccatcatgggtcctcctgatagtccatatgctggaggtgttttcttagtgaacattcatttccccccggactaccctttcaagcctccaaaggtatcttttaagacgaaggtcttccatccaaacatcaatagtaatggaagcatatgtctcgacattcttaaggagcaatggagccctgctttgacaatctctaaggttttgctttctat

SEQ ID NO: 46462 - DNA, 53 bp, Zea mays
  Clone ID: LIB3066-031-Q1-K1-E8
tgcacgcctggcctgggctggccgtctccgtccaccgtacgtcctccaccgcg

SEQ ID NO: 46463 - DNA, 433 bp, Zea mays
  Clone ID: LIB3066-031-Q1-K1-E9
cttaagaagacgatgttcggcgtccgcatcttggcgtacgaggacgccgcctccgtgctcggcgtctgcaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctgcaccccggaggccgttagcctgctctgcactgccaaggtcccatgcaccggcgtcaccatggatgacgtcaacgtcgagtatagcggcaccaacaacaagaccatggctatatgcaccaacgccaaaggcagcaccaaagggtgcgctaaggggcttgcatgcttctagacccttcatcgactgacccatctctttaggtataatttttctc

SEQ ID NO: 46464 - DNA, 414 bp, Zea mays
  unsure at all n locations
  Clone ID: LIB3066-031-Q1-K1-F1
cccacgcgtccgcggaaaaggggccagcggtaccgtaccagtcgtccagttacctgacgcagcagctcagcagcaacatggcgcagagaaccgccgccgccgcctcctcttctgcgtcaggctacggcgttcagagaccccctggtctaagtctaacaacagcccagacgaaattcacgtcgctccggccgttgccgccttcggtcgtcccttcccatgcctacggcgcgccgnctcacggacccgtcaccgtctttcacccgtcagctcctcccgtgccgtatccagcgagcaattctggcggtcctggcagcagcgacgcggtgttggagatcgagagcgtgaggtggagcgtggtgggatcgaagcctgagggctcggagcgtctgaggagctgcaaaagggcagcagaga

SEQ ID NO: 46465 - DNA, 336 bp, Zea mays
  unsure at all n locations
  Clone ID: LIB3066-031-Q1-K1-F10
ccgaggccaccgccgacggcctgctcatcatcacgttccgcggcctcgagggcgtcttcgtggacgggtacgctgcggcgctcggaaggaagacgacggcgacgtgttgggccgtcggcccgacgtgcgcctnctcctccggtggcctggacgcgggcgcgaacggccgccgcggcaaccgcgccgacgtcgacgtcggcctcctcctgtcgtggctcgacgcctcgccggcggcgtccgtgctgtacgtcagcttcggcagcctcgcgcagctgtcgctgaagcagaccgtcgagctctgcccgggccttgnagggttccggccggccgttcgtc

SEQ ID NO: 46466 - DNA, 409 bp, Zea mays
  unsure at all n locations
  Clone ID: LIB3066-031-Q1-K1-F12
gatcaatcttcctcgttccgccgctccctcttctccggcagcgaggtgaggccaccgatcggaccttccctagcggcggcgcctaccaacctcaaggagcgatggctctgtctgcgacgctacggatttctcttagcgtcgcgttctttggggttctggcgttcgtgcttggtgtcatcgccgaaaacaaaaagcctgcttccgggactcctatcctaggaaaggatgtcgtcatctgcacgtttccaagtgatccgactcttgcgatggggagcctgtccattgtggcacttgtggtagctgccatcgtangccatgttgccatcttctttccatacttgngcaaagtcagttcctcgtggagcgctgtttcaaagcaccagcttgataagtgtctttggtggtgctg

SEQ ID NO: 46467 - DNA, 457 bp, Zea mays
  unsure at all n locations
  Clone ID: LIB3066-031-Q1-K1-F2
ggccaacgagttcttcctgcagatgctgtgcgagcgccggcccgggcgctttgtccagatgatggactccatcgccgacctgggactggaggtcaccaacgtcaacgtcacctcccacgagagcctcgtcctcaacgtcttccgcgccgccaggcgggacaatgaggtggcagtgcaggcggacagactgagggactcgctgctggaggtgatgcgggagccgtacggcgtatggtcgtcgtcggcgccgcccgtggggatgagcggcagcggcatcgccgacgtgaagcatgacagcgtggacatgaagctcgatggcatcatcgacgggcaggcggcaccgagcgtcgcagtgggggtttcagaggatcactacggcggctacaaccatctnctccaatacctcgcttgatcattatttaattgcgttcggtcatgttgaaagttcgatcaaact

SEQ ID NO: 46468 - DNA, 226 bp, Zea mays
  Clone ID: LIB3066-031-Q1-K1-F3
aaaaaaacaagaaaaaaaaaaaaaaaaaaatttcaatttcaaataaaaaaactacaaaaaaggggactgtataaaatacatacagacaataaaagtccggcgctgtcgctctttacacctcacgtttacctacatctgattccaacgctttatcctttctctaccttaacctaattcaattttactatcccgacaattacaacactttgcatattcttaacctttc

SEQ ID NO: 46469 - DNA, 445 bp, Zea mays
  Clone ID: LIB3066-031-Q1-K1-F4
ctaattaaacaatgagcaatttcttgtttatcatgcaaagaaaacatgttttgcacggtatagatgtactggaggcatgcaaattctataatgttttgagaggtcaaattttacatattgagttgtggacttggacatttgacaaaaaagagtgaggaaagaagtgcgcttcagttattaacttgttagtatggctggacatctctcttgagtggatgcacctaatacactgcaaaatatgtttttaacaaaaagtttgtttgaccttgtcctgacccatgaccttacatattgccgttcaagtaatcccagcaacaggtttaacaaccgtggtggtttccaagctggtcgaagccgtggccagttccagagctgggggagaggccgtggtcagttccagagccgggggagaggccgtgcccagttccaaggacgaaggagaggc

SEQ ID NO: 46470 - DNA, 420 bp, Zea mays
  Clone ID: LIB3066-031-Q1-K1-F9
ccaaaacccgcatccataaacaagaaaaagttaagaaaacccccgctgccagcgacagaagaggaaggggtcccttctccttggttgcgttgcgcctccctcctgtctgcgtgcgtgcaatcgacgcagaggcgcgggcgctcgcaccaccacaaccacgacccgatggctttcatgcgctcccgctcaaatgcatcttctggcatgggagttgctcctaacattagggagacattcgtcgagcttcaaatgaagaaggcatttccgatatgttatcttcaaaatcgaagagaaagcaaagcaggtggttgtggaaaaaacaagggctactactgaaagcctttatgaatttttgggcctttttccagagaatgacttgcgatacgcgctggattgatttgaattttgtactggggaaaa

SEQ ID NO: 46471 - DNA, 316 bp, Zea mays
  Clone ID: LIB3066-031-Q1-K1-G1
acaaagcctagaagcaattcgacaactagttttaactattgtgattcatcggagcctgatcgggtgattcgaattgcaatggtggactaatgacgacggcattcaattatctgcagaagctctacgccttgagagtgagaaggattacccttacactgggagtgatgacatatgcaagtttgacaagtccatgaatgctgcttcacttcagaactcctgcgttgcgtctgttgactaggctcaaactactgctaacctgatcaaacatgggccataggcaataggcatcaatgctgtctacatgcaaacatacatt

SEQ ID NO: 46472 - DNA, 390 bp, Zea mays
  Clone ID: LIB3066-031-Q1-K1-G10
cgctcgcccccctttcctccacctatcttcttcagacgaccagcaggaggtacgagcaagagcacctaggaggcctctctctccctctccccagccacccccgtagcgagagggagggcggaagaggatgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaacactgtcaacctcggcctctgggacactgcaagtcaagaagattacaacagactgggaaccctgagctatcgtggagctgatgtttttcttctggctttctcactgat

SEQ ID NO: 46473 - DNA, 381 bp, Zea mays
  Clone ID: LIB3066-031-Q1-K1-G11
cacgaacgtcggcgcggccagctcgacgtacaccgtggaggtgaacgtgccggcgtcggtgacagtggaggtgaacccgccgaagctgactttcaaggcgctggaagaggtcctgaactactctgtcacaatcaagtcggccaacggccaggcgcttaccggccctgtcgagggggagctcaagtggttgtccggcaagtacgtcgtgcgcagcccgatcctcgtcactaacgaatccgggccctcgccggcggagacacgtaaaccgtaaccctcgatagcagctggcaaatgcctacttattacgtacatggtaacgattagtttgccatatgagccagcgcttgaaatcgatgggattgtgagcttcattcacttttg

SEQ ID NO: 46474 - DNA, 419 bp, Zea mays
  Clone ID: LIB3066-031-Q1-K1-G12
cccacgcgtccgcccacgcgtccgcccacgcgtccggcaaagggccatccgctgcggtcagagtacgtttctgaatcatagcttggcgatgcctgaggctagacaaatactgagctagccttcagaaaaaaaaagaatagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaataagcaaggtttagagaagatgcaacatgggcacaaagatgaaaaaagggatcctgaaaccgttccgctatatctcaaccatcatggatggtaaagacgcttgaatgcaaaatgg

SEQ ID NO: 46475 - DNA, 470 bp, Zea mays
  Clone ID: LIB3066-031-Q1-K1-E6
gtcgtcgacagcctcgccaactcctccgagctcgtgatccgccgcctgcgctcgctcgcggtggaacacgccaaaaacctcgcgttccacaaggttgatatccgtgacaaagatggattggaaaaggtttttgcttcaacaagatttgatgctgttattcattttgctggactgaaagctgttggagaaagtgtacaaaagcctttgctttattatgaccataatgttgttggcacaataaatcttctggaagtaatggcagctcatggatgtaagaagttagtgttctcatcatcagctgcagtttatgggtcacctaagaactcaccctgcactgaagattttcctctcactccacataacccatatggcagaaccaaacttatggcagaggagatatgccgtgatatctaccattcagatcctgaatggaatatcattttgcttaggtactttaatccagttggggc

SEQ ID NO: 46476 - DNA, 364 bp, Zea mays
  unsure at all n locations
  Clone ID: LIB3066-031-Q1-K1-D1
atggcatccacatgggcgactcatccgggatcacgatcaccaacaccgtcattggcgtcggtgacgactgcatctgcatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctncgtgctcaccgtctacaagatccactacgagaatatcaagatggaggactcagccaaccccatcttcatcgacatgaagtactgccccaacaagttgtgtac

SEQ ID NO: 46477 - DNA, 425 bp, Zea mays
  unsure at all n locations
  Clone ID: LIB3066-031-Q1-K1-D11
cggacgcgtgggcggacgcgtgggcgaagccggagaatgaagagctagcctatcaaccatgcatggaagtagcaatggcacctgaatcagctacaaaccatgatccaatcctagcggctagcgatctctagtttatattacaattaggagcaagcgatccaattatcgatagagcgcgagatcgatcgatcatgccgggccgctcggtggtctccatcctcctcctcctcctccatggcctcctctgcctgcagctggctgccttggccgagatggacgacgacgacgtcatggaagacggcagctgcatgcatttcagtgtgtccccgccgnctgctccggcggaggacgcggatgagcggcgcgactatttccgcgccatgcaagccaaagatctgttccggcacgagcagatgatcacgatg

SEQ ID NO: 46478 - DNA, 383 bp, Zea mays
  Clone ID: LIB3066-031-Q1-K1-D2
cggacgcgtgggctcctccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgtcgtcaaggacgtcgtgaaggatgcggcggcggccggcgaggtgatgacgcccgccgacgccgagaagcctatctctgtcgaccccaaagcagacgccatcgtggtgatggacgccaagaaagaggagggcaacaacaaggtggccgtggaggaagatct

SEQ ID NO: 46479 - DNA, 435 bp, Zea mays
  unsure at all n locations
  Clone ID: LIB3066-031-Q1-K1-D3
cccacgcgtccgcccacgcgtccggccccatacacacaaaagcaaaaagcatcatcacaatgatggcgcgcgcgtgtgtgttcctcgtggtgctcctnctggccgccgtcgcggtggcgccgtttgcgagggctgcgcgtgtggatgtcgtggagggcaggtccatggcgtccgccgacgcgcctgatgcggcggctgacgcgcccgctcacggtcccgactccgcctcatccgcggactcgccgtcagaggcgccctccagcagcagctcatccgactagccgcgcacaacgcagttcttgtcatgatctatctagcagataaaaagatcatatgtctcgtttgattctctggaataactaatagtatatatgctgcgccctgatgatatataaatatgtgcatcanatgcgtgcggcaaacgcatggaatgtg

SEQ ID NO: 46480 - DNA, 437 bp, Zea mays
  Clone ID: LIB3066-031-Q1-K1-D4
agagcgttcccccgcggctcctccacggcaagagctcgcgtgcgtacggctccatctgggagtccaccgtcaggaacgtcaagttcgtgtcggacaagacggtgaagccggtgtacattatcacccccaccgaggccgcgcacatccaggccaccgtggcgtgcgggcgcaagcacgggctgcgggtccgcgtgcggagcggcgggcacgactacgagggcctgtcgtaccggtccgccaagccggagacgttcgccgtggtggacctgtccatgatgcggcaggtgcgcatcgacggcaaggccgccacggcgtgggtggactccggcgcgcagctcggcgagctctactacgccgtggcgaagatgacccccagccttcggttcccggcgggcgtgtgcgccacgatcggcgtcgggggccacttcaacgggggc

SEQ ID NO: 46481 - DNA, 180 bp, Zea mays
  Clone ID: LIB3066-031-Q1-K1-D5
acgccacgcgtcacgtcttcctgtccctctccgatccattctccagggcagctaactatgcatgtgtgaccgtgcaaagatgtcgtggcacgcgtacttggacgagcaccctgatgtgccagatccaggggcaccacctctcggcggcgggcatcgtaggtcacaaccgtgccgcctggg

SEQ ID NO: 46482 - DNA, 465 bp, Zea mays
  Clone ID: LIB3066-031-Q1-K1-D6
cacgcccagcttagctcagctcaggtagctatagttagctagagagctggacgacccccgggcgacctcagatagatttttaatggaggcgccagcagcgccacctccgtcgtacgacggcggcggcggctacgtcctcgtcgacctgtccctgacgctgggcccgaccgcgacgccacaccctgccgcctcctcctctcctgagcctgaccacacaccagccgccgccgccgccggttccagttccgccggcgtgcggctgttcccgtgcctcttctgcaacaagaagttcctcaagtcgcaagcgctcggcggccaccagaacgcgcacaagaaggagaggagcgtggggtggaacgcccacctctacctcccgccgccggccgcggacacggcgtcggcgtcggtcgccggcgccgacgtcgctcgtgccgcgacgacgcccgtcggcagcagccacgcgct

SEQ ID NO: 46483 - DNA, 407 bp, Zea mays
  Clone ID: LIB3066-031-Q1-K1-D7
cccacgcgtccgtctccctctccctctccgatccattctacagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttgcccgagttcaagaccgaggacatggccaacatcatgaaggacttcgacgagccagggcacctcgcgccgacaggcctgttactcggacctaccaagtacatggtcatccaaggcgagcctggtgccgtcatccgtggcaagaagggatcaggatgcatcaccgtgaagaagacagggcaggcactcgtcgttggcatctacgacgagccgatga

SEQ ID NO: 46484 - DNA, 435 bp, Zea mays
  Clone ID: LIB3066-031-Q1-K1-D8
gccacgggcatcgtgctagggacctacatggcgctcgccacggcgctcttcttctacctggcgcacgacaccgacttcttcaccaacgccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggtggcgccatctgggcgttcagcgtcgtcacctacttcccgctggacgtgctcaagttcgccatccgctacgcgctctccggcaaggcctggaacaacatcaacaac

SEQ ID NO: 46485 - DNA, 382 bp, Zea mays
  Clone ID: LIB3066-031-Q1-K1-D9
gatcaccggacgtcgagcgagcagtctccctattccacccaataactaataacatctccggggacgcggggttccttggaccactatatccaggagcgacgaagtgatccacccgccagccatggagatgaagaatgtcctctgcgccgccctcgtcgccgccgcctctgccaccgccgtgctggcctcggtcgcctccgaggcgccctccgaggcgcccgccggcgcggacggtggtgcggctggccctagcgcaagcggcgccgacgacgccgacgtgcccgccgtcggggcgctcgtcgcctgcttcctcgcctactaccttcactgaacgacgacacgcggtgcgggaaacctttggatgcatcgagtttggttcatt

SEQ ID NO: 46486 - DNA, 282 bp, Zea mays
  Clone ID: LIB3066-031-Q1-K1-E1
cccacgcgtccgcccacgcgtccgagcccgtccttggcagtgccatggttgcaaaattctgctcgcggtctcgcatggcacgagctgcagaaaaccgattaaaaaaaccaaaaaacacacccgtaaagtaattaaaccaaacacgcgctgccaccgaccgatcaggcgaccccgctccaagaggaaatccaccaccgcggccggggcctcccagatctcgctggaggcagcggcagcggcggcggtggggggcgatggcgctcaacatgaagaccctgacgc

SEQ ID NO: 46487 - DNA, 300 bp, Zea mays
  unsure at all n locations
  Clone ID: LIB3066-031-Q1-K1-E10
cccacgccgtccggcggcgtgcgctggtggtgtcgtgngactcgacctgtgcccancccaaggacagagtggtgcaaggccgccgcaggagcacttcgacctcagcatgcccgcgttcctccagatcgcgcaggagaaggccggcatcgtgcccatctcctatcgcagggtggcatgcgcaaagcagggcggcatccggtacaccatcaccgggaacaagtacttcaacatggtgacgatcaccaacgtgggcggcgccggcgacatcgcggcggtgtcggtgaaggggagcaagcgcgt

SEQ ID NO: 46488 - DNA, 347 bp, Zea mays
  Clone ID: LIB3066-031-Q1-K1-E11
gtctggtacacctccagcttcaagttggaggtggacgacatgccgatccgccgcgacatcgagacggtgctcgaggtcaacagccacgggcacgccagcgtggcgtttgtgaacaccaaattcgtaggatgtgggcacgggaccaagatgaacaaggcgttcacgctcgagaagcccatggacctgaaaaagggcgtgaaccacgtcgccgtcttggcgtcgacgatgggaatgatggacagtggcgcttacctggagcaccgtctggccggcgtcgacagggtgcagatcaagggcctcaacgcgggcacgctggacctgacgaataacggcttgggccacatcgt

SEQ ID NO: 46489 - DNA, 433 bp, Zea mays
  unsure at all n locations
  Clone ID: LIB3066-031-Q1-K1-E2
cggacccggcggcggcgctggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggcgacatgtacatctacagccggcacttcaacccgacggtgctggcgctggggcggcagatggcggcgctggagggcacggaggcgggctactgcacggcgtccgggatgtccgccatctcgtccgtgctgatgcagctggtgggcgccggcggccacgtggtggcgtcgcggtgcctgtacggcgggacacacgcgctgctggcccggttcctgccgcgcgcctncggggtgcgcgccaccttcgtggacgccgacgacgaggccgacgtgcgcgccgcggt

SEQ ID NO: 46490 - DNA, 314 bp, Zea mays
  Clone ID: LIB3066-031-Q1-K1-E4
accatacgtcctctacccctcgcctgggttcaaactctccccagcccgggctgcctacgagaggctattcatgaccctcaacgcccgcctttcctcctagctcccacatttattgcagatccaacccattgagcctcaccttaattcacctctccaacatgacagtcaacaccaatatcaaactaccactccgcatggcgcccacttaatcccttccacggaacgccagctaactaccctacccaccttcaccgctcaacttcaacaccgcgcaccaccccatctacgagcccaccacacccatgatgtcctta

SEQ ID NO: 46491 - DNA, 252 bp, Zea mays
  Clone ID: LIB3066-031-Q1-K1-C9
tcgggaccttcatactcataaacacattccatactttgagatacaaaatctgactggaacaacacgttatggtaatattaatacttatcttggaatataacaaagcatgatagatgatctggagtctgttggctatcttctgctatattttataagaagaatggccttaaagctggcactaagaaacaaaagtattataaaattagtgaaaagaaaatgcttacctcggcagatattctgtgcaaatcttac

SEQ ID NO: 46492 - DNA, 466 bp, Zea mays
  Clone ID: LIB3066-031-Q1-K1-E5
gggacgtttggccaatcaagatcaggatcatgaggtaaaagaatgcgccatatcttgcatgagtttggtggtctctacttttggtgatggtcttgaaagagaattaccagcatgccttcccatactcgttgacaggatgggtaatgaaattacaagacttacagctgtcaaggcattttcagttattgcgaattcacctctacgtattgatctctcgtgtgtcctggatcatgttgtttctgagctcacagctttccttcgcaaggccaacagagctcttacgcaggcgacgttgggaactctaaattctatggttgtcacatatggtggtcagattggctcttcttcgtatgagacaataatcgcggaactttcaaccctcataagcgacatggatttgcatatgaccgctcttgcattggaactttgttgcacaataatggttgacagaaaatctattcaaaac

SEQ ID NO: 46493 - DNA, 386 bp, Zea mays
  Clone ID: LIB3066-031-Q1-K1-B3
cctttttcttgtggtggcaacatcatcatcagtgtgggttgcagaaggagccgatgacttagaagtgtcttgcgttaaagagtgcacccaaaattttaacactcccgagggcaagaagatctgtgaaacgatgtgtgccaaccctaaaggaaggcctatcgacagagttagagctgattgatcaatgctcatctttatttgtagctagctatcatgcatgcgatgatggccttcttgattattattatttcattcctcatgttgtttgttcttgcatgttttttccaccactaatattgtcctaattgatgcatacaagttgtcactcaaagcattttctatgctttacttattggttaaataaatacaaaggctttcttttacct

SEQ ID NO: 46494 - DNA, 394 bp, Zea mays
  Clone ID: LIB3066-031-Q1-K1-B4
gttctagatcgcgagcgccgccctttttttttttttttctcatatataggttaccttttgggagttgcagtaggttagcagagttttgagcttcaaaacactccatctgatatcataaaaccacctgtctttgatatcaatatacctctcggcaaccaaaccaaatcgagaaaatgggtttcaggacaccgatcttccatagcagatggaagctaggtacaggttcttggaccatttgtccttcacatgctggctaggaaacgcagatgttctcagggtctcctgtgtttcatcactaggctttctccttggaatgctcaagataaaggctgcctggtcccatgtggcaaccgttgccgtgatgcgatagccattgtcccaacgcatgtggatg

SEQ ID NO: 46495 - DNA, 396 bp, Zea mays
  Clone ID: LIB3066-031-Q1-K1-B5
acggcgtcctctacttctgctataagttcaccgaggtccccgccgtctcttgtgtctcggaaccggaaagcaaacaagtccagtacgccaagaagtacgtgcaggactccaagaacacgacggacaagactatggtgccgcccaccgtgtacccaccgccgcaggccatggcgtccgcatacccgccgcaacaatattgttcgccgtacgcggcgtacccgcggcagccttacgggtaccctgctccgccaccgtacgggtacaatgctgcttccccacaaccggcgatgtacaactacgcagcacagccggtagctgcaccggcgaggcatggcggaggtatggggatggggctcggcctaaggctcctaggcggtgcggtcggggggatgatgc

SEQ ID NO: 46496 - DNA, 404 bp, Zea mays
  unsure at all n locations
  Clone ID: LIB3066-031-Q1-K1-B6
aagtcagaggagagcctaggggttagcaaccaaaacatgcccagcagggcgctgacgttcagtcagctgagcgccgcaacggacgggttcagttcgcagaacctgctcggagaaggcggctttggacgggtgtacaaagggctcctcgaggacaccggagaggttatcgccgtgaagcagctgaacagggacgggctccagggcaacggcgagttcctcgtcgaggtgctgatgctcagcctcctgcaccacccgaacctcgtcaagctgctgggctacagcaccgactccaaccagcggatcctggtctacgagtacatgcccaggggctcgctggaggaccatctnctggacttgccccgagctgaaagccctgccgtgcacacgcngatgcngatcgcggt

SEQ ID NO: 46497 - DNA, 422 bp, Zea mays
  Clone ID: LIB3066-031-Q1-K1-B7
ccgatccatcttgggcgggcgccgcgcgtctagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggccgccgcctcctcagcgctgcgaaagcgacctcaacatcagggagcaccgctcctgcagcgaggtggccggcggcaccgcggcgggctgcgccgctgtgtgctgctgcttccctgcgtcatggtg

SEQ ID NO: 46498 - DNA, 372 bp, Zea mays
  unsure at all n locations
  Clone ID: LIB3066-031-Q1-K1-B8
gtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaaggactacgtggtcaaggcggctgaggtcaccaaggcctgcaacaccacctgcgccaaggagaagcagcctctgctcagcgagaactgcangaggtcctgcaccccttcttcttcctgaacgcagagcacngcccgccgtcgtcgtctt

SEQ ID NO: 46499 - DNA, 390 bp, Zea mays
  unsure at all n locations
  Clone ID: LIB3066-031-Q1-K1-B9
cggacgcgtgggcggacgcgtgggcggacgcgtggggtcgctgctcgtcctgcctagctgacggtccggccagcatcacctcctgctcgcggcctcgcccagctccctccaccctccagtgagacgcagatctcctgctcgcggcctcgcccagctccctccaccctccggtgagacgcagatcttggtgcgacggggcactacggaggcagggtagtgcggttgtgcgtgtgttggtggcctggttctagcaaccgagaatgttcagagatgaattagagagagatggcatgcctaacattgaaagaacattgcgacaaggattccagactnggttcagaacccatatnctcagaatgcggaatataaatcaaggagaggctgatgatg

SEQ ID NO: 46500 - DNA, 339 bp, Zea mays
  unsure at all n locations
  Clone ID: LIB3066-031-Q1-K1-C1
ccgtccggaacgagaagcaatagcaaagcaccggaccggacgtgtacgggtctctgcacgccgggcccgtcgcgtcgcggtcncgcgcgcgccggacaccatcccgcggcaagtaatgagggccccccgggcccggcgccgcgtctctcgcccgcnncggcgcctggcgcgccctgctgctggcnncgcgacacttcctgnngcggccggccctggttgaccgacngnntcctcccttggggcgccgtnnacctgctgctncgccgcnntggccctggggtcgctgccnnngtgcctggccgnngcggtgacncnngcgccgnngcggggtccccgggt

SEQ ID NO: 46501 - DNA, 52 bp, Zea mays
  Clone ID: LIB3066-031-Q1-K1-C12
ccgtccgcccacgccgtgccgctgcctctcgacgcttggaatctatggcgat

SEQ ID NO: 46502 - DNA, 442 bp, Zea mays
  unsure at all n locations
  Clone ID: LIB3066-031-Q1-K1-C2
gcaagtacggctccaaggtcaccttccaccttgaaaaggggtgcggccccaactacctggcgttgctagtcaagtacgtcgacggcgacggtgacattgtggcggtggacgtcaaggaaaagggctccgacacgtacgagcccctcaagcactcctggggcgccatctggaggaaggacagcgacaaaccgcttaagggacccctcaccgtccgcctcactaccgagggaggcaccaagaccgtctacgacgatgtcatccctgccaactggaaggccaacaccgnctacaccgncaaataattaactttagtgctgacaatactttaagtcggcctatgctagctatactagattgggttggatcccaagcaatgcattacacatgcatgcattggaccgtgatatctatttgctaccactaccctattacgacagtgatg

SEQ ID NO: 46503 - DNA, 433 bp, Zea mays
  Clone ID: LIB3066-031-Q1-K1-C3
cccacgcgtccgcccacgcgtccggagacttatgtctcacatgaacaaactgatgacgagggcagcgggcagaccacctttagctacgaccgcttggtatcaaagtatactgacgctgtcaacgggatacgaccacaggctcacagagacatatttggtggacaatgagttcgagaccgagtttgtgatgaccaaagaggagttgtacgagcagtcaaggtgtaagcatgagttgcggaacaagaaagctgatcttttgtgaacttacacacacgggtaggtacgacacaaagccctcgcgttgcgcatcgacagctgtagtacagcaatctcaccatgctcggtataccgatgcgtgatcatcatgagctttatacgtgagttggatactctctatctgcacacgttttgagcgccttatatatattactat

SEQ ID NO: 46504 - DNA, 354 bp, Zea mays
  Clone ID: LIB3066-031-Q1-K1-C4
aggagctggtggactgggaacacaagagccaggagagtgggaaaatgcacgcttgcggacacgacgtgcacacgacaatgcttctgggggctgccagaatactccaggatcgcaagagcgacctaatgggcaccgtgaagcttgtattccagccggcagaggagggccagggcggcgcgtactacgtgctgcaagaaggcgttcttgacgacgcgtcggccatattcggcttgcacgttgacccggccctccccgtcggagtcgtttcgtccaggccagggcccttcgcggcgacgtccggcccgttcctggcgacggtcaccggcaaaggcgggcacgccgcgatgccccacg

SEQ ID NO: 46505 - DNA, 338 bp, Zea mays
  Clone ID: LIB3066-031-Q1-K1-C5
gcaatttgaataaaataattgtagcccttgttggatgttgtgtttaattttataagcaagggcggggagatcggtcttcaaagtctattttcgtcatgttgcacgtgtgatttgccaggaagacggggcgaattcgtggtgctacctaaaagagaccccatctggtgcggttctggggttcgaggagcggcgaggcaggtgggaaatgagggatgtggtcgtggttgacgaagattgcgtccgcgtgcttgggcccggtccggaggtgcgcgcgtacgaagaaggatgatgacgacagcgataatggccgcggcgtcgccgacgacctgctgtggtcg

SEQ ID NO: 46506 - DNA, 442 bp, Zea mays
  unsure at all n locations
  Clone ID: LIB3066-031-Q1-K1-C6
cccacgcgtccgcccacgcgtccgggattctctacagaattttttcctgtgctgtgggctagtcctcgcatgggtggctggctagcgcattggaaagagtcactcgatgatcctgacactaagattataaggccccaacaggtatacaccggcttctggcttaggcactatacccccgtcagagaacgagtgctatcaagccagagtgaggaacttggtcaggttgccacctcaaacgcaactaggcgccgccgtgctggttctgccctgtagaagctgcagcgtataaacgcaccggcatactcaataaacatcgaccactnttgtgcttgaaaaagccacaaatggcttttagcttgggtggagttgtaagccttttggtgtcgagtatataggcaataatgcagtgagaacaccacaccgttacaatgtaaaactgtca

SEQ ID NO: 46507 - DNA, 470 bp, Zea mays
  Clone ID: LIB3066-031-Q1-K1-C7
gagcgcacacacacacaaccagatctcccctaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatcccttcagaccagcagcggctcatctttgctgggaagcagcttgaagactggcgcacgcttgccgactacaaca

SEQ ID NO: 46508 - DNA, 467 bp, Zea mays
  Clone ID: LIB3066-031-Q1-K1-C8
cccacgcgtccgcgctccttcacttcctcgctggcccataaatatatatctatctatcgcgatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaggacaccatcggcg

SEQ ID NO: 46509 - DNA, 352 bp, Zea mays
  Clone ID: LIB3066-031-Q1-K1-B2
cccacgcgtccgcccacgcgtccgcccacgcgtccgcccacgcgtccgcggacgcgtgggatccaagagagaatgccgcagcacatctcaacagtcgccgcacgcgccgtccccgccgatctcgcgcaacagccgccgcacatgccaccccgccctcgcacccacggcatccgcgcccagatgttgcgggcggcgccgtccccgccgatcccgcgcaacagccgccgcacatgccagcctcggcctcgcgcccacgacatccgcgcccggctgttgcggccggcgccgtcctcgccgacccctcagatataaagtcactctggtgttcttcaagactacccgaagcgattca

SEQ ID NO: 46510 - DNA, 365 bp, Zea mays
  Clone ID: LIB3066-027-Q1-K1-F11
agatgatgctgcacactttcttgatgtcatccgtgctgccgaggaagctaatgtgtacaatgatttagtgaagtaccttctgatggtaaggcaaaaggcacgggaacccaaagtcgatggagaactcatctttgcatatgcaaagattgacaggctcagtgacattgaggaattcattcttatgccgaatgttgccaaccttcaaaatgttggtgaccgtctttttgaggaagaactatatgaagctgcaaagatcatctatgctttcatctcaaactgggctaagctggctgttaccctggttaagctgaagcagttccaaagtgctgtggatgctgctcgcaaggctaacagtgctaaaacat

SEQ ID NO: 46511 - DNA, 389 bp, Zea mays
  Clone ID: LIB3066-027-Q1-K1-F12
cccacgcgttcgagaaggcttcatcacatgctcgggccatgagctatacgtgctggagctgggacaactggtggtggacgtgctcacctgcgtgacagtccatcgcagaacgagcagcaagcggccactgatgcaggcgccccggagcacgtggtcatcatggatctatcggtagtgcttctgaacgtgtgctacgatgcagtgaccattgctgtgtacatctcccagggcaagctgcctagtgttcaacaccggaatgcttgagttacgcctgtgccttggcaattgcactgtgaccatgcgcagactgatacataagctctacggcgcgacatccactctgtacttcgacgagacgcaagtggccaatacgctgacgatgcgctctg

SEQ ID NO: 46512 - DNA, 260 bp, Zea mays
  Clone ID: LIB3066-027-Q1-K1-F3
aaaaggcttatcgactaatgaatacatccctttcttttggatccatgcttacgagcacgtacagacgggattaacatgtctagctgctaggatcctgagattacgacgacaggaattaatcttaaggtgtcattactatgtgtacccttgtactgcctgactaaatcgggatgttttacattacacttactgcagctttcgtgatagcaaagaggccctgttccaatcgcacttcccaacatatgcacaggctgaacggc

SEQ ID NO: 46513 - DNA, 481 bp, Zea mays
  Clone ID: LIB3066-027-Q1-K1-F4
cccgcgcgtccgcccacgcgtccggcgcgcggagcctcctcaacccttcagacctccgcctcccaccgcttccgtagcctcgcctcgcctcgcctcgcctcgtccttctcctccgtcccaaccatgagggagatcctgcacatccagggcgggcagtgcgggaaccagatcggtgccaagttctgggaggtgatctgcgacgagcacggcatcgaccacacgggcaagtacgccggcgactccgacctccagctcgagcgcatcaacgtctactacaatgaggccggcgggggccggttcgtcccgcgcgccgtgctcatggacctcgagcccggcaccatggactccgtgcgctccggcccctacggccagatcttccgccccgacaacttcgtcttcggccagtccggcgccggcaacaactgggccaagggccactacaccgagggcgccgagctcatcgactccgtgcttgacgtcg

SEQ ID NO: 46514 - DNA, 307 bp, Zea mays
  Clone ID: LIB3066-027-Q1-K1-F5
cccactcgtccgagattctacgcgtggacaaccttgtcatcaccggcaagggaaagctcgacgggcaggggccagccgtgtggagcaagaactcctgcgtcaagaagtacgactgcaagatccttcccaactcgctggtgatggacttcgtgaacaacggggaggtgtccgggatcacgctgctcaactccaagttcttccacatgaacatgtacaagtgcaaggacatgctgatcaaggacgtcaatgtgacggcgcccggtgacagccccaacacggactgcatccacatgggcgactcgtccgg

SEQ ID NO: 46515 - DNA, 328 bp, Zea mays
  Clone ID: LIB3066-027-Q1-K1-F6
gtcaggcaagcttccaaggatgacttggtagccagtgatggacatgagagtgataggttagccatgcagattagcgccagccggctggatcatgaccttctggctctagacatactactgcaagatactgcccaactcgctggtgatgagacgttcgagaacaacggagatgtgtcacgagataactctgatcaacttcaagctcatgcacatgaacatgtacgatgacgaggacatgctgatcaacgacgttaatgagacgactcacgatgacatgaacgatactgacgacattcacataggcgactaggctggtgtcacgatcacc

SEQ ID NO: 46516 - DNA, 475 bp, Zea mays
  Clone ID: LIB3066-027-Q1-K1-F8
cccacgcgtccgagcacctactcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgactgtggaggcgaagaagaacgccgaggaggccgggatggagaagctggcgcagcaaagctgatcgact

SEQ ID NO: 46517 - DNA, 359 bp, Zea mays
  Clone ID: LIB3066-027-Q1-K1-F9
cccacgcgtccgaaaaaaaaaaaaaaaaaaatacataaagacctacaactaacaacgataaggaggagctaaactcgactaacctcgacataaaccttatcgtccgtccctaccatgaatgaaatcctgcacatccatggcggtcagtgcgggatccagatcagggccaagttatggcaagtgatctgccacgagcatccaaattgaccacacgggcaaacacggcggtgactccgacctacagctcgggcgcataaacatctactacaatgaggcctactggcgcagaagccttccgcgcgccgcgctcatagaactcgagcactgcaacatgcacttggtacgctccctacactacg

SEQ ID NO: 46518 - DNA, 376 bp, Zea mays
  Clone ID: LIB3066-027-Q1-K1-G1
tcgcccacgcgttcgcgcttcttcttctttcattttcatatatagaccctaataggaccaagagcgtcgatgataacctggctaatttgggaatcaatccaattccaacccaaaggcaccgagcgtgatctccgtacgtgccgtcatggcctcgcaccgggcgctgctgctgctgctcctcgccgtcgcgctcgtcgctgcgctggccgctgtcgcatccgccgacgacgccaacgccaagcccaccatcctgacccccgtggcgcataccccgctggggtccttcgacggcgacaagccggcctctgacgacgacgccgtcgacgacgactaggacgccgtccctgtcggcgcgcccaacggtgccaccatgact

SEQ ID NO: 46519 - DNA, 64 bp, Zea mays
  Clone ID: LIB3066-027-Q1-K1-G10
tgcaatgcgagccttgttccttgtatcgctcttgtgcaccgagcatttcgagaaggccatgtca

SEQ ID NO: 46520 - DNA, 440 bp, Zea mays
  Clone ID: LIB3066-027-Q1-K1-G11
cataagcggaaataagcgattcaaatcactattctcccccatggaactacaatcccaaggatgggcggagcgggtaacccataaccaaagaggaggccatgaaagaactaattgaagtcgtcacgaagacaaagccggacaacttcactactcgcatagtagagaaaaaagatgattatatccgagttgaatatgagagtcctatatttgggtttgtagatgatgtggagttctggctcccttctggcaacaagaccatggttcagtatcggtcggcgtctcgatcaggatttatcgatatcaatgccaacaagaagagagtaaaggagctgagattggctttggaaaagaacggctgggcttcaaaaagcaacttctgaattgaagtgagaagtgtggaagacgtgcaagtgcatgctacttagacgagccagcacaac

SEQ ID NO: 46521 - DNA, 435 bp, Zea mays
  Clone ID: LIB3066-027-Q1-K1-G2
tcgcccactcgtctcggcctcgaggagggagacgaggccggcgacgttggagtggacgtacgccggcgggttctccatggcatagcgcacgtcggcctgcgccgcgaggtggagcacgtgggtgaagggcacgacgtcgaagagcttggccaggaggcggccgtcgttgatgtcgccctccacgacgaaactcgtcgtggctgcccagcagcgcgcgctgcgccttcttgagcgaggggtcgtagtaggagttgaagctgtcgatgccgacgacgccgactcccggatctggcgctcccagtgcaacccgccccaggacgcccggatctgtcgcgcccggtgctggtcatgtcccactccagcaaccgcctctaccagtcgcccgcgcaccccgtgctcgtcatgtcccgctccagcaaccggctggaccagtcc

SEQ ID NO: 46522 - DNA, 438 bp, Zea mays
  unsure at all n locations
  Clone ID: LIB3066-027-Q1-K1-G3
cggacgcgtgggcggacgcgtgggcaaggacatgctgatcaaggacgtgaccgtgacggcgcccggggacagccccaacacggatggcatccacatgggcgactcatccgggatcaccatcaccaacaccgtcattggcgtcggcgacgactgcatctccatcggccccgggacctccaaggtgaacatcaccggcgtgacctgtggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgtctncgtgctcaccgtctncaagatccactacgagaatatcaagatggaggactcagccaaccccatcttcatcgacatgaagtacttgcccaacaa

SEQ ID NO: 46523 - DNA, 438 bp, Zea mays
  unsure at all n locations
  Clone ID: LIB3066-027-Q1-K1-G4
agatgatgctgcacactttcttgatgtcatccgtgctgccgaggaagctaatgtgtacaatgatttagtgaagtaccttctgatgggtaaggcaaaaggcacggtaacccaaagtcgatggagaactcatctttgcatatgcaaagattgacaggctcagtgacattgaggaattcattcttatgccgaatgttgccaaccttcaaaatgttggtgaccgtctttttgaggaagaactatatgaagctgcaaagatcatctatgctttcatctcaaactgngctaagctggctgttaccctggttaagctgaagcagttccaaggtgctgtggatgctgctcgcaaggctaacagtgctaaaacatggaaggaggtttgctttgctttgtgtgacgctganngagtccgtcttgcacaaatatgtggtctcaatatta

SEQ ID NO: 46524 - DNA, 321 bp, Zea mays
  Clone ID: LIB3066-027-Q1-K1-G5
gcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagttgcagggc

SEQ ID NO: 46525 - DNA, 393 bp, Zea mays
  Clone ID: LIB3066-027-Q1-K1-F10
ggctgccgctgtcccacatgtatttgtatattttcttcatggtcgagatttgcaggtacctcgtggagtagaggaactgttcagctcgagcgagtatacgattgtaaactcgtgttaagttactgaagcgattcgataattggactttaggatcatcatgcatgtatctttagtgcatgagagcataggattccagcaaattcaaatttcttgcagctgcacctcacttttaactccaaaggtgtgctctgtgttgctttgaagtcacttgtaacttcttcatatcgtttgtccctaagcagactgtcaaagtgctcaaaaaaagttttattcaatggatgcatccaagttctaagagaagatcatggagtaacttggtggcaagatttaaaa

SEQ ID NO: 46526 - DNA, 445 bp, Zea mays
  unsure at all n locations
  Clone ID: LIB3066-027-Q1-K1-D4
tgaagagagaggaggcggcgaagaatcagcagcagcaggaccccttcctgacgcagctgcggagcccacggatggagagctggtggtctgcctactacgccagcgtcctcaacttctaaccaaaatccacacaatccaacagctttatatgtaaagcgaaggcccacgctcacagtcgtcggcccaactgatgcccgtgcgccgcgcgctgggccgcacggcccaagagctaccaagcgcgggcacgcaccgcggcagcccaaggatctctccaccttatctccctgctcgggactcgggacctttacctatcttcttcggtcttccatgggagcgagctagagagaaggcgccatggatcaacagcttctcgtggatgactccaatcatattaacgatatactaacttataatgtgccaaaaaaaaaaaaanaagtttataatt

SEQ ID NO: 46527 - DNA, 484 bp, Zea mays
  unsure at all n locations
  Clone ID: LIB3066-027-Q1-K1-D5
gggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatntatgacgaatgtcatgtatgttctggtgactgtcatgtatattctgatgactgtcatgtatcttggtcatgtatgctcaaggttcattatcttggtcatgtattaaagatggtatgaataactcaata

SEQ ID NO: 46528 - DNA, 379 bp, Zea mays
  Clone ID: LIB3066-027-Q1-K1-D6
ggcaataaatagttcgagaatccctgaagcgtgcatatatatattcctgccatgatgaagggaatggagtcgtcacgcaggttccagccggacgtcatcctgcttctcctgctcattgtgtccaccgatatggcacacgcaagggaatgcgagaagtacactgagcgatgtgttggggcatgcatgatcgcagactactgctcctatgtgcgcacgggtgaaggcttcttgagccgcacgtgcagcaccgttcgccgccgatgcatctgcactaagcagtgcttaacaagatcgctcgatcgctcgtcatgcatcgactacctagttatcataaccgtcattatctccctcttattcatgactaatggcatgtatgttc

SEQ ID NO: 46529 - DNA, 235 bp, Zea mays
  Clone ID: LIB3066-027-Q1-K1-D7
gcctgacgacatactgctcgtattcgacacggcgcccatgatcgtctgctctatcgggcacaccagctacctaggctggcaggaggggcagcgcgctcgggctctgatcgtggacccggagctcgaccggtgcaagcagcacgacatgatccgggtgacgtagaaactttagctgtcgacggcttatcaagctcttcacgggctataactgggtggcgctgacgcggcacttata

SEQ ID NO: 46530 - DNA, 396 bp, Zea mays
  unsure at all n locations
  Clone ID: LIB3066-027-Q1-K1-D8
atcgacatgaagtactgccccaacaagttatgcaccgccaatggtgcctccaaggtcaccgtcaaggacgtcaccttcaagaacatcaccggcacctcctccaccccggaggccgtcaacctgctctgctctgccaagatcccatgcaccggcgtcaccatggacgacgtcaacatcaagtacagtggcaccaacaacaagaccatggccgtatgcaagaacgctaagggcagcgccaagggttgcctcaaggagctcgcatgcttctagaaccaccatcgacccatctctctagttatacaatgtgtntggttggtggatgctgagagatnggttctcagctcagatgcaagctgcgcctagcctgtgtaggtttgtgctggtacatngagagct

SEQ ID NO: 46531 - DNA, 282 bp, Zea mays
  unsure at all n locations
  Clone ID: LIB3066-027-Q1-K1-D9
gtcagaaaatagtgggatcgagttgtttcactgcacgagcacattctccggcgaccaccgggcctccctctccggnctctatcgaccgaccaacgcgccgagcgaagatgtcgtggcagacgtacgtggacgagcacctgatgtgcgagatcgatggccaccacctcacgtcggcggccatcgtcggccacgacggcgccacctgggctcaaagcaccgcgttccccgagttcaagcccgaggagatggctgccatcatgaaggatttcgacgagccggggc

SEQ ID NO: 46532 - DNA, 450 bp, Zea mays
  Clone ID: LIB3066-027-Q1-K1-E10
cccacgcgtccgcgaagaagggcagcactaccagtagcagcagccatgcccgctcgcgctcgatggcgactcctcgcgctgccgctcgcgctcttactcgttgccgggtcggcgcatggcctcgtgaagccggaggcagccgcggcgcccaagccccccgtccccaaggccatatcggacctgagggacgcgatcgtgaaggggctgggattccaggccgaggggctcaaggtgtccgggttcgacgtgcgagacgcgctcgtggggcacgcggtggcgtacgagttcgacatcgaggtcggcaggaaggtcctaccggtgcgcctgctggaggacgtcagccggtgggacttcgtcgacctccccatcttccgttcccaggccgacgctgacgatacggcgctcgccgagatccggcgggccgggagggggagcatcgttgagcctacc

SEQ ID NO: 46533 - DNA, 375 bp, Zea mays
  Clone ID: LIB3066-027-Q1-K1-E11
cggacgcgtgggctcactaccacgcccccgctcctgtcgtctctatcttcgcctcttccatcgcaggattcagcggccatgggcggcggcaacgcccagatgtccaagatggcgcgcgagaggaacgccgagaagaacatgggcggcaaaggcagccagctggaggccaacaagaaggccatgaacatccagcgcacgatctgcatgcagaccttcatctgcaccacctgcgatgccaagtgcaaagaacatgcggaggcgaggcatcccaagaacgacctctaccagtgcttcccccacctcaagaactagtaagcagcagaagcatatgctctgctcagctaaaagacaagtactacatatatatatatatac

SEQ ID NO: 46534 - DNA, 169 bp, Zea mays
  Clone ID: LIB3066-027-Q1-K1-E12
tcgcggactcgtgggcggacgcgtgggcggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaataaagttaataat

SEQ ID NO: 46535 - DNA, 428 bp, Zea mays
  unsure at all n locations
  Clone ID: LIB3066-027-Q1-K1-E2
acttgctagtggggaaaacaagatggagcaacgcatgcattgtagtgatccacaagatacagatccaacaacattgcctgctcaaaggccggcaatctcaaacatagtagcttataagaaaagcactcaaggaaaggaatacatagaatggggacgaagggggcccttgagcttagaagcacttccggtgaacaatcgctggtcctgactcatcgtactcagcctttgaggtaacatactgttggagagcagcttgcctgtaactatctgtaacaatgaaacagacaacacagaattgctcccagtgcaacagctggatgatattagagaagcttctgattctgcgccagagatctncatatgcgaacctaacctgtgctccagtatgaactatggcacagtgcctggaagacactccatgtcagaag

SEQ ID NO: 46536 - DNA, 302 bp, Zea mays
  Clone ID: LIB3066-027-Q1-K1-E3
gacccacgcgtccgggcaagggaggcaaggtcctgtaggccgacgcgcccatgctcaccttggaggcgggcaagacgtaccgcctccgcgtgtgcaacaccgggatcaaggcgtcgctcaacttccgcatccagggccacgacatgaagctcgtggagctggagggctcacataccctgcaggacgtgtacgactcgctggacgtgcacgtcggccactgactctccgtgttggtcgacgccgaccaggcgcccggcgactactacatggtggccttcacgcggttcattcacgacgcccag

SEQ ID NO: 46537 - DNA, 241 bp, Zea mays
  Clone ID: LIB3066-027-Q1-K1-E5
acccgtccgcggtcgtcgtccatcgcacgactcatacgatccacagatgtatacagctggaggagaggaaacgcgcgacacaggtgcagcaggctcatgaaccattacgcggctgccagctgacaaggttggcccttcatgcactcgaaagctactagatggaccacttggaaggagctctttgacttctactatagccaacctcacgcctctgtggtcaatactcggcatctcgaagata

SEQ ID NO: 46538 - DNA, 401 bp, Zea mays
  Clone ID: LIB3066-027-Q1-K1-E6
gctcctagcggccctcctactcttggagcttgtgtcgctagtgccgggggcgtcatgcgaggagttgcccttggatttttgggtgagtgaactacgggtggtcggggcaaaggacatttcaacagccgatggatgcactaagaagaataaggacgcagtgctctgcccaggctaacacggtaaccaatttcatcaaccctaccaactctgaggaacaaggctataggaccatcggggagtccatcgctaacatccctgatgatagcaccaaacagtacatcctcatcctcagcggtggcaccgtgtaccgagagaaagtattggtgagcaaaagcaagccattcgtcaccataagatcagatgacctcatcaaccctgccatcattgtgtggaacgacact

SEQ ID NO: 46539 - DNA, 318 bp, Zea mays
  Clone ID: LIB3066-027-Q1-K1-E7
ccctctccaccttccatcccgatcaccgccgccaccgctttcgttccacgtcccgatggcaccggtagatctaacccccaggcagccccggaaggcgtatggcggcgacgccggcgcctactacgagtggagcccagccgacctgcccatgctcggcgtcgcctccatcggcgcagccaagctctccctcgccgccggtgggctctcgctccccagctactccgactcttccaaggtcgcgtacgttccttgaaggcactggcacctgcggcatcgtccttgccggaggcgaaccaaggagaaggtgctggccgtgaa

SEQ ID NO: 46540 - DNA, 390 bp, Zea mays
  unsure at all n locations
  Clone ID: LIB3066-027-Q1-K1-E8
gtcggtgatctggggcctgatcggtccggagcggctcttcggccggcacgggctgtaccgcaacctggtgtggctgttcctggtcggcgcgttgctccccgtgccggtgtggctgctgagcagggcgttcccagagaagaagtggatcgcgctcatcaacgtgcccgtcatctcgtacgggttcgccgggatgccgtcggccacgccaaccaacatcgccacctgtctggtgacgggcaccatcttcaactacttcgtcttcaggtaccgcaaggggtggtggcagaagtacaactacgtgctctcggccgcgctcgacgccggcaccgccttcatggnggtgctcatcttcttcgccctccagaacgcgcaccacgagctcaagtggtg

SEQ ID NO: 46541 - DNA, 300 bp, Zea mays
  unsure at all n locations
  Clone ID: LIB3066-027-Q1-K1-E9
cggacgcgtgggcggacgcgtgggcggacgcgtgtgcggacgcgtgggctgacgcgtgggcgctctcacctcattggggtcctggtgggcgaataagcaccaagccctncgcttggatcgaccatcgtgcgcgttccttgctcgcgtcgagagatttccaacgccgagctagcgcacagggaagggagagaaaagtgagtgccaccgcggggacgagggaaactcgactcaccacctatcgctccttggagttgtgtcctggggattctccgggcttggaggaggaaggttgaagcagct

SEQ ID NO: 46542 - DNA, 472 bp, Zea mays
  unsure at all n locations
  Clone ID: LIB3066-027-Q1-K1-D2
ctccctcggtagtgaggcggacggtgaggcaccaagtccgtctacgacgatgtcatccctgccaactggaaggccaacaccgcctacaccgccaaataattaactttagtgctgacaatactttaagccggcctatgctagctatactagaattggttggatcccaagcaatgcattacacatgcatgcattggaccgtgatatctatttgctaccactaccctattacgacagtgatgctggcgccaacaatgatggtgtcatcctccttctccatcttcttcatctccatatatagctagagtgagacttcgctgttgtttaaaagagaagagttaagaaatggattgacaagttatataataagtgcctaatgaaatatttgataggccttcattttttatcaaaggatccatgaatgttgtgttgtccatgtatctnctacgtaatcctaactttatcatgtattcta

SEQ ID NO: 46543 - DNA, 322 bp, Zea mays
  Clone ID: LIB3066-027-Q1-K1-B9
agcaggttcaaggaggtgaccaagcgggagtacactcagtacagcgagtacaagatctgggtgtggaagtcgcaggacgacctgttcctcaacggctccttcttcaaccagtccggctgcctgaacgagcgcatgtactacaggctcgacctcatccaggccaagggcggcctgtacgcctagtcgctcaccaggtactcctgcgcgctcaactgccgcgtcggctggaagtgctagtgcgtgtgcagctctaggctgcaactttcatcattggcgatcgatcgtaacaatgcaaggttgttgcgtatataacgcttgtgtt

SEQ ID NO: 46544 - DNA, 333 bp, Zea mays
  Clone ID: LIB3066-027-Q1-K1-C1
tctggttgtgcacgcgcgcatgtcacaaccagatgctataatcatgggtgtcgtattcgctatcgtgctggtcaaagtcgagagcaacaatgacatacatagggtagatgattccggggtcgtaatcaaggattgtgagcatcacgcagatgcagaactctattctgtagcagccgaatcgtaggaagacgccaaagggcgggaggattatggccaagaggatctacaagaaggtgcaacagtaggcgtgcgccatgacgatctcgaagctggtcaggatcgggactgatatgttgctatgcgtagagcccggtgactagttctagatcggga

SEQ ID NO: 46545 - DNA, 334 bp, Zea mays
  Clone ID: LIB3066-027-Q1-K1-C10
gcagaccataatccgtcctaccaatcgccttcacagatcggcggtccacccggaggctgcgatggcgtcgtcgcatgcttacatctacaagatgcatctccttcagagctaccgcatcgtctgtcacaccgacatgactaacgccatccatgcctactaatactactgctgcctagcgctgacgagagtcattagaatgtcactcatgcgtcaacttgtgctattactgaaaatacacctttgagatctgtgaagggctccaatctatttaagcgatcaaaggaatagtatctaggccttttcctgagctggtgatactaatatggagcaccat

SEQ ID NO: 46546 - DNA, 386 bp, Zea mays
  unsure at all n locations
  Clone ID: LIB3066-027-Q1-K1-C11
ccgacgggcgccggtctcgacgacaacggctgcggctatgggtacaaggacgtgaacaagccctccttcaatagcatgggtgcatgcggcaacatccncatcttcaaggatggtctgggttgtaggccctgcttcaagatcaagtgcaataagcctgcagagtgctccagcaagcccatggtggtgcacatcacggacatgaactatgagcctatcgcggtgtaccacttcgatttggcaggcacggcgttcagcgccattgccaagaaggacgaggaggagaagccgtgcaaggcgggcatcgtcgacatgcagttccgaagggtcaagtgcaagtacggctccaagatcaccttccaccttgaaaaggggtgcaaccccaatta

SEQ ID NO: 46547 - DNA, 453 bp, Zea mays
  Clone ID: LIB3066-027-Q1-K1-C12
cccacgcgtccgcgaacgtgcgctgtctctcgatcctgcatctctgcacctgctcgcctccccagggaggcagggacaatcgacttcgccgggcgccggctagccccaccggcgacgacaggcacagtggaccacggaggagaaagtactctgctttgaatgggaagtgccatgaacaaagacaaagttcatgacaaggagactcacggaacaagtagtgatataactgagaaaacacctgtggaaacggtgaagggtcccaatctgcttgagcgagcaaaggaagagatcgaggcccttgccggagctgttcatactaagatggagcaccattccagtccccacgcgaagaaggatgaatcacataaggaaggcaaggaggggagcctgcacaaaataaaagcccacacggatgaaactcacggaacaagtgctgacataaatgagaacaca

SEQ ID NO: 46548 - DNA, 452 bp, Zea mays
  unsure at all n locations
  Clone ID: LIB3066-027-Q1-K1-C2
cccacgcgtccggttccattccatccgcacgaagaagagcagcggcggatgaccccgttgatgtcatcgccacgcacgtcgcctcgcccttcttgacgacgtgcgccggtcggccggataccatgccgggcaagcaggaggagggcggccaaggcccggcgggcagcagcgtgtgcttgtggctggtgacggcgctgctcctgctatctgtgctcgtcggcggcgcgtgcctcgcggcctacgtcctgctgccgccgcaggagacgccggcctggctacccgccgtcgggctagcgctcgtcgcgctaccaggggcgttctggatcctcacttgcgcgtaccggtgcgccgccgcgcgggccgtggagcgcacgacgatggccgtggcgccgtctnctggtagcatgtgctcgcgctacggatcgtgagcagtgacctatttaaggatcgct

SEQ ID NO: 46549 - DNA, 471 bp, Zea mays
  Clone ID: LIB3066-027-Q1-K1-C4
cggacgcgtgggcgctgggccggcggtgggagaccgacgccgcgtacgtgcagtccaaggaggcggtgaaggacgtgtcggtgcccaccagcaccatcaggttccccgacgggacgtcccggctggtggcgccggcgctggtgtacgccagcgctgccaggatggcggacgccgacgtggggagccccaacttcaacctgacgtggaaggtggacgtggacccgtccttcagctacctggtccgcctcttcttcgccgacatcgtgagcaaggccaccaacgacctctacttcgacgtgtacatcggcgggcgcaaggccgtgtccgggctggacctgtcgacggtggccggcggcgagctggcggcgccctactacaaggacttcgtggtgaactcgtcgttgctggaggacggcaagctgagcgtccaggtcgggcccatggggcatgacacggtgcggatcgacgcgc

SEQ ID NO: 46550 - DNA, 386 bp, Zea mays
  Clone ID: LIB3066-027-Q1-K1-C5
cggacgcgtgggggcccagaggcagtgccgtgaccgattcgagacgcaagagaaggatcgagacgaggcggcggttttccggggcagcatcgtctcggccacgaagatgtcttactcaaggggctcaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttttgttaccatggctgctgttaaagatgcagatc

SEQ ID NO: 46551 - DNA, 481 bp, Zea mays
  Clone ID: LIB3066-027-Q1-K1-C6
cagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatcttcagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctttct

SEQ ID NO: 46552 - DNA, 295 bp, Zea mays
  Clone ID: LIB3066-027-Q1-K1-C7
ttgcattgaggtcatgtgagcggccgaatgttttcatgaaattgcgacgtgctgagtaccgggtgttatgccaactgacatcgtggggtaatatgttaagccataagactggaatgacatgataagtgatccaaaaactggaatcatagatgtgcgtaacatgtatgacatactcataggatagcttaatgaaagctgtcgatccacgtacaaactcattcatagagattactacttgggttgaccatcaatttcaattggtgtaatcatgcaccctacggtcatggcgagatga

SEQ ID NO: 46553 - DNA, 409 bp, Zea mays
  Clone ID: LIB3066-027-Q1-K1-C8
gggaagaagtcgtccagcgactgtggccacaagtctgcttccaaaggcaagttagcggcgggtcagactcggactcgggagcggaagcggaagcggaatcggaagcggaatcggaatcggggtcggaatcgaagacgaatctgaaggccgtgtccaagagcatcaaggcgatgtgctcgcagacggactacacggacgcgtgcgagaagagccttggcaaggccgcgaacgccagctcgtcgtcgcccaaggacatcatccgcagcgccgtcgaggtgatcggcgactcgatcggccaggcgttcgaccgcgccgatctgatcctgagcaacgacccactcgtgaagggcgccgtcggcgactgtaaagaagtgttcgcggacgccaaggacgacctcaacagcacgct

SEQ ID NO: 46554 - DNA, 96 bp, Zea mays
  Clone ID: LIB3066-027-Q1-K1-C9
ggtgcgctggatataaataagcactgtatttaaggttaaacattccgctatgttcgctgtcgataaagagtgctatttacgctgctggcgttagtc

SEQ ID NO: 46555 - DNA, 448 bp, Zea mays
  Clone ID: LIB3066-027-Q1-K1-D10
cccacgcgtccggcaaagggccatccgctgcggtcagtgtaggtttctgaatcatagcttggcgatgcctgaggctagacaaatactgagctagccttcagaaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaacacgtggcacacatcggttgggatggtcctggc

SEQ ID NO: 46556 - DNA, 266 bp, Zea mays
  Clone ID: LIB3066-027-Q1-K1-D11
gggacgagttgtgagacagcacctcgttgtctcgtgatcagacccatggtccatggagcaatacgattcttgtaaactctagcttcatccaatctgttcctcctgatctaactagtctgaatagcaactgttcgtttgctaccaatatcaacttcttttcagatgctccatatattcctgctctctgtaaacaaacaattatcactgttcaatagatgcggagatgtggatataaaaattacaaaacaaagaagaagaccaagaga

SEQ ID NO: 46557 - DNA, 442 bp, Zea mays
  Clone ID: LIB3066-027-Q1-K1-D12
cccacgcgtccgcccacgcgtccggcggtccgatcaggtgagcagcggcgcggctgctgcctgcccgcgcctgcctccgcggctccgccggccgtcgaccgagcagccgagcagcggcgcggcggctgcctgcccgcgctcgcctccgcggctccgctggccgtcgttcgccgacccgaacgccgagtcgcgcgagcgtgccggcgtgccccgcctctcgtcggctcgcgactgcgccagcgcggtcgcgccgccccaccccccggtgaccggcgtccggatccatccgtctggcaacccaaccggccaagggccaaccccgtccccggaccccgactccccgagggccaaccggccaaggcacaaccgctgaaccgcacaatgcatatttagtcgtctactcgcctaggcctattctttccctctcaaactcaaattcttc

SEQ ID NO: 46558 - DNA, 482 bp, Zea mays
  Clone ID: LIB3066-027-Q1-K1-B8
aacacctatgggccaaggatgaacattgacgatggccgtgttgttagcaacttcattgctcaggctgtgcgtggcgaaccccttactgtccagaagccaggaacacagactaggagcttctgctatgtcgccgatatggttgatggtcttattaggctgatgaacggaaacaacactggaccgattaacttggggaacccaggtgaattcaccatgctggaacttgctgagaatgtgaaggagttgattaacccagatataacagtgacgatgaccgagaacactcctgatgatccccgccagaggaagccggacatcaccaaggcaaaggaagttctagggtgggagcccaagatcgtcctgaaggacggcttggtgctcatggaggatgatttccgggagcgcctggccgtgcccaagaaaaccaaggcctaaactgccctgcggtgggcgaagaatatccacgggggagcatactcata

SEQ ID NO: 46559 - DNA, 309 bp, Zea mays
  Clone ID: LIB3066-014-Q1-K1-A10
taattcccgtttctaccgactcttcctcccactcttccttccacacccactctaaagatttcccattatgatatcaatctaattataatgctctttcatacagtctcatacttcattcacatcttaaaccttacaacaacatctcaaccgatacataactgacatactcaacctctacaatgtactataactcactcacatacaccttcactacctcgtcccacatctcacacctcccattgtaatactactacttattctaatcaatcctaatactagcgtacacaatatatctctacactccactta

SEQ ID NO: 46560 - DNA, 350 bp, Zea mays
  Clone ID: LIB3066-014-Q1-K1-A11
tcttcctgttctagatctctatcttcctcccttttttttttttttttttttttttagtttttttttttatgtttttattttttttttttttttttttttttataaaaaaattttatttttccatttaaaattaaaaaaattatttcaatttcaatttctactttttaaataaaaattttattaaaccaaaataaactactaaactgaaattgcaaaaaaacaaattataattaaccaaaacacaaaacaacatattatcatggatctcatcatcttctaaatacaatgatcactcatatcctataaaacctacaaattttttatccccctaataaaaaaattgcctaaaa

SEQ ID NO: 46561 - DNA, 461 bp, Zea mays
  unsure at all n locations
  Clone ID: LIB3066-014-Q1-K1-A12
gcggggagtgggtggacgtgccgcccatgcgccacgccatcgtcgccaacgtcggcgaccaggtggaggtcatcagcaacgggcggtacaagagcgtcatgcaccgcgtgctcacgcgccccgacggcaaccgcatgtccgtcgcgtccttctacaacccgggcgccgacgccgtcatcttcccggcccccgcgcttgtcggcgccgccgaggaggaccgcgccgaggccgtctacccgagcttcgtgttcgaggactacatgaacctgtacgtgcgccacaagttcgaggccaaggagccccggttcgaggccatgaagtcggccatcgccaccgcgtgagcaaatactgacttccgctgccggcttccttcgtggcgtcaagccttgaggcttgaacgaacaacgtacgtncatgtgcttatagtggcacagttatgtgtgtaactaccgatcgtggaa

SEQ ID NO: 46562 - DNA, 343 bp, Zea mays
  Clone ID: LIB3066-014-Q1-K1-A2
gccggccatgagcgcggtggccgtggcgccacaggatacagcctcgttgggcaccttggcgaggaggtggacagcctcagcgaagatgacgcccatgcccatgtggaggtgcggctcgatatggcagtggaaggcccacacgcccgggttgtccgccacgaaccggagcatcgtccacccgtacggaaagatgaccgccgtgttccgcagcggcgggtcccggaggttgagccgcgcttcgtcggcggcgtccccgcggtacgcgccgtcgccgtagcccagcacccagaagtcgtggcccgtggaggtgcccacgggtgcacctcgctgacgttgcgcgaca

SEQ ID NO: 46563 - DNA, 421 bp, Zea mays
  unsure at all n locations
  Clone ID: LIB3066-014-Q1-K1-A4
cggacgcgtgggtctagaaacactagtgcttccaaaattgcaagcaaatcttcctttggtgggagtgcgcctttgaagaatggtgaatttcagaagatgttggaaatggaatcacagaaaactatagtggtaaattgccctgatgtgagcatccctgtagtggaagagacaaaaccactcatatgcggaatcactgaattggatgatggccttttcaaggacaagcaactttccactaaggagattgcaacgtatggattgtatctttgccccttatggtttgtgacagagtatttatcgaatgcnagcgccttgcaagaactagtgttgccagtaccacagtgctgtcttcaacttcaggactcttcactcctttcattggtgtttacttggccaagactccataaatgctgcgaaagtt

SEQ ID NO: 46564 - DNA, 454 bp, Zea mays
  unsure at all n locations
  Clone ID: LIB3066-014-Q1-K1-A5
gtttctcattcagcgcccgtacagccaccactctcaaccgagccatatccaaaggtctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctnggccggagtcgtgcagaccgacccccgctgcctctgcatggtactggacggcactgccacgtccttcggcatcgccatcaaccagaccagggcgctggagctccccggcgtctgcaaggtcaaggcgccgncgctcagccagtgcacaggcgtccctg

SEQ ID NO: 46565 - DNA, 436 bp, Zea mays
  Clone ID: LIB3066-014-Q1-K1-A6
ggcaacaccatcgtggaaatccaagtaggaatgggccccgacggctagctgcgctactcgtgctacctggagagcaacggcacctggaaattaccagtcatcgacgcattccagtgcaacgacaggtacatgcgtagacgactgaaggcggcatcgcacgcggacggcaagcttgagtggggacaccgtgggccgaccgacgctggcggctacaacaactgatcagaggacaccggcttattgcgtggagacaacggtgggtggagcaccgagtactgtgacttttttctgtcctggtactcagctagatgctgctggagcacggtgaccgtaatctggtcgggcaccacattggcatttggtgcggcatccgcataggtcagacgaaaggtctccagcttccactggtactacaggtgaaggtgccacgcctcag

SEQ ID NO: 46566 - DNA, 332 bp, Zea mays
  Clone ID: LIB3066-014-Q1-K1-A7
cggacgcgtgggcggacgcgtgggcggacgcgtgggcaacggtgccggcgctggtgacaacggcagtgcgtgcgggatcaagaacgtgaacctgccaccctacagcggcatgacggcgtgcggcaacgtccccatcttcaaggaccgcaagggctgtggctcatgctacgaagtgagatgcaagggaaaacctgaatgctcgggcaatcctgtcacggggttcatcacagacatgaactacgagcctatcggtccctaccacttcgacttgagcggcaagggccttcggcttccctgggcaaagcccgggctcaacgacaagcttcggcact

SEQ ID NO: 46567 - DNA, 467 bp, Zea mays
  Clone ID: LIB3066-014-Q1-K1-A8
agttgacgtcgtcatcaactgaaactactgatgatccttttgaagtgaatgacattgaaccggcagctaaggaagtggtggtcgttgatgatacccacgttgtggatcctgtatatgattcaagtccttcgggaagcgagaggcctgcacctactggtttagtaattgacggacctgtcctaaaagatggtcatgcttgtactcttgttgttgaagcaatcatcgaagaagggggttcatcgtcaagaatggaggtttcttccagtgaggtagctggacctagtttgagttctgtggaagcaaaggcgaatccccagagaaagaagcctctgagataagagagcagtccatggttggccatgtcgaagcacatggaggttctgtcagccatgctgatccttcagtatctgatataagttctcagccgagtactgaaagttcaacaaatggtgattctggcagtggtg

SEQ ID NO: 46568 - DNA, 358 bp, Zea mays
  Clone ID: LIB3066-014-Q1-K1-A9
cccacgcgtccgcccacgcgtccgcgaaagaagtcgcctaatgctttcgatcgaattatgcgcgttcttcgtcccacgctccgtctttatttgtaatctgaagcttacaggaacatttgagtggatcatggacggattggtaggcctcttgaaagtccgggtggtgaggggcatcaaccttgcctaccgcgacgcatgaggcagcgatccgtatgtcgtcctacgacttggcaagaagaaacttaagacgagcgtgaagaagagatctgtgaaccccatctggcacgaggagctaactctgaccgtcacagatcccagcctagctctgaatgctgaggtgttcgacatggacacgttc

SEQ ID NO: 46569 - DNA, 367 bp, Zea mays
  unsure at all n locations
  Clone ID: LIB3066-014-Q1-K1-B1
ggggctggcgagggctcctccgccgcggccgggctccagcggcgtttgcatcgcccgcgcacatgcaagaggcgncgccgtcgcggccaggccggggacgacgaggacgacgacgacggtcgcggcggcggcggcagaggccgcttctaacgggtcagcggcggcggccgtcgcagggatcagcagcagcagcagcgcgctggtgacctcgaccgtcgggaaatcgacgaacatcctgtggcatgagtgcgccatcgggcagaaggagcgacagggtctgctgaaccagaagggctgcgtcgtgttggatcactggcctaagcggttcaaggaaaagcacgctcgcgtgcgcgctgagccgcgagct

SEQ ID NO: 46570 - DNA, 413 bp, Zea mays
  Clone ID: LIB3066-014-Q1-K1-B10
caccaccagcgccgaagccgtcacctccgcgctactccagtgagctcgccacctccagatcggagagtcctgtccacgaccagcctcagttagctcaccaccatcagcgccaaagtcgtcacctccacctgctcctgtaagcttgccacctcctgaagtaaagtcttccccaccaccagcaccgattagctctccaccacctccggccaagtcaccacctccaccgtcccctatgagctcacctcctaccgctgtgaagtctacacctccaccagcgccggtcagttctgcaccacctacaatgaagtccccaccgtcggcagcaccaattatctctccgccaccagcaccagtgaagccaccatcgctaccaccaccagccccagtaagctcacctgctactgcggtcacct

SEQ ID NO: 46571 - DNA, 459 bp, Zea mays
  unsure at all n locations
  Clone ID: LIB3066-014-Q1-K1-B12
cagctgcggtgctcttctacatcctcgccgttgctgccctcagcgcggccgaggccccgggagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctganggaccggctgctgatgactccgccggtgctgctgcccttggaagtggagctgccatcgccggcgttgccgctgctgttgctaccatgatcttcttctactaaactcaccgacgatggtcgtgtcccggtgagacattatggtggacacgtaattggc

SEQ ID NO: 46572 - DNA, 460 bp, Zea mays
  unsure at all n locations
  Clone ID: LIB3066-014-Q1-K1-A1
cccacgcgtccgcccacgcgtccgaccagagctcctgactggtcctctctccctcctcacgggcnggcgccgtctgttccgtgcatccaccgccccggtcgtctcccggccagatccctctcctgcaaggtttctttgcgagtggccggagaagatgatgggcgggttcctctccagggtcctcctgctggcttttggctatgcctatcctgcctatgaatgctacaagaccgttgaactgaacaaaccacagattgagcagctcatattttggtgtcagtattggattttagttgccctgtttgacagttttggagagatttggagattttacaatatcatggctaccgttttactcagaagcaaaggtgttggtctttgtatatttgtggtaccctaagacaaagggaactacgtatgtttatggaactttctttaagccatatatttctcagcatga

SEQ ID NO: 46573 - DNA, 379 bp, Zea mays
  Clone ID: LIB3066-013-Q1-K1-G10
cccacgcgtccggccggtgaaagacggtccttatcatcgacctcctcaccgccgacggcatgtggtactacaagacatgcttgaggtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgacccggcaaaggctccaagcaagctatcatctgcattctctggaactcaagataaatgcgcggtctgccagaaaacagtgtatccattggagaaatccccgtaatgctagttctaccacaagatctgcttcaaatgctctcactg

SEQ ID NO: 46574 - DNA, 204 bp, Zea mays
  Clone ID: LIB3066-013-Q1-K1-G2
ggcggtcccgaggcctcaaatccgtgccctacgtcggggcacactgcttctcttcctcgtcccgcgcatctactctgtgtccaggctgcaaccctgggctccagaaaagggtgtgtgcctgccacccccaaccgcgccgaagcggtctgaccatcttgtgctcggttctgccgccggacaggactctcctgactgtctacagtg

SEQ ID NO: 46575 - DNA, 372 bp, Zea mays
  unsure at all n locations
  Clone ID: LIB3066-013-Q1-K1-G3
cgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggataagctntaaagatgtgtacttggtatacgaactcatggatactgatttgcaccagataatcaaatcacctcaaggcctttccaatgaccactgccagtattttctttttcagatgcttcgaagacttaaatatcttcattcagcagaaatacttcacagag

SEQ ID NO: 46576 - DNA, 377 bp, Zea mays
  unsure at all n locations
  Clone ID: LIB3066-013-Q1-K1-G5
caagctnctncagggacgcgcgcctcccgcagcagcgcgtcgtcgagggcgtccccttcccggcggtgctcgtcccgagcgctcgtgcgggctcctgcgccggcggggtcgacaagttcctggcggccgtgcgctgcgagagggcgtcccggctggagccgctggtgcgggacgcgggggccctgctgctgcgagggttccccgcgacgacggccgccgacttcgaccgcaccgtcgacgccttcgggtacgaggagctgccaatcgtcggcagcgtcgcgccgtggaccaacgtcgtgggccgggtgttcaccggcaacgactttggcgccgaacagaagatcccctatcaccacgagatggctcaaggtccaaca

SEQ ID NO: 46577 - DNA, 264 bp, Zea mays
  Clone ID: LIB3066-013-Q1-K1-G7
ggaataactctctctcccgtcgccgggatcccgccggtgacaatggtgaggtggttgtcgccgccgtcgccagcggacggcgagatacccttcggacacgacgccgtcgccttgtccttcttcgtggcgtgtgtggccgtcaccgtcgcgctcgcgtcgtccatgtgctcggcatgcggtcgcaagccgaatgcggccacccgtgcagacccggccgcttcggaccagtccgtcgggacgggctcgggctctgtcttcggcagc

SEQ ID NO: 46578 - DNA, 304 bp, Zea mays
  Clone ID: LIB3066-013-Q1-K1-G8
gagaaacagcgggctagtgcgggacgacgggcaggataagctaacagacttggagctggcgggtctcctcgactcaagctggtggtacgtacagtcggcgcaagcagctcgggcaaatggaggcggcagtcacgacagctgctgggcgaacgatgcagctcgaagtgactgggctcttagtcatgaggataagctgcacgacggcatctacaactgacagtgccgaatacgagcgagtacacctgttggtgtgcgtaaaaaggacaagatcagaaccgggccagactaatcatggggagcggct

SEQ ID NO: 46579 - DNA, 409 bp, Zea mays
  unsure at all n locations
  Clone ID: LIB3066-013-Q1-K1-G9
gccacgcgtccgccacgcatcggtctggctcgaatcgaatgcacgatgagccgagatacgaagactcacaaacattaaccgtagctngcaggccctacgcggccgttgcccggtctgcggagaggaagccgatccaaggacgatgccgtcggacatataccattgcagacacgcagacccgtcaagtgctgactgaaaacatgctggcaatgcacaagagagcgtgtcagctctgaaaccatcatgcgggtctaaacaccatgtgcgcgtcgatacaaccgaaccaggcatccggcgagtgagtataaaaccggcaatctagaggagcctagatgcacatatcagaactgctcaagtcgcgtaaactgctatatcatattaaacaggcatacattacaacaataagcac

SEQ ID NO: 46580 - DNA, 362 bp, Zea mays
  Clone ID: LIB3066-013-Q1-K1-H1
caggatggggctcctcgtcaagggaggcaacgtcctcgagtcgctgggcgaagtcagggtcgccgcgttcgacaagaccggcaccatcaccagaggggagttcagcatcaaggacttccatgtggttggggacaaggttgaaatgaaccagctactctactgggtatctagcatcgagagcaaatcaagccatccaatggccgctgcacttgtcgagtacgctcagtccaaatctgtacaggcgaagccggagaacgtgaccgagacctgcatctatcatggcgagggcatctacggggtgatggatgggaaacagatctacattggaaaacaaaggatcataactagggtcttgtgtcgtc

SEQ ID NO: 46581 - DNA, 451 bp, Zea mays
  unsure at all n locations
  Clone ID: LIB3066-013-Q1-K1-H11
cggacgcgtgggcggacgcgtgggcggacgcgtgggctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacgcccaccaagaagcaggaacaagccgaagccgacgccggaggccgtcaccgcggcgaactacgcgtcgttgtggtcgcccaagcgcctcatgcagcgcgctgcccgcgctttccgncgcagcaggtcgcgcgcccgcg

SEQ ID NO: 46582 - DNA, 336 bp, Zea mays
  unsure at all n locations
  Clone ID: LIB3066-013-Q1-K1-H12
agggtgctgattctggcatgaactcaagatttatggcggatattggagctgtggaatgctgggccaggtctatctactagatgatgaactatatgctgatctaatagcttatatacaagaattatttggctggaaggtttatcagttatttgcaacagtgaaggaacatctaatgcttaatattgatgacctaagcattatcgagcataacgaggacattgggacagtcaagaataaatcatctagggaaaccattgcacattcacccntcatggcttatgccatgttagcagtgggagacagcatggtatgtgaagcggaacctatgattttttt

SEQ ID NO: 46583 - DNA, 334 bp, Zea mays
  Clone ID: LIB3066-013-Q1-K1-H2
ctatcatcatcttctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggca

SEQ ID NO: 46584 - DNA, 368 bp, Zea mays
  Clone ID: LIB3066-013-Q1-K1-H3
gcgcgacggtggagatggagtgccgtcacttcgagtcgcacgaggtccacgacaaggcggaggcgacgacggacgccggcgggtggtacaggatggagatcagcggtgaccaccaggacgagatctgcgaggtgctgctgctcaagagccccgaggcggactgcgccgagatcgagcgcacccgcgaccgctgccgcgtcccgctcacccgcaacgacggcatcaggcagagcggcatccgatacgccaaccccatcgccttcttccgcaaggagcctctcagcaactgtggcgagcttcttcgcgcttacgaccttttcaacgagacgttcgagaattcctaagcgtcattttggtttttttttttt

SEQ ID NO: 46585 - DNA, 386 bp, Zea mays
  Clone ID: LIB3066-013-Q1-K1-H6
cccacgcgtccggatcaaacggggccttattcgctgcttcactggccgtaaattcgcaatgttgatctggggaatgaattaacaaactccaatttttggttctctggttccttcaaggggtcgggtctgcacgccatctgctcggcatatgaaatctgctgagccgtcaacaccacttggagtaacttattcgatgagttcatgatttattgatttattgcagccagaaatcacgcagctgaggcttgttcgtttctatcggattgcacccggaatcgttccagctaatcaaagtttatataaattagagaagcaatccgggtaggaatcgttccgacccaacaattcgacacaaacgaacaaggccttaagcttgttctgtattc

SEQ ID NO: 46586 - DNA, 397 bp, Zea mays
  Clone ID: LIB3066-013-Q1-K1-H8
cccacgcgtccgcccacgcgtccgcccacgcgtccgggtgcagcgcgcgagcgcgttcgtgcggcatggaacagaacgacggctcgttcctcgccgtgcgacgcctctccggcggcgccatccaccaccatcgccaccactcttcgccggctgaggtcgtgggcgtgtccacggcgtggatcgggaaggggcttacgtcgtgcgtgtgcgcgcaggggacggagagcgacgggcgcctctccttcgatttgagtcccattcaggaagagtgcttgcataggttgcagaaccggatagaggtgcagtatgatggttcaaatctagagcatcagaaagcactggtggccctttggcatgcttcttttcctggaactgaacttctaagattagtatcaga

SEQ ID NO: 46587 - DNA, 461 bp, Zea mays
  Clone ID: LIB3066-013-Q1-K1-H9
gttgtccctagagaggaagcaaaggcacatgaccgtcgtctccgggtgggacgacgagtccggcctgctcgatgcgatggtcgttgaggccacgcccgtctgtgagtcccgtcgcaagaggcgagcctccacctgctccaacaatgacggcgccggatccaacaccaaatacggtgatacggttgacagaccaccaaggatccaccttcctacaatggtgtggtgcaaaaacaacaacatggtctacacagcagtgcctctaacgcacggaaggacaaaggcagacgccacagagtatcattgaggaaatcatgtctctgttattaaatggttcctgcacatctgctttgagctgatcaccacgccttgtggacacaggcactgtgttcgaggagcctattatatgcacaaacattccaagacttgttctaggatggactaataacgccatctgcagtgga

SEQ ID NO: 46588 - DNA, 357 bp, Zea mays
  Clone ID: LIB3066-013-Q1-K1-G1
gccagccatggcgactagggtttggctcaccaccctcctcctcgccttcctcctcgtcgccacccgcttcaccgcccgagttgctagagctgattcgggaggaagatgctgctgcagctgaggttgttgaaggggctgatctaggtattgtgggtgatgatacacaggtttccagtgacggacctttaagccctgctcctggtgtagagacagtagttgtattccccaaaaatgctggcaaaattgtactagcatgtgaagaaactgaattactatgtggtctgcaaaatgagggtgaatcgactttgaatggtggtgctggtcattcaactcttcatctttctttttaccataata

SEQ ID NO: 46589 - DNA, 340 bp, Zea mays
  Clone ID: LIB3066-013-Q1-K1-E10
cgagaacctgctccttctctcgaccattgatccctccaaggaccccattcgctctggcctcgaaccttgccttgagaggcctgagggaaaccctaacggtgaaggcgggattaatgcgattgacattattttaatgatgaaagcaaggagggtgcttgcaaagcttgctgagaaaagaaaatcggctgtggaatcttcacgctcagaaaggaccttgggtggaattgatcttacatccaagattgtagactttgggaatgcttgctgggccgacaaacaatttacagattttattcacacaaggcataaccgggcaccaaaggatattctgcaagatact

SEQ ID NO: 46590 - DNA, 447 bp, Zea mays
  Clone ID: LIB3066-013-Q1-K1-E11
cccacgcgtccgcccacgcgtccgagcgacatttcgaataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgtggcaacgtccccatcttcaaggacggcaagttgcggctcatgctatgaagtgagatgcaaggaaaaacctgagtgctcgggcaatccagtcacggtgtacatcactgacatgaactacgagcctatcgctccctaccacttcg

SEQ ID NO: 46591 - DNA, 180 bp, Zea mays
  Clone ID: LIB3066-013-Q1-K1-E12
cccacgcgtacgcccacacatgccatctacattgaacatatcacacttcatcgctacgattgtatccctaactaataacatcatgctctaaattatagtccttctagtgctcgatcccagatgttcatacagatcctatattgtgtcttcatgtcactacattaccaccaactacatctt

SEQ ID NO: 46592 - DNA, 378 bp, Zea mays
  unsure at all n locations
  Clone ID: LIB3066-013-Q1-K1-E3
agcgttgccttcccacggtggctggagctactgattcagaagtgcaaaggcctgcgacggtttgagttgcagtgtggtctgtcattgctcaggagctgcctcgacggtggcaagaactggcatctcgtgcagcagatccccgaggtgcgcatcataagctgcgatggcaagagatactttcggtataacaagagccgtcgcatctacgaaactaatgcacagtcagaagaatgaagccatttctgaaaaccttggcacgacactggtttgttttgggtcagccacacgtttcagttgtcgctgtccctactttgttccgggagtattgagagcttgtggtctggtcacgattgattcangtgttttcctttggtttgc

SEQ ID NO: 46593 - DNA, 389 bp, Zea mays
  Clone ID: LIB3066-013-Q1-K1-E4
cccacgcgtccggaagaagttagagagctcaaagaacagattgcttgcctcagggcagcattagctaggaaagatggaggtcaagagagcattcgaagcactcaatcaagcccagacatatatagaatgagaacgggcaatggattacctgcgttgaggcacccaatagtagatggaagtatagagaacgactcggcattgggagatttcgctgagcactcgccattcgggagcagcaattcgctgccagagttgggaccagatggcacacaagatctagccttctaccaaagaagcagccctgaacagcaatggagctggtccgggtctgttgcaacagaagattccgatgacttcgaggttgcaacgaattgctcgtcagatctgga

SEQ ID NO: 46594 - DNA, 248 bp, Zea mays
  unsure at all n locations
  Clone ID: LIB3066-013-Q1-K1-E5
gatctgggctggagctanaaccgagggaggcgcgccatgttgctgcggctggctgctgcggctcccagttccgtatatatcatcgttattattattatggtataataactttgctcgcgagacaaatggaggttctctaggtagtgtctctaacctgtcgtactgacttctgtcgatagaagagaatggggccacaaacttctttattatccatggatggataggatagatcacgttctagatcgcga

SEQ ID NO: 46595 - DNA, 264 bp, Zea mays
  unsure at all n locations
  Clone ID: LIB3066-013-Q1-K1-E7
cggacgcgngggcggacgcgngggagctccgccaccaccaccaccaagcccaacaacagggggcncgcgaaaanaangaagagccgcagcacggcaacaacggccgcgcgcgaggagcaagcccncgcgcaagnggcggccaccgccccacaggaagcggaggcaaagaagaagagagcggcggacagcggcgaggcggcggaggcgaagaagacccaggacgacggcagcacgacgcagagcgagggcaagaaggggacggac

SEQ ID NO: 46596 - DNA, 302 bp, Zea mays
  Clone ID: LIB3066-013-Q1-K1-E9
ctaatgcgtgaccctccattaaccgtagccttaacactgctcgattgatcctggcttcaggggcacgtccgtgtcatggatcgaagattacttattaaatgtagacgaacacgcctcgaatggccactattaatgaaatacatgtactgcatgaaggacctgcgatgatacattcttctcacgtgctctaaactcaccttattcatacctaacattgcagcaccactgtcattttccttacagtcttagaagccttcacgtatgacatgtacctactcagctaagtgtacaaggcgcgcccg

SEQ ID NO: 46597 - DNA, 332 bp, Zea mays
  Clone ID: LIB3066-013-Q1-K1-F1
gttcgggatggtgattttggcagcaaactactactatttggcaaaaagatcagaatggttactagcgtcctctattggaagcaagtcacacagggcgagacctaaactaatttaattatgaagtgtgaacaatagaggagatataaatagtgtgaacaatgaactggaggagacagaagcggggagatcgaagacaagggaggccttatgtgcatgacaatcttcggtcgcacaaatgggtgttgtaagtattgatctgtaagctacaaatgtatgaaggggagtgagtgctttccatacatgttccttctggggctatggccatatgcttt

SEQ ID NO: 46598 - DNA, 318 bp, Zea mays
  Clone ID: LIB3066-013-Q1-K1-F10
aacaaacatacaaacacacaataaaaaagaattctaacaacaaaacaaaaaagatacaaatcagaaaaaaagaatagttaggtccgcgataatcaatcgaacgaagctgcatgctgctaccggccgaccgcaacatgaagatgacacggacgatgtgcctaggcctgctgcttctactactggcggcggcgtcgacagcgactgctcatttcacggtcggcgatgtggatgattacgtgtccaagcgcacgcaggagtccacccacatgaacatcggtggcgcagacatcgatgacctcatctccagtgcggcgcgct

SEQ ID NO: 46599 - DNA, 455 bp, Zea mays
  unsure at all n locations
  Clone ID: LIB3066-013-Q1-K1-F11
accatgacgcaggaaaagacggtggtgctgtacccctccctgggcgttggccatctgaaccgcatggcgcagctggccaaggccatcctccgccacggcagcgtcgccgttaccatcgccgtcgtcgacccgcccgagaagcacgccgtgctagctgctgcgctggcccgcctggcagcggtcagtccctccatcacggtccacctcctccccatcccgccctgcgccaccagcaagcagcattcccaccccatcatgcccatcctggatgcgctccgcgccgcgaaccccgcgctccgggcgttccttgccgcgcgagtccctgccgtcgcccctcgtggtcgacatgttctgcaccgacgcgctcgacgtcgccgcggagctcgcgatccccgcgcacttcttctacccgtccgccgccggcgacctcgcggtctacctncaggttccagatc

SEQ ID NO: 46600 - DNA, 217 bp, Zea mays
  Clone ID: LIB3066-013-Q1-K1-F12
accacgcctcaggatacgaccgtgctgcttttccaaatgctaagcgtgaactatctaaaccgaatattctacttgcacaaacaacattctcaacaccatactcatcctacttactatcatcgtcatagatcttacatagaaacactacctactcactactgtactactcctactagcaccctgttacattatcaacaacagtccatatcatacccat

SEQ ID NO: 46601 - DNA, 317 bp, Zea mays
  Clone ID: LIB3066-013-Q1-K1-F2
cggacgcgtgggctgacacatgaacatgctctcgggtgcagtcatcggaataacaaataggacgcgtcaacaacagccagctcgcgaaaataatgaagagccgcaacatggctatcatctgccgcgctcttggtgctagccctcgcgctagtggcggccaccgaccgcacaggtagcgtaggcatagaagatgagagcggcggacagcggcgaggcggcggatgcgaagaagatccaagactacttctgctggacgctgtgcgaaggcaagaaggcgacggacccggtcgtgtgcaaggagttctgcgcgctctacc

SEQ ID NO: 46602 - DNA, 300 bp, Zea mays
  unsure at all n locations
  Clone ID: LIB3066-013-Q1-K1-F3
cacccacccatcaaggttggggccgccagcagagttcagccgttcctgttcctgataaaacgagagaaggatggcagtgtctcagggagctgtcctattcttgtttctcctcctcgtcgcagcagatgtgggaaccatcgatgccaaaatgggagtagccatgcccatgcatgccttgataatggagaaagcgaaacagcangagaaggagaagaaggaggagaaaagcacggagaatgaagagagtcaatgcttatcgncgagtcttcagttcgagggcttctgcttaacagcgacaga

SEQ ID NO: 46603 - DNA, 360 bp, Zea mays
  Clone ID: LIB3066-013-Q1-K1-F4
ggcgtgttcaagtacaacctcatcggggacgtgccgccctccaacacggcccccaccaagatggcgcccaacgtcatcagcgccgagttccgcacgttcatcgaggtggtcttcgagaaccccgagaagagcatcgacaccatccacatcgacggctacgccttcttcgccgtcggcatggggcccggcaaatggacggcagcgtcgcggagtacgtacaacctcctggacacggtgagccggcacacgatccaggtgtacccaaggtcgtggacggcggtgatgatgacgttcgacaacgcgggcatgtggagcgttcgctccaacatctgggagaggcagtacctcggcgagcagctg

SEQ ID NO: 46604 - DNA, 341 bp, Zea mays
  Clone ID: LIB3066-013-Q1-K1-F5
atccaaaccagacaagcaaggaatcccccgatggctcatcgcgttctcctcctcctctctgtcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccggtttcaaggccaacctgcgccgcgcgcgccggcaccagctgctggacccgtcggcggagcacggcgtcactaagttcttcgaccttacgccggcagagtt

SEQ ID NO: 46605 - DNA, 132 bp, Zea mays
  unsure at all n locations
  Clone ID: LIB3066-013-Q1-K1-F6
cataggcgcccgcatggactctggccggatcatctacttcatctaacagaaggacgatgggggacgctacnagtcgcacctggcgtaactccagccttacagttccactaacgacaccgtgcacgcccatgt

SEQ ID NO: 46606 - DNA, 310 bp, Zea mays
  Clone ID: LIB3066-013-Q1-K1-E1
cccacgcgtccgccaaaacatagagtgtcgacttttctattggtgtgattgggggcactaaatacgtaacacattgcactcagactacatatactgtgtttgtgtgttgtatgccgtatgcgtgtgtgagcttgcgcaaattggacatctaggccgtgcgtatcctgcgatgaaaggcgccgtcatcggcgcatcgaccgtcctggtcgtggcggtggtggccaccatctgcgtcgtttccttcaaaggcagcggcgatggcgggagggccgatgagggcgagatgtccacgtcggtgaagtccatcaag

SEQ ID NO: 46607 - DNA, 312 bp, Zea mays
  Clone ID: LIB3066-013-Q1-K1-F7
cggacgcgtgggttaggtcactgggaggaaccatgctgtggaacatgttccagtggttttgcgctgctgcaaagggctgtggcttcggagtgttccctatctttggcctcgaggcatataaacacggattctacttcgacttctgcatgtccaacatcggcatcggcatgctgtgcccgtacaccatcaccgtgtccatgttcatcgggagcgtcgtctcgtgggggctcgtcttggcgtacctcgcgaccaaggcgggcgtctggtactcttcgcacctcagccccagcaggcctcagcggcatcaggggc

SEQ ID NO: 46608 - DNA, 221 bp, Zea mays
  Clone ID: LIB3066-013-Q1-K1-F8
gttctgaaaatgaattcttttgaggctacctctactgctattagtcaaggcaggtacaacgcggagtctgtggggagtgatggtgaggtacacatggagcaaggccctgtcctgtaagccctgcattatccacttggtgttgtaaaatgaattgcatgtctttactcgatagaaggtaatatgtgatgtgtcgcaagggcatgcagtcacagttccaatga

SEQ ID NO: 46609 - DNA, 381 bp, Zea mays
  unsure at all n locations
  Clone ID: LIB3066-013-Q1-K1-F9
gccacgcgtgcggccacgcgtgcgcttgcattctagcagcaaagcaaagaggatcggatcagaagaaaagaatagttaggtcccggaggtcgatcgaacgaagctgctgatgctaccggccggccgggcatgacgatgacacggacgatgtgcctaggcctgctgcttctactactggcggcggcgtacacagcgacggcgcatgtgacggtcagcgatgtggatgagtacgtgtccaagcgcacgcaggagtacagccacaggaacaacggtcgcgcggccatcgatgacctcatctccagtgcggcgcgcttccacgccaacgtggatgcacgcctatggccgtagatacgacctgcangacgaggcagcagctaccgt

SEQ ID NO: 46610 - DNA, 459 bp, Zea mays
  Clone ID: LIB3066-001-Q1-K1-C8
cggacgcgtggggcgcgccatcactccactcgatcgaccgcctccgtgtccgtgccctacagctggtcatgagcgcccgcccaaccatggcggcggcggcgcccgtgcgcgcctgggtggtggcgctggcgctggtgctggcgtgcgcgctgctccagccgcggccgtccgacgccgcggcgcagcccgccccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgccgccgcgcccgacgacgtcggccacgacgacggcagcgactacaacgaccccgacgtgcccaacaacgaccagctcgtcgtcgtcggccactgaaagctgccgcgcgcgcgcgcgc

SEQ ID NO: 46611 - DNA, 424 bp, Zea mays
  Clone ID: LIB3066-001-Q1-K1-D1
aaaaaaaaaaaaataaaaaaaataaaaaaaattaaaataaaaaaaaataaaaaaaaaaaataacaaaaaaaaatatatataaaaagtcaaaaaatattatattataaaaaattaaattgggttgcctcgttttatggtttccatttttttttccccttaaattcaactttttagctttttttttgttccccctaatttctattctttgcccgtctttttacaactttttgttttttaaacctttggcttttcccaattttttcgctttgcataatatctctttttctcccgttgttttaatcctttttactcctttactttttgcttttcccaccatttttccatctcattttccaaatgtaatcccccttttactttcactttatccgcttcttttttgggggtttttcccatttttcccttt

SEQ ID NO: 46612 - DNA, 392 bp, Zea mays
  unsure at all n locations
  Clone ID: LIB3066-001-Q1-K1-D10
cggacgcgtgggcggacgcgtggggtacagcaatgtcccgcacacgaagctggtggaggtgaagggtcaccagaactgggtgaaggtgagcgggcagtacctgacattccccggcggcggcacgcagttcatccatggtgcgctgcactacatcgacttcctgcagcagtccgtccgcgccatctcgtgggggaagcacacgcgggtggtgctcgacgttggctgcggcgtggccagcttcggcggctacctgttcgagcgcgacgtggcgaccatgtcgttcgcgcccaaggacgagcacgaggcgcangtgcagatggcgctcgagcgcgggatcccggncatctcggccgtcatgggctccaagcgcctgcctttcccgagcaagtcgt

SEQ ID NO: 46613 - DNA, 414 bp, Zea mays
  Clone ID: LIB3066-001-Q1-K1-D11
ctagcttgctcctcgatccatcaattgcaagaggagcaagataccaccaccgtagcaccacacgcaggtacgaagaaggcgacgaacatggcgaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgtgtgtatatattacacaca

SEQ ID NO: 46614 - DNA, 241 bp, Zea mays
  Clone ID: LIB3066-001-Q1-K1-D12
cccacgcgtccgcccacgcgtccgcccacgcgtccgcccacgcgtccgcccacgcgtccgcccacgcgtccgcccacgcgtccgcccacgcgtccgcggacgcgtgggcgccactgcgctgccctagaaccttcgccgccgcccctctttaggattaccgtgtccccgatcgccccctggcacgcccgccccgatcgccccctggcacgcccgccccggatcctgcaccggaattccgtgt

SEQ ID NO: 46615 - DNA, 462 bp, Zea mays
  unsure at all n locations
  Clone ID: LIB3066-001-Q1-K1-D2
tttcaaactaatatactcttctacatctttggggtatcctcgattaattgttcaggtctgatttgaataaacataatgtaatatgtgtgtgtgtgcaagaataatacaacttatgataaagttagcgtggtgcaacaataagctaaacaattatcctaatagtaaacatgtgtattgatattccttttttttacgaataggttccatgtttttggaattggaacaaggtcacttgggttcaacatcagggtacaagttaagaaaggttcatctgtatcggtaggatttgaaattctgcataagagttccaactagtatcacgtgaggactaaggcataaatcatcagattgctcatgccagtttcttgcttggttaagcatacattcccatgatctgtgctgagaaagttccacaaccttactatgttatttgtntattttgaaatcgttcttctttctaga

SEQ ID NO: 46616 - DNA, 466 bp, Zea mays
  Clone ID: LIB3066-001-Q1-K1-D3
cccacgcgtccgctgtttttgatgcggccatgagatacaaatctgagggccatgctactataatcctcgctggtgctgagtatggaagcggcagttctcgtgattgggctgctaagggtccgatgctcctgggagttaaagctgtaattgccaagagctttgagcgtatccacagaagcaacttggtggggatgggaatcattcctctgtgcttcaaagctggtgaggatgctgattcgcttggcctcactggacatgagcggtacagcatcgatctccctaccaacctcagtgagatccgtcccggccaggatgtgactgttactaccgacaatgggaaatctttcacttgcatcgttcgctttgacactgaggtggagctggcgtacttcaaccatggaggcatcctcccttatgtcatccgcaacttggcagctgcgcataactgaggcaaggtcaacacacc

SEQ ID NO: 46617 - DNA, 451 bp, Zea mays
  unsure at all n locations
  Clone ID: LIB3066-001-Q1-K1-D4
ctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgccaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcangacaccatcggcgcggcgcagcgggccatcacgttcaaggacaccggcaccgncaagatcatgctgcagctcgccgtccaggacttcgactcgtgcgaaccgccct

SEQ ID NO: 46618 - DNA, 209 bp, Zea mays
  Clone ID: LIB3066-001-Q1-K1-D5
atcgctacgagggtgatcgcgcgcgagctcaagatcgacgagacgccggtgtggaaggtgatgacgaggcaccccatcttcgtcctctcggatacgctcgccgtcgaggcgctgcagaagatggttcaaggcaagttcaggcacctgccgttggtggataacggcgaggtggcgaccttgctggtacatgtgaatgattcctttgtact

SEQ ID NO: 46619 - DNA, 55 bp, Zea mays
  Clone ID: LIB3066-001-Q1-K1-D7
ccggcggcaataatggcctcggttccggctccggcgggtgaatatacatttatat

SEQ ID NO: 46620 - DNA, 105 bp, Zea mays
  Clone ID: LIB3066-001-Q1-K1-D8
cccacgcgtccgcccacgcgtccgcccacgcgtccggtgtctcgggggtatctcggtcggaaagctgcggcctattctttaggattaggaggagccgtatgaagc

SEQ ID NO: 46621 - DNA, 335 bp, Zea mays
  Clone ID: LIB3066-001-Q1-K1-D9
caaagagtggaaaacaagcaaaatgttaaatatactagactttgaattcccttcgattcatccggcgcggtgggctatggacctgcagcagcaagctaattaagtttatatatattgcatgagagagcatgcaccgctaaccatatatactactgagacttctgaattctagtatatgtaatccttttgtttgggtttaggaggcaattctaatcatgtatgccgaattccaaagagtggaaaacaagcaaaatgttaaataaaaaaaaaaaaaaaaaaattaaaaataaataatatataaattaaataataaatattaaaaataataatttatt

SEQ ID NO: 46622 - DNA, 270 bp, Zea mays
  Clone ID: LIB3066-001-Q1-K1-E1
ctacgctcacggctcgtcctcgtcgccgtcatggctctgctttccggcggccttctcccgcatgcgctggttaaggttaggggaggcaggggacacggtggcgccgtcaacccgcaggtcgccgtcatctgctctcgcaccccgttcccggatgtgtgcacgtccaccgtcgggctgcacgcgttcaagtacccggtcatcgacaacctggccgtgccaacatgcaggtggacgctttcgccaagctcacctttcaagcgcacaagcacg

SEQ ID NO: 46623 - DNA, 422 bp, Zea mays
  Clone ID: LIB3066-001-Q1-K1-E10
atctaagcaaccagttgctgtaggaattgtttttttggtggtattattatctctatctatacgatctagagaaccatgttcaatctaatggaataaggtttcgtattgacctaggcaattttccctgggattagtcattttgttgaaagactctgtactatactctgtagcgtggtgatttttgctagatggcatgcttccatttaggaagaagagatacttttcatctgccctcatgtttacaattaccatgctgtagttgttctatataataaaataagtgtttactctatcagcgatttggtttaaacagcttgtttcgatccgagatagggagcatgatagatttaaagcgctactgaaatcatgttctgggatttgactgtctggatattggctataatccaatcagtgaagttgta

SEQ ID NO: 46624 - DNA, 395 bp, Zea mays
  Clone ID: LIB3066-001-Q1-K1-E11
gttcgagaccttcaacacccccgctatgtacgtcgccatccaggccgtcctgtctctgtatgccagtggtcgtaccacaggtatcgtgctcgactcgggagatggtgtcagccacactgtccccatctacgagggatacgccctcccccacgccatccttcgtctcgacctggctggccgcgacctcaccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctactagctgcctgacggacaggtcatcaccattggtgctgagcgct

SEQ ID NO: 46625 - DNA, 306 bp, Zea mays
  Clone ID: LIB3066-001-Q1-K1-E2
cgtgtaagcacggacagggactggcgctctcataagactagctctcaatctcaggtcaagatcggtactacgaacaagcacctgctgtagcttctggccgccctttacctacactagttgaacaagaacgcactcgagggttagcggatgcttccagtccatgtctgcgttgatctactactgctgatagtactggtagatcaaacactaggatttctgcgatcgaatctacacctgtggatcaagaccgaactggactattcgttttacaatcaatggtacagggatttcataatcaaagtgcat

SEQ ID NO: 46626 - DNA, 457 bp, Zea mays
  unsure at all n locations
  Clone ID: LIB3066-001-Q1-K1-C7
cgtcgaccccgccgatgagatcgccgccggcagcttccgccggtccagctactcccggcccgtggcgtgtgtggccgccaccgtcgcgctcgcgtcgtccatgtgctcggcatgcggtcgcaagccgaaggcggccacccgtgcagacccggccgcttcggaccagtccgccgggacgggctcgggctctgtctccggcagcggcggaagccaggaggctagcgccgaggaggcggaggaggaagtggtgagactgtcaccggagctggcgacgcacggcgccatcgacccggtgacgctgtcgtcgtcgacatcgaagcggcgcctgtccatcagcgtgagcaagaagctgagcatgaacatcccggacaagctgcggctgagccggcgggagcacaaggaccaccaccaacagcagcagcaccagcacgacgccccgggcgncttgcacgcctcg

SEQ ID NO: 46627 - DNA, 414 bp, Zea mays
  Clone ID: LIB3066-001-Q1-K1-B11
cacaaatctggagtttgaacacacgacaggtgatatgcttatcttttgtggatggactgttcgcttggcttttgctgattgaattggagctgcacttgtagtttggtaacgtttatatacataactatgcggattgcgttagctagaatatgtcttccagtacctgggtgacaatgggctctaaattttagagtgttgtagatttgttttgttgcaaatgtggcatggcatggcttggcttgcagcttcgagtactggtcgttcgagatccttgtgctgtttgcagggctgatgcccgactctcatctcagcacttccatcattgcaatgtgccaaaacaccgaaaccatatcatacatgatcacctatggcttcgccgctgtcatcagcacaagggtgtccaacgagcttgga

SEQ ID NO: 46628 - DNA, 375 bp, Zea mays
  Clone ID: LIB3066-001-Q1-K1-B12
cggacgcgtgggcaccgttgcgcgggtagccgttgggagagattccagagaggggaagtgcgccgccgccatgggcgactggctgccggcgtcggtagatcctcggcgactggttggagcccctgccaagccctcggggagaggcgtctgtggtcttcggtgttgagaaagccgaccggagctgcacaattgctcgacggagtaccaacaccgtcgttgattcctgtgctgccgtgggcagcgtcgtctgcgccttgaccattgatcggcagtgaggtcacgaggatctaaaaaatcaccctggtacctggagtctcaagtgccagggaggttctcgggttgattttgctgcgatggcggtcagacgggagattc

SEQ ID NO: 46629 - DNA, 228 bp, Zea mays
  unsure at all n locations
  Clone ID: LIB3066-001-Q1-K1-B2
cgaggcgtgcttcacggagcacgacgtggcgttcggcaaccggcccagactgaccttgcaggcgctggccttctttggcggcgccgcgctggccgtgtctagctacgggccctactggcgcaaccttcggcgcgtggncgccgtgcgccttctcttcacgcaccgcgtggcgtgcatgtgccccgtcatctcgggcgaagtgcgcgccatgctgcgccgggtggggcg

SEQ ID NO: 46630 - DNA, 452 bp, Zea mays
  Clone ID: LIB3066-001-Q1-K1-B3
cccacgcgtccgaccacaacctcttctcccctgtttcctctcgtgcgttctccgcaggagcgaggagggctcgcggcagcggcagggtctccggtgtttttgttccagaatctgtagcaaatggctgacggcgaggacatccagccccttgtttgtgacaatggaactggcatggtcaaggctggttttgctggtgacgatgcgccaagggctgttttcccaagcattgttggacgcccacgtcacactggcgtgatggttggcatggggcagaaggatgcgtatgttggcgatgaggctcagtccaagaggggtatcctgactttgaagtacccgatcgaacatggcattgtcaacaactgggatgatatggagaagatctggcaccacaccttctataacgaactccgtgttgcgcctgaagagcaccctgtgctgctgaccgaagcccc

SEQ ID NO: 46631 - DNA, 348 bp, Zea mays
  Clone ID: LIB3066-001-Q1-K1-B4
gcggaccgtgggtgagtatatgggtgtaaacatttcatcgtcatgaatcaagcctatatggatactgcattgaacatgcacttgtacaatacaactgaaacatgctgcaaggtcaaaataggcatatactctgagactcacattaaaacgcgatatcaatatataattatattactatccccaatacatgttttgaccactttaaacctcaggtccacgaaacccctggttgtcacacttcaacagatcctataaaccccattatgctcagttcacgtagtatataaagaccctgaagcgcccgaccttacaaaagattgttaaccactaagacgaaatggaacacat

SEQ ID NO: 46632 - DNA, 444 bp, Zea mays
  unsure at all n locations
  Clone ID: LIB3066-001-Q1-K1-B6
aattaagtgcttcttattaaccacggcttaaccttaatcaagcgatcgtgacaagtacctaaaacanacagcctagggtagcaggtacatcatcatgctcgggtccggcacgtncgtccagcagctcccggcgttccagtacgccgtcgcggccgacgcgtcctcgccgatctcgaacatcccagcggcgtccagggacgcgaacggtgccatgtcctcggatactgaggagtacggcgccgcgaagccagcgggggtggaggacgcttcctccttcgcctgcgccgccgcgaagctgaacgccggaagcggcggcggcggcggaggcgcgaagagagacgccagcgccgccgtctgatcggagaatatcggccccggcggcggcgccaccacgtcggccgtggaggaaaaggcaaaacctttgggcgtggggctcgctctgcc

SEQ ID NO: 46633 - DNA, 370 bp, Zea mays
  Clone ID: LIB3066-001-Q1-K1-B9
cccacgcgtccggagcaccatgcgaggaaataacatgccgcggcacacgtcgccgttcctttttgccttgttggcgtcggcggcgaccctgctcagcgtcggcgacgcgttggtcgtcgacggcctgcaggtggggttctatggcaagacgtgcccggcggccgaaggcgtcatcagcgacatcgtcaacaacgaaatcgctatggaccggggcatctcccctggcctcattcgcctcttctttcacgactgcttcatcacgggttgcgacgcttccattctcctggacgagtcgcccgccggcgacgtcccagagaaggagtcgtccgacaacggcttcaccctggtcggtctcagaaccattgacatt

SEQ ID NO: 46634 - DNA, 467 bp, Zea mays
  unsure at all n locations
  Clone ID: LIB3066-001-Q1-K1-C1
accgcctgggccggcgcgcgctgttcctgcagggcggcacgcagatgttcgtctcccagatcgtggtgggcacgctgatcgcgctccagttcggcaccgccggcgtgggcgagatgtcccgctccaacgcctggctgctggtgctcttcatctgcctctacgtcgccgggttcgcctggtcgtgggggccgctgggctggctcgtcccctcggaggtgttcgcgctggaggtccggtcggcggggcagagcatcgccgtgtgcgtcaacatgctgctcaccttcatcatcggccaggccttcctcagcatgctgtgctcgctcaagttcgggctcttctacttcttcgccgggtggatgttcatcatgaccaccttcatcgccctcttcctgccggagaccaagggggtgcccatcgaggagatgaacctcgtctggagccgncactggttctggggcaagtacgtc

SEQ ID NO: 46635 - DNA, 369 bp, Zea mays
  Clone ID: LIB3066-001-Q1-K1-C10
cggagtcttacgtgcactcgtaccggaaccataatcgggattaaagactgggagggaagctcctacgacatgcgctggacacatacttatatcagacttaagactatacttcaacggtaattgctactgatattatgggaaagatgaaacatactacacatacaaccaaatgtaacacattacagaactcagaaacgaacacacatgtgtgtgcttaatccttcagtcatgttatgaatttgatgaactatagcccagcaggctcctctggccgtggaagtttccaggcaatactggagtgggttgctatttcctactccaaggaaactcatgtacaaagaggcaagaacatacaatggagaaaagaca

SEQ ID NO: 46636 - DNA, 402 bp, Zea mays
  Clone ID: LIB3066-001-Q1-K1-C11
cccacgcgtccgcccacgcgtccgggaaccataatcgcgttctaaagactgggagggaagctcctccgccatgcccctgtcctctactcaaatccggcggcggcggacagggcaaccgccactgctgctgggatccggcggccagcggcaactaccggggtgcagcgaacctggagataactccctggagcaaggagatggacggactcgtccaaactgctcgtaggtcggatgctgcggccacggatccgccatgcggcggggtcaaccatgtcgtcgactccatagccgaagagcccgttgctgaggatcttggtgagcagcaggttgaagtagctgagcaggagctcattgaaggagaagagcaggtggttcaagaggagccacaaggcgaggagtatg

SEQ ID NO: 46637 - DNA, 422 bp, Zea mays
  unsure at all n locations
  Clone ID: LIB3066-001-Q1-K1-C12
attgatcggcttctctggaggtgcgtgtgagcagctcggaggtcagccgccgagaagagctcataggcaatggcaaccgcaaggaaggatcctcagcaggttgataaagtcaacctgaaacccagcgagtctggcaaaggggtagtacggcgtgcaaggtctgtcccgacctctccggatcgcagatcgtccccatccccggccccagtctcagacaacgccagccgaccggcatcatcactcaacactcgcacgacctcgtcccggtccacaacaacatctagctcggcggcctcttcaagccacgggaagacgatgcgctccgcttcgtcgtccgtgggtggtgcaagtgcaagcgcanggcagacaaacgcggcgagaaggagagcagagaagccccgtgccacatccttgtggcctgc

SEQ ID NO: 46638 - DNA, 467 bp, Zea mays
  Clone ID: LIB3066-001-Q1-K1-C2
acgcggacgcgtgggcggacgcgtggggaaggccggcatcgtgcccatctcctaccgcagggtggcgtgcgcgaagcagggcggcatccggtacaccatcaccgggaacaagtacttcaacatggtgacgatcaccaatgtgggtggcgccggcgacatcgcggcggtgtcggtgaaggggagcaagcgtgtcaagtggacggagatgaagcgcaactgggggcaagtgtggcagaccggggaggacctcacctgcgagtcgctgacgttccgggtgatgaccagcgaccaccggaaggccacctcatggcacgttctccccgctgactggaagttcggtgtcacgtaccaggcatccaagaacttctaagtagccacttttcctcctcttcttcaacctgcatatgcccacaagcaaccatgcagatgataacatgcatcatgcatgcatattcattctttcgctc

SEQ ID NO: 46639 - DNA, 352 bp, Zea mays
  Clone ID: LIB3066-001-Q1-K1-C4
caccggcaaagccagcgagcatcagtccgggagcaggagcgccaacgagctgctcccgcccagcgccagtttcgtgaagctgtcggacatgagccctaaacagtggagcgcattcctcgacaagttccaggagctgctcccaggtgccctgagcgcccggaagcacgctgccggtgtcgtcggccagcgctcgatgccgaggctgggcacgtcttgccagttttgagagtagcagaagagaagcgcctgctctctgctctgtctttgccgctgtaccattttggaggcgcttaccatattatgaactttgaactatgatatgatgttcgcataaatatcacatgttctctgt

SEQ ID NO: 46640 - DNA, 390 bp, Zea mays
  Clone ID: LIB3066-001-Q1-K1-C5
agacctcctgtgccggcacgcgctgacactgcatgtcggcatgcagatgttagtctaccacatcgtgggcggcacgctgatggcgcgccagctctggacctccggcgtgggctagatgtcgcgatccaacgcctgggtgctggcgctctgcatctgcctatacttcgcctggttagcctggtcgtggaggccgctgggctggctcatcccttcggaggtgttggtgctgtaggttcggtcggcggggcagagcatgcgcctgtgcgtcaacaggctgctgaccttcatgatcggccatgccttactcagcatgctgggctcgctcaagttccggctcttctacgtcttacccgggtggatgttcattatgaccaccttcaatcgccattt

SEQ ID NO: 46641 - DNA, 384 bp, Zea mays
  Clone ID: LIB3066-001-Q1-K1-C6
gctgacgacaccaccgtgtggtcgacaaaataaaaaggagagagagatggccctgttgggtcgccctatggccgccgcaccattcttcgtcgtcgtccttctcgtactcgtggcggcagaaaggacgatgggcagggtggtggtggaagagacgctctggctgtcgcaaagccatgccttcaaaggcgtgtgcctcagcaacaccaactgtgacaacgtatgcaagacggagaagttcacaggcggtgagtgcaagatggacggcgtcatgcgcaagtgctactgcaagaaggtctgctagggcatgaccggcaacaagccctaaccgtacggctggttgatccggttgcacactgcacagctcggttgggcacgcggtcatgt

SEQ ID NO: 46642 - DNA, 326 bp, Zea mays
  Clone ID: LIB3066-001-Q1-K1-B10
cccacgcgtgcgcccacgcgtgcgcggacgcgtggggtctcacagaggttcgcaagaatggaacctgcctctggctcaggcccgatgggaagacccaggtgacagtatagtaccgcaactagggtggcaccatggttcccatacgagtgcacacagtcctaatctgtactcagcacgacgagacagacaccaacgacgagattgctgctgacctgacggagcacgtcatcaagccagtcatccagaagcagtacctcgacgagcagacattctaccacctcaacatgtctggccgctacgttatagtcggacctaacggctacccc

SEQ ID NO: 46643 - DNA, 269 bp, Zea mays
  Clone ID: LIB3066-001-Q1-K1-A10
cggacgcgtgggcggacgcgtgggcggacgcgtgggcggacgcgtgggaaattaaagtatgccaggttctcgaaaaggatgtcagtgtattatgggtctatttggtaggatggctagaaacccaggctggaaacgccctggctagaggaagcaccggaggtttgtttgattgtagctggctaaaggtgacgcacaactctaactgctatttggttttcctggctataaagtctggccaaaggtggtgcacaattctaacaattgtttgg

SEQ ID NO: 46644 - DNA, 372 bp, Zea mays
  Clone ID: LIB3066-001-Q1-K1-A11
ggcatcggccagtgggggctctgaggccgagggaggcgaggaaagcggcgggtgccgggccgcccgcgccggtgccgagccgcccgcgccggtgccgaggccctcaccagtcaccaccccctcccctcttccgtctgtcccccgcttgccgccaccgccgctgcccgctcgcgatccttcccctttttaacgctcccgcggccccgcgtcgtgctcccttttgtcgccgctgccttcgtgcccgtactcgcgggttctcctcgctcctcaatctccgcgcctgggcgcggcgttcgccgccggatctgggcgcgggacggtgccccggacggtcgatggcgcgggcggcgctccggttgggcgaccgcgcgc

SEQ ID NO: 46645 - DNA, 417 bp, Zea mays
  unsure at all n locations
  Clone ID: LIB3066-001-Q1-K1-A12
cccacgcgtccgcggacgcgtgggtgtagccgttgagacttgggaggcaggcgacatgggtggcgggaaggacgacggccacgatccctcgaaggcggacaagggattccacggaggagggtacccggccgccgccggtggatactacggcggccagtaccccggcggcggctaccctgctccaccgggcggcggtgcgtaccctcccggccctgggtacccggtaccacctggtgggtacccgcctccgggtggctaccctcagcctggcggatacccgccgtcgcacggggcgtacccggcgccgggtgcaggcgcgtatcctcccagcgggtacccncatcaaccggtctacccacagcctggctatccatcgatgcccggtcatggtggcatgtacggaggaggccacggtgc

SEQ ID NO: 46646 - DNA, 413 bp, Zea mays
  Clone ID: LIB3066-001-Q1-K1-A2
cccacgcgtccgcctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggt

SEQ ID NO: 46647 - DNA, 438 bp, Zea mays
  Clone ID: LIB3066-001-Q1-K1-A3
caggaagaaaaattgttccaagatatatccactgtactatctgaactttctcaactacatgatggtttgagctatcctcttgatgttgaagctggaacaaatgatatttcaagtaatgagattgattgggctagaaagcgtaatgaacttttgacaaagcttcaaggattatgcaaatctatccgggtcacgttgtcaaatcatgttcatagagaagaacttgagttgtggccattgttcgataaacatttttctgtagacgagcaggataagattatcggtcatataattggaactactggtgctgaggttctgcagtcaatgttaccttgggttacatcagcacttagtttagaggaacagaacatgatgctggatacatggaagcaagcaaccaaaaacaccatgtttgatgaatggctaaatgaatggtggaag

SEQ ID NO: 46648 - DNA, 449 bp, Zea mays
  unsure at all n locations
  Clone ID: LIB3066-001-Q1-K1-A4
cggacgcgtgggcggacgcgtgggccattttttccctggtcgcccacttccctggtgctcgcccttgcacttccctggccgacgcccctccatggtcgagctcacccctgcagggtgcccctcccatggcgcctagtcctcttcccatgtcgagctcgcccaaccaatcgtctccatcgcaggtgctgtgttccccttccctttcctcaagtttggtcctcggcgcccaagcttctatgtccctacagcacgcacgacgttgcccctacccccatggtcggccgacctcgtcagtgagcccctggcgctaccctgcagctcgccctcaagcctagggtctcgctgttttcctttgccccacgcggatgctgtagccgggctatgtctctccctgtcgtagcaccccgcaaatgttntgtcgtcgccggtttgtcgtggaagaggaaagt

SEQ ID NO: 46649 - DNA, 363 bp, Zea mays
  Clone ID: LIB3066-001-Q1-K1-A5
caggaagaaaaattgttccaagatatatccactgtactatctgaactttctcaactacatgatgagttgagctatcctctggatgttgaagctggaacaaatgatatttcaagtaatgagattgattgggctagaaagcgtaatgaacttttgacaaagcttcaaggattatgcaaatctatccggatcacgttgtcaaatcatgttcatagagaataactagagttgtggccattgttcgataaacatttttctgtagacgagcatgatatagattatctgtcatataatttgaactactgttgcttaggttttcatttcatgatacccttgtttacatcagaacttatttaaaagttacat

SEQ ID NO: 46650 - DNA, 160 bp, Zea mays
  Clone ID: LIB3066-001-Q1-K1-A6
gagggtataaaatttcttctccaaataccaaccaaattcaggggttacctcttgtctctctctctctctctcttttccttttgattaaaagtaagtgaattaggcgagggtttaattatttattttgtcaaaacttatgtgagtcatgaaatgttgcatc

SEQ ID NO: 46651 - DNA, 454 bp, Zea mays
  Clone ID: LIB3066-001-Q1-K1-A8
cccacgcgtccggctggccacgccgcggggcagaagcagcagggcagccacagccctgacgccttgcgtcgaccttggaccctcttttggcgccaacaataggaggaggagcggagccacattccccgcgccgccgctcctgtcccggatgctgtcacccaccacgcggccggcagctcggactgacgagagatctggcaccagcccggagaagcccctgttgcgccggtgggtactacgggcgccgtcgggaggatctacgtggttagggttgcagtccccaagtgcgatgagatctagaacgccatctccgacggtgaggctgagctagcgcccgtgccggtgttcgtgtttatggattttgtggatttgaggatgctcgtagaccttgtgcaccgggtccggaacgatgtcggtgggaggtgaagcagagatgaaggagctgcccgaggag

SEQ ID NO: 46652 - DNA, 378 bp, Zea mays
  Clone ID: LIB3066-001-Q1-K1-A9
ctaatgtgcattcgccccatgtatacacaaataacgtttaccaaaaatcttgattacagatgtgttcctggtgagtataccgtacggttttgcttaggaaatggatgtgttcctaatgggtctgtcgtacggttttaccgtggtccattgaataatagtatctcacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaagggggggcccttttaaagggtccaagttttttttcccggggtttcaacccttaaacctttttatagggggccctaaaatta

SEQ ID NO: 46653 - DNA, 427 bp, Zea mays
  unsure at all n locations
  Clone ID: LIB3066-032-Q1-K1-H3
cccacgcgtccgaagtcagcttcagcttgctaaacagtttcatggcgagacttggagcatgaatacttcaggtacttatcatgtcatatcagactcattttttggctcatttattactgaattaaattgggatgaaagtcgaaatgcaaaacttttagatggaatgcagatcttctgatcttcatttggttgctccttcagtgaagccatcacatcagacaaatggcaatcatggcattcaaacttaacttgttagctctcctgtgagcagcatgaagccggttctcctttgattatcaactggcttctgttcgtaacagatttggcatgcagtggcaacttggtcaagcatagattctcttgagtccaaccccagtaggaatcaaatcaagatgcttcacanaatatgaaaaactggtgacacaag

SEQ ID NO: 46654 - DNA, 439 bp, Zea mays
  Clone ID: LIB3066-032-Q1-K1-H4
ccaggcgtccgcacaggcaagggcgcaaccaataatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcgcccaccagcgcctcctcggctgcgttcccggccgtcggcgccgtgctgagcgcctccgtgctctccttcttcgcctactacctgcagtaaaattaaaggaggatcggagggagaggctgctggctgccattgcctgtattcggttggatcccgtttatatatatatatatatatttaagtactttaatttgggtctgaacatgt

SEQ ID NO: 46655 - DNA, 112 bp, Zea mays
  Clone ID: LIB3066-032-Q1-K1-H5
accacgcgttcgccttatcaacttccgtaccgttgagtacccccaaaggcacgggtcggatcatcttcactgaatgtcggaaattctagaaccgtacccacactacataatc

SEQ ID NO: 46656 - DNA, 332 bp, Zea mays
  Clone ID: LIB3066-032-Q1-K1-H6
cccacgcgtccgcccacgcgtccgcgtcgccaacgccaataaatacacccgcgggtgcgagcccatagaacgctgcaggggcgcgcgctgatcaccaagcatatacatatagcacatcgatttcttattattgcatgcacgtttatataagtgctcattgtcttgctgttgtaagtgccagcacaagcatatatacggcgtttatatatactacatactccgatcgttcaaaaaaaaaaaaaaaaaaaaaaaaaaaaaaaaaaaaaaaaaaaaaaaaaaaaaaaaaaaaaaaagaaaaagaagagacccttgaccaaaagaaaaaaagaaaa

SEQ ID NO: 46657 - DNA, 366 bp, Zea mays
  unsure at all n locations
  Clone ID: LIB3066-032-Q1-K1-H7
atcaacttctggacggcgggcatcgagggcgggtggggctggcgcatcgggctggggctcgccgtccagaagttgatcaggttcgccgccaggatgccgatggtggtcatcagctggaacccgatgttgaccagtgcgtgtgctcatccgtgcacgccggcaatggtgtcctccgcccgtgcgctcatcggcctcctcgtcgccgcggcctccctcgccgtcgcgctctcggatggcggcgggatggcggcgcctgtgtacgggtacgcggcggggagccccaacgggccggagaactgggggaagctgagccccgcgtacaagctgtgcggngaggggaagcagcagtccccgatcgacatcgtc

SEQ ID NO: 46658 - DNA, 442 bp, Zea mays
  Clone ID: LIB3066-032-Q1-K1-H8
cccacgcgtccgcgatcacaataagatggcgtgtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccgggcaggggaaagctcga

SEQ ID NO: 46659 - DNA, 357 bp, Zea mays
  Clone ID: LIB3066-032-Q1-K1-H9
agaacgcctccgtagagttcttcgatatcactggtctctgcaacgactcatccaactacggggagatcgataccgacgagcagatcggacaccgcgcactatttctgcaggaccgcacgcatatgatcatgtaccagatccttgtgtggacgctcatacggctggagctaggcatgaactggactggctacatgtaggatcaatacgccatgggcatcgagctgatagagtacgtgcaccgtgccgagcttacgatagctggtgggcccattgagtggctggaccacatcgagatctacccggtggcctagcagtaggcagggatgtgcgtcacggcaaccgaatacatgtacttca

SEQ ID NO: 46660 - DNA, 230 bp, Zea mays
  unsure at all n locations
  Clone ID: LIB3066-033-Q1-E1-A1
gatctgtatggtgattgtaagatcgataattaggttcagtgagcgcgatngactcgattgtttgactggctcgaatttcgataatttgcataagcctgacgtaatacccgcctaccttccgcgctgaatacgcggcgaaaaaaagggaaacacacacgagtaccccccgcaccccccggttagccgcagtcgccatcattatgcaaatagcatgtaaagctgcctgtacc

SEQ ID NO: 46661 - DNA, 429 bp, Zea mays
  Clone ID: LIB3066-033-Q1-E1-A10
ggttggaactttgggctgtttatgtgctgccggtttcttctattgtgctgcgcttactcagacttaaagtctctctcgcggtacgctgtagttacggtgaagaatcatttgattgcgagtgttgagcatagtgaggtcgcggataaggttaggtgtaagtcttgagtttctactgttgagaagagtcgtgttttgtctacgtcttgttctgtgcggtatcttgtggggatgcctgatgcgctgctgaggattggtggcttacctggtatgacgaagtactagctggaaccggtctatggtgtcaatgtggggtcggatactgtggcgtggtcgtctgagtttactaaggaggagcctttaacttccctccatgttgaccctcattagtctgtgggagccgcggttgcggaggctattggcgggttcgag

SEQ ID NO: 46662 - DNA, 474 bp, Zea mays
  Clone ID: LIB3066-033-Q1-E1-A11
ggcttggaacctttgggctgatttatgtgcttgtggatgtgcgggtggatgtgcgggttactccttcttgttattacgtctactgttggggaggatcatttctccttctcttcctctttctctttctctttctctttcgcggccgatcattgggctgctggtgaagggtgaatgatgttacgttggtggacttacgtagggtcggacttataaaagtcggacttgcggagggccggacctctcccgcagggtcggacttacggagggagcgtatggtgtctgctgtttagtctgaggcgtgagggtacgctcattcatttgaggattcatgactctacttacgtggatctggcacctatttcgcataggaatagggagaagacttcttcggccgctaagatgcaccggatcatttacgaagttacgattaaaactagcagtaggatcgctaaactcaccaacgacacgaaagaa

SEQ ID NO: 46663 - DNA, 387 bp, Zea mays
  Clone ID: LIB3066-033-Q1-E1-A12
ggcttggaacctttgggctgatttatgtgcttgtttatgtgcttgagactgtgagtggttctttcccccccccccccccccccccccctggtaggtaagtcaacgcagttacaaacgggtaaagacaacatagtaccctcccggcacataagcccacttccttgcacgatagaaccttagtccacgccggaatatcctcaagcccgcgttgtaactaatatcgtatactctacccaaaaaatgaaggttcaacagacgcagaaaccaaatcaaaactcgaaagtcctataaaacgcccgcacttgtcttctcagtacccccggcgccgcaaattatattctcggccattccaatcagaaataagtaatcaattcgcacaccaactcg

SEQ ID NO: 46664 - DNA, 330 bp, Zea mays
  unsure at all n locations
  Clone ID: LIB3066-033-Q1-E1-A2
gcttgtggatttgcgggtcagcctcagactgttgagtggtttttccccccccccccccccatagtgaatgggttctgtaggttctgcgtccctagtctacgcaccatagcacctttcacggtttgcgctaagtatgtatgtatcacacaaaacatatccacacatacatacgatgcgcatcatgataatgatgaagaagaacgaatagtcagtagatgcattggtggttgacctataagcgcatagaaaatgactgatcttatcttaatcacatacacttcatcacggtcnccgtcataatttgacggactaaaaagtacgtacgtacgc

SEQ ID NO: 46665 - DNA, 317 bp, Zea mays
  Clone ID: LIB3066-033-Q1-E1-A3
tggacctttgggctgatttatgtgcttgtttatgtgcttgggcgaatggcaagtcaagtgaggagttcgggccggcgaatgtaagtttgcatgagaaggggcggaccactaaggctaagtctactgacctatgtgagtctagcctgtctacggacggcgataagcatctgaaacctcgtgaggaagaagattgctaccgaagaaactagagggctcctcgaatattaaagattcgcgctctaagtctcactagcgtccctcggctcggagattcgtcgcgataaacccaaaccggttaggcctaccgtacggaacaa

SEQ ID NO: 46666 - DNA, 360 bp, Zea mays
  Clone ID: LIB3066-033-Q1-E1-A5
tgggctgatttatgtgcttgtttatgtgcttggtagtggaggtggttggtaagttcgagcggggttatggcgggttgattgatgtcggtggtcataataatcggttggaggatattgctcctccttgtggtgataatggcgggcggagtattgagcatggtgatcctccttcgctgcggcatctgtagacgtcgtcggagtatggtgattgtacttcgctgggtgttatgcttgcgcctggtgtggtgtttgcggaggctcttgcgaaggcggttggtacttatcggtatcatggtagttggctttatgtttttgagtctattgtgggtcatcataatatgtggtgttatgatgggcatt

SEQ ID NO: 46667 - DNA, 128 bp, Zea mays
  unsure at all n locations
  Clone ID: LIB3066-033-Q1-E1-A6
cataataatgggttctaatatattgcncctccctgtggcgataatggcgggcggagtattgagcatagtgatcctccttcgctgcggcatctgtagacgtcgtcggagtatggtgattgtacttcgct

SEQ ID NO: 46668 - DNA, 175 bp, Zea mays
  Clone ID: LIB3066-033-Q1-E1-A7
tagtgcgtggaagtttaattaccttttcttagacatcttgcgatattatgtgatgcggggatagattcgcatttgcctgcttattcttcctttgatgggatctcgcctactcctgttaatgattgtcttacttcgcctgattttaagaatggttaggctgcttgtgagccttttg

SEQ ID NO: 46669 - DNA, 307 bp, Zea mays
  Clone ID: LIB3066-033-Q1-E1-A8
atggaagggttgggttgatttatgtgcttgtttatgtgcttgaattaccgccggatctgccttttcttcgtatgtaattctactcggctgcgtagacttaggacggttgcttcttccgagattccgttcttttgagcgtctctggcgagtcatcccgccctgacccactaagaaacttgcccgtcctacgccgcgtaggtctacactcgaccgtcggacctggtaaatttgtgccggacttcgcactggccagcttccgttcgtaaggactccgccgccccgccccggcggctgagtactgtacgcc

SEQ ID NO: 46670 - DNA, 414 bp, Zea mays
  Clone ID: LIB3066-032-Q1-K1-H2
cccacgcgtccgaaaagttatgggcttcagtttcactgtgcattggatatgtaactttctggtgggactattttttctggagcttgtgaacaagtttggggttggagcagtctatgcaggttttggtggggtctccctgctgacagcactctttgcctacaatttcatagttgaaacaaaaggacgttcgcttgaggaaattgagatgtccttgagcagtgctacccctggcaagcaagagtagaacatctcaattgtatggacaaactgaacaactgacgggaggaatttaataagagcagagggggcctaatcccatgaatcttcagcagcagcagtttgttgcaaacaacatcaactcctatagataatgagcacaatcaaattcagcttttctttggtagcatgagaatc

SEQ ID NO: 46671 - DNA, 324 bp, Zea mays
  Clone ID: LIB3066-033-Q1-E1-B1
gggaaaatgtaagatttcagtatttttgttttgctgttgatggttgttggagcagagagacggtggcggatgaagcgaatctggctcatgctggtggttcctttcatgaggttaatgaggagacgtcctgtgatgttcctgggcatcatggtattactgctcttgctaaggcgaccaacgactacgtcgctaaaggtaagcgccacggccccgccatccctatctattttagagtcgtcgagtaagtaaccgtgggtacggatggtaagaaaccacgtaattgcaccgcctgagcaaacgaagcgtgcataagagtttttgtga

SEQ ID NO: 46672 - DNA, 438 bp, Zea mays
  unsure at all n locations
  Clone ID: LIB3066-032-Q1-K1-F9
cggacgcgtgggcggggaggtgtccggggtcacgctgctcaactccaagttcttccacatgaacatgtaccagtgcaagaacatgctgatcaaggacgtgaccgtgacggcgcccggggacagccccaacacggatggcatccacatgggcgactcatccgggatcaccatcaccaacaccgtcattggcgtctgcgacgactgcatctccatcggccctgggacctgcaaggtgaacatcactggcgtgacctgcggccccggccacggcatcagcatcggcagcctagggcggtacaaggacgagaaggacgtcacggacatcaacgtcaaggattgcactcttaagaagacaatgttcggcgtccgcatcaaggcgtacgaggacgccgncttcgtgctcaccgtcttcaagatccactacgagaatatcaagat

SEQ ID NO: 46673 - DNA, 324 bp, Zea mays
  Clone ID: LIB3066-032-Q1-K1-G1
cccacgcgttcgcccacgcgttcgcccacgcgttcgcggacgcgtgggttttttttttgtttttttttttttttttttttttttttttttttttttttttttttttttttttttttttttttttttttttttttttttttttttttttattttattaatttatttttataatggttaaatgatatttgaaattgagaaagaatggttgttgctgctgaataaatgtacattgagattgagattttgtttaaaaatgtttaaagttcaaaataaccgggtactgatgggaggacaatattggagatttttaaaaatgctgtaaaa

SEQ ID NO: 46674 - DNA, 271 bp, Zea mays
  Clone ID: LIB3066-032-Q1-K1-G10
cgtcacgcgtcggctgtcgcatccgcggctttccgcgtccgggcacgcattccctcacgcgtgcggggaattgtcggcgggaccaggaccatgccatgacggaggctgtagaccactagcgctgctatacggacagtggcacatagcaaattgcatcgggacgtgaaccaatctgtagtcgcatggcgactgcaccttgaatacatggtgccacattatgacatacaacctaggtacgagcactaacctggtcttgacgcagaatttgtgg

SEQ ID NO: 46675 - DNA, 439 bp, Zea mays
  Clone ID: LIB3066-032-Q1-K1-G11
ggcatttcatttgctcaaccaagctccaatatcagcataagcgacatcacaggggagacaagaggtggttcacggattgcctttggaagtgagatgtcaggtggcatatcggaagtacgggctgagggcctccgcattgtcaactcccttcacgggatcagaatcaagacggccccggagcgcggagggtacgtggagaatgtgtacatagcagatgtgagcatggacaatgtttcgatggccatcacgatcactggaaactacggtgaacatcctgatgacaaatatgacagcactgctctccctgtgataagcaatattacaatcaaggatgttgttggcgttaacattggggttgctggtatattggaaggcattcagggggacaatttcagcaacatttgtctgtccaatgtttccctcagtgtgcaatctgcac

SEQ ID NO: 46676 - DNA, 402 bp, Zea mays
  Clone ID: LIB3066-032-Q1-K1-G2
ggaccaggtaagcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtgggga

SEQ ID NO: 46677 - DNA, 334 bp, Zea mays
  Clone ID: LIB3066-032-Q1-K1-G3
gcggtggcggagatgtacctgctgggcatgaccgacaagatcgtcaccagcggctggtcgacgttcggctacgtcgggcacggcctcggcgggctcacgccgtggatcatgttcaggcctgagaaccacaccacgccttacccgccgtgccgccgggccaagtccatggagccgtgcatgcacgggccgccgttctacgactgcagggccaagcacggcgccgacacggggaagctggtgccgcacgtccagcactgcgaagacatgagctgggggctcaaacttgtccatcccgagtgaaacagcaataataatgaaaaagaatatctttttt

SEQ ID NO: 46678 - DNA, 395 bp, Zea mays
  Clone ID: LIB3066-032-Q1-K1-G4
ggaacgaagatggcttgtttattagttcagttgcctccagctcaaacctgtgggctttaattatggatgctggcactggttttacatctcaagtatacgaactttctagttactttcttcacaaggaatggataatggaacagtgggagagaaatttctatatcactgcactggctggtgcgaataatggaagctctttggtgattatgtcaagaggaacacaatatgcccagcagtcctacaaagtaagtgatacatttcctttcaaatggataaacaaaaaatggaaggagggcttctatgtcactgctatggcaacagctggaagccgatgggcagttgtcatgtcccgcaatgctggtttcacttctcaggtagtggagcttgatttctta

SEQ ID NO: 46679 - DNA, 414 bp, Zea mays
  Clone ID: LIB3066-032-Q1-K1-G5
cggacgcgtgggcggacgcgtgggcgacaagatggcgtgcacagacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtgga

SEQ ID NO: 46680 - DNA, 418 bp, Zea mays
  Clone ID: LIB3066-032-Q1-K1-G6
aaaaaccagcagctagcgatggctggagcccgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccgccgacaacctcggcgcctgcaagcgcgccatcggcttccgcgacgccgtcaccatccgcgccacgatgagca

SEQ ID NO: 46681 - DNA, 441 bp, Zea mays
  Clone ID: LIB3066-032-Q1-K1-G7
cccacgcgtccgcaagatcagcagagccgacgtcaagtacccgcagtggttctcccctgagctccggcggttgatgcccaagctcctcgaaccgaacccaaacaacaggatcacgatcgagaagctggtcgagcacccctggttcaagaaggggtacaggccggccgtcatgctggcacagccgcacggctccagcagcctcaaggatgtccaggtcgccttcagcaacgccgaccacaaggacagcagcaccaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaaaccggcgtcggcgatagtgtcaaagctggagcaaatcgc

SEQ ID NO: 46682 - DNA, 421 bp, Zea mays
  Clone ID: LIB3066-032-Q1-K1-G8
tcgaaatcctctccctctgagctagatctttgttcccatccatgctgacgcacctgcgctacgcattccgtgctgaaatccttccctgccctaaattccgtcgatggaagtccgaagggagcacagagtagaggtgaaattcatgccaactcatgccaactcgttctagccgtggagccgcgcccgaggaggaccgctgtggtctgccgaggccggccggttgggcacgcgccgcgttgggatgcatggttgctggggccagaccgcgcccgcccctgcgccggatccgaggccgaggccgcgcccttgcccggaggcagagcagttcgctgctcgtggccacgcggaggccgagcgggcctgcctgcgcgcgccgggtggcgaggccgaacactactcacatctgtgtacatgcagtcgc

SEQ ID NO: 46683 - DNA, 438 bp, Zea mays
  Clone ID: LIB3066-032-Q1-K1-G9
cccacgcgtccgcagcttctcggcttatggtgccagagccagaccgacgtgcctagtagcggactatcttagcttcaagagaccgacccaggcaagatccattgatcgatggagctgcttcctctgctcacgtggctcctccttgcgcacgccctggcctgcctggcctggacggccgccgcgcggcgccggcagtctcggtgctacctcctggactacgtctgccacaagcccagcgacgaccgcaagctgtccacggagacggccggcaacgtgatccagcgcaacgcgcggctggggctcaccgactaccgcttcctcctccgcgtcatcgtccgctccggcatcggcgaggagacctacgccccgcgcaacatcctggagggccgcgaggactcgcccaccctgcaggacgcggtggacgagatggacgccttc

SEQ ID NO: 46684 - DNA, 340 bp, Zea mays
  Clone ID: LIB3066-032-Q1-K1-H1
cccacgcgtccggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaagttgttggcactgataaggagaccaccacccaaggccatgacgaccttggcaagcgctgcgccaagtacta

SEQ ID NO: 46685 - DNA, 326 bp, Zea mays
  Clone ID: LIB3066-032-Q1-K1-H10
gaattcccgacccacgcgtcccgtccagcatcctcagccacagaaaatgctctgtggtcggatggcacattcttacacgtcacgtattgacgagcaactcatgcacagttctatttatacccctggatcaccctatacttgcgatgtccctatggtacaagaggccatagacgccatatgtaggatccacggatcatcaccagatgagaagatagacatcacctaagctattataaagaggctcgactggatccaagcccgcactctttgctggcatcatagcactggtgatgagcaatctaaccatgatccgaatgacccgcaga

SEQ ID NO: 46686 - DNA, 376 bp, Zea mays
  Clone ID: LIB3066-032-Q1-K1-H11
cccgccggggcggctagtttaacgcgcgctcctgccgacgccgcactcgcccccggtctcctcccgcctcccagatctcgctcgctcggcgccagttgcctcgcagtttggatcatctcatacctcggcgaagatgagggagatcctgcacatccagggagggcaatgtggcaaccagattggcgccaagttctgggaggtggtgtgcgatgaacatggcattgaccctaccgggcggtacactggcaattccgaccttcagttggagcgtgttaatgtctactacaatgaagcctactgcggacgctttgttccccgcgctgctctcatggatcttgagcctgggacaatggacagtgtccggaccggaccctat

SEQ ID NO: 46687 - DNA, 408 bp, Zea mays
  Clone ID: LIB3066-032-Q1-K1-F8
cccacgcgtccgcatcgatcacgacatgatggcgtgcacaaacaatgcgatgagagccttgttcctcctggtcctcttctgcatcgtgcatggtgagaaggaagagtcaaagggcatcgatgcgaaagcgtccaggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgt

SEQ ID NO: 46688 - DNA, 207 bp, Zea mays
  Clone ID: LIB3066-032-Q1-K1-E11
ctgacgcgttggcggacgcgtgggcgtactttttatctatatcagtgggagctaaatgacgggagggaccatatctacccacggacggtctctcacggtcattactgggggcagcgccatgatgccgttgtgtatattctacgttcacatagtggtcgtcgtacacatccaccacttactccaggagcgctacttctgtgacaaata

SEQ ID NO: 46689 - DNA, 445 bp, Zea mays
  Clone ID: LIB3066-032-Q1-K1-E12
ggcatcgccaagcagagctaccagctgcgcatctggctcagcgccgtgatcgcgaacatggagacgtgcgtcgacgggttccccgatgacgagttcaaggccaaggtgaaggagtcgttcaacgatgggaaggagctcaccagcaacgccctggcgctcatcgagaaggggtcatcgctcctctccgtgctaaagggcggctcgaaacgacggttgctcgaggaggagggagaaccggcgcaagccgggcctgcactcgacaaggacggcatcccggaatgggtgcccgacagtgagcggagggtgctcaagggccgcggcttcaagagcacactcacgccaaatgtggtggtggcgaaagacggcagcggcaagttcaagaccatcaacgaggcgctcgccggcatgccaaagacctacgactgaagatacgtgatccaagtga

SEQ ID NO: 46690 - DNA, 374 bp, Zea mays
  Clone ID: LIB3066-032-Q1-K1-E2
ctacgtcgagcccgaggaccgcaagggcgtcttctggtacaacaagaagttctagccgccgccgctcgcagagctgaggacgctaccgtaggaatgggagcagaaaccaggaggaggagacggtactcgccccaaagtctccgtcaacctatctaatcgttagtcgtcagtcttttagacgggaagagagatcatttgggcacagagacgaaggcttactgcagtgccatcgctagagctgccatcaagtacaagtaggcaaattcgtcaacttagtgtgtcccatgttgtttttcttagtcgtccgctgctgtaggctttccggcggcggtcgtttgtgtggttggcatccgtggccatgcctgtgcgtgcgt

SEQ ID NO: 46691 - DNA, 384 bp, Zea mays
  Clone ID: LIB3066-032-Q1-K1-E3
ctggcttgtatccctctctcgtctctccagcgacggcagcgggcgagggttacgcgaaggcgaagcggagtagtggaagcagaggcggcagccatggccgtgatggagaagctcaagatctttgtcgttaaggagcccgtagtcgcggcctcctgcctcatcgctggattcggtctctttcttccagcagttgtccggccaatcctggattcatggcagaccgcggaacaagttcctccacctcttctaaatgatgtggttgcaggtgtcaccggcaagaaaaagtagtgaacttgcattgttttctcatgccaatgttgccccacattttcttccccgtgttttttctggcgaccagattggaaggcttttcccaagagtcac

SEQ ID NO: 46692 - DNA, 401 bp, Zea mays
  Clone ID: LIB3066-032-Q1-K1-E4
atcaaatccacggtttaataacgaaccgtgttaacttaccataacaacaactcaattcctatcgaattccttcctatcgaattcctatagtaaaattcctataggatagaacgtacacagggtgtacacattatatatgaatgaaacatattcattaacttaagcatactcctttttttatttaatgagttgatattaattaaatatctttttttttagatttttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaggattataaattgacttactacacccccgagtacgaa

SEQ ID NO: 46693 - DNA, 404 bp, Zea mays
  unsure at all n locations
  Clone ID: LIB3066-032-Q1-K1-E5
gagacaagcggcggcagcgagcagcatgccccgccggaagacgagaacaaggagaaagagcggcagctggccaaggagaaggcgtacgcggcggagaaggtcgtccagcaggagatgctcaagtacgccaaggagaagggtctggtgtccccgaccaacggcacggggtggtacaggggcatcgcccgggagttcgtggacgcccacaacgagctccgcgcgcgctacggcgtgccgcccatgaagtgggacaaccagctggcgcggcaggcgcggcgctggtccaacgccatgcgcaaggactgccagatccttcacagcggccacgagtacggcgagagcgtgttcaggagctacgacgactggaacgccaccgncagggaagccgtcttctggtggggcaa

SEQ ID NO: 46694 - DNA, 392 bp, Zea mays
  Clone ID: LIB3066-032-Q1-K1-E6
cggacgcgtggactctaatactgtgctgtattattttcatggcacctgtggccattaaagatccatggacacgtacagtaccaatacatgattcttcacagttcaaaaaaaataaaaataaaaacaaaaaaaaaaaaaaaaaaaaaaaaaaaaaaaaaaaaacaagtaataaaaaaaagatataaaaggatcacaaagacaatgaaccatgatagtgccataaactacatatggcaagcgcctttgaactgcctcttcaaacttcaccgtgaagatcgacaacattggtgctgcatatgcccaatccgaggtacttgcaacgctaagaggacactatggtactgcgagacgagtagcttggaccaatccaaagtatggtgcaatacttgcat

SEQ ID NO: 46695 - DNA, 439 bp, Zea mays
  Clone ID: LIB3066-032-Q1-K1-E7
agataattggaagctgcttcagcttcttgactgtgtcttacactagtaaatttcttgtctacatcatgatacattaataccttcttaaaatctatactgcatggtactttatataaattactttgattgtatacattatctaaataatacactaaaggtaaaaaaacgatttttttatgaattcagttaattcgtatatatacaaaaataaagtaagaaatgtgattaagtttgaaatgttagttttacgattgtgccacttggtttatgaatatctgtgtatgtacttttaagagtaaaacaacagcatgttaaggcctaagtgcatctaagttattctatatttattgatcataattaacaataaaacacgaggaagctgcaaattgtttcattattttcttcttcgtccgatgtagcattccatttatgtgtgctc

SEQ ID NO: 46696 - DNA, 427 bp, Zea mays
  Clone ID: LIB3066-032-Q1-K1-E8
aggaatttgatcttcgagtggctttgcctctgggtgtgctgaatggtgctctcaacgccggagtggctgcgggagtcatccatccattggaaaggggatctgcaggatctgtctcaccacttgtagaaagatttaacttgggtggtaatagggctctcgtgtgccgcttgggtggaccatcttcactattaggcttcaaaacaagagggctacgggcagcaacagagtccagaacacatgaccccaacactcctggcaatggcacttccccttcccctgagctaaatggtcttggaggtgaagtagcggtgacagcctttgccgacctgtcatttgatctgcctctgaagccgctcagggagctgggaatccatggtcatgcttttgtctgtgctggaaatcttggtagattaacggaatgtgatct

SEQ ID NO: 46697 - DNA, 293 bp, Zea mays
  Clone ID: LIB3066-032-Q1-K1-F12
ctgacgcgtggccggacgcgtgggcgaggatccccggtctgcaaggcttcgctgcatgcagaccagcacttggcagtgccgaccggatcatgaaaacttgtggattatcatcccactggtggctgtattggcttgattgtgtattgcaccttggattgtaacttgcaagatactctagccatgagctgtgtgcaacttgaatttataaacacaacatataagatacaattgacgcacgtgcactaactgccattccagcagagcttgtagaatgttataaaacataaactaac

SEQ ID NO: 46698 - DNA, 339 bp, Zea mays
  Clone ID: LIB3066-032-Q1-K1-F2
cccacgcgtgcggacaattatctcgtaacctttcgggctcctcttcctatcctcgcgtgcccccaccaaaccctaatccgagcacccagcgttccaggccctacccgcttcctctcgcgccggcctttggggctctcaccctgagcggtaggaatccgcagggctccagttgggtgccagaagcatccaagtcgttggcgggagaccgggaaatggcggaaaaagagggggcgaacgttggggcggaagagatggaagagcgggagcaggaacgggaggcggatgacgtggacgtgaagattcgacgattcgacggctgcgacatcggccccgagcgct

SEQ ID NO: 46699 - DNA, 366 bp, Zea mays
  unsure at all n locations
  Clone ID: LIB3066-032-Q1-K1-F3
ccaggatcatgtgggaccagctccgatgaagcttttccatttttcttaggcatgcaactccgatgaagctgctggccatgtcgtcctccgccggcctatttccatggccacgacaaaattgaggatcggttaccacctacctgcgtccatcggatgaacctatgtcgctgctgcttaactgcacattgagattgagattgtgtggttgtcgctgctgcttaactgcacattgagattgagattgtgtggtgttttgtttcaggttcagcctcaccgnctactgtggggaggacaacattgtagttntagactgctgctctacaagtacctactggcctacttcattttcagggtgcccttatttct

SEQ ID NO: 46700 - DNA, 390 bp, Zea mays
  unsure at all n locations
  Clone ID: LIB3066-032-Q1-K1-F4
cccacgcgtccgcccacgcgtccgcggacgcgtgggttcggctgccctggtgttgccagatcctcgacgcattctccggggttcccggccaccggtgtcgcggtggtgaacaaggggatgggcgtatcgtatccgtcacacagtangccggacgtgctgtctagtccggggacgccgagctgcaatcggcgtgggatggcaggcgttggctaccagcagggtcctcgttcagaaagagtgatcccgccttggaccggccatacaagccattctgggagcggcatggtgttaccttacagcactgggactgggaggacgctgccatcgaaatgggaggatgcagagaggtggatcttcagccccaaccccaccccaacaatgcactcggga

SEQ ID NO: 46701 - DNA, 448 bp, Zea mays
  Clone ID: LIB3066-032-Q1-K1-F5
cccacgcgtccgcccacgcgtccgctcttcggtggagataaataccaggagatgaggatgaaggtcttagaaattaccagaatataagttacgtaaagaaagaccgtcgtcaaaaaccatctccacatcaccaaatggataaaccatcaaaaagcattctagcttaatcttggacagaataattttcaaagcattatcataatcataatatctcagccatactctagaaagaggttttaccagatacgatatggatccatggcaaaagccaattccaaagtgcatttcaacaggggctgcaaatgacaggcaaacactttaaaaggatctatgggacatcagtggcaaacactttaaaaggatctatgggacatcagtgcatttcaagccatcatccttcatggtgcaaacctattaccaaagtatcagatttttttatagcattttt

SEQ ID NO: 46702 - DNA, 261 bp, Zea mays
  Clone ID: LIB3066-032-Q1-K1-F6
ggaagtgtggatgtcaattgtggtgcatgtgcttgggtctagtgctacaaactgtggagcacccattccaagttgtgtagtgggtttcgggtgccttggcgaatgcctttgcatcctaacacctaaagtggcggacattgcgtgaggctggcttcacagagcagcgagtaccgcccgccaccagaggtggaaggataatgagccgctatgctctaggccaattagggaacatgtgccctctatggtagaccactatctttt

SEQ ID NO: 46703 - DNA, 353 bp, Zea mays
  Clone ID: LIB3066-032-Q1-K1-F7
cggacgcgtgggcgtgaacaacgtggatgtgtccgggatcactctgatcaactgcaagggattccacatgaacatgtacaagtgcaaggacatgctgatcaaggacgtcaatgtgacggcgcccggtgacagccccaacacggacggcatccacatgggcgactcgtccggggacaccatcaccaacaccgaaatcggcgtctgcgacgactgcatctccatcgaccccgagacctacaaggtgaacatcaccggcgtgacctgcggtcccggccactgcatcagcatccacagtctagggcggtacaaggacgagaaggacgtcacggatatcaacgtcaatgactgcacgc

SEQ ID NO: 46704 - DNA, 427 bp, Zea mays
  Clone ID: LIB3066-032-Q1-K1-E10
ccccacgcgtacggccacgcgtccgcaagatcctgttggagttcaaggaagaaaaatcttaggacagggaaaatatcgatgccgcgagagcgtgggctggtcccttgtctgggaatcgtctcgttgttgctctgaggaaccgctgatcagatactgctaacgttacaatgaaactgccagcaataagccttgatgggtatgctgcctattctgttagggatctgtggaagcatgaaactctatcggaaaatgtcgtacgaacttttggcgctcaagttgacgtgcatgacaccaagatgtacatcttttctcctgcaaccattgtcgcttcagttcgatcaggaccggtggatccaagatgacagcaccgctattgttcaaggatatgtcacgacaacaagcgccttcggttttcctgctgcattct

SEQ ID NO: 46705 - DNA, 306 bp, Zea mays
  Clone ID: LIB3066-015-Q1-K1-B10
gaaaatagtgggatcgagttgtttcactgcacgagcacatcctccggcgaccgccggcctgggtctccgtcctctagcgaccgaccaacgcgccgagcgaagatgtcgtggcagacgtacgtggactagcacctgatgtgcgagatcgagggccaccacctaacgtcggcggtcatcgtcggccacgacggcgcaacttgggctaaaagcaccgggttccccgagtccaaccccgaggagatggctgccataatgaaggatttcaacaagccggggcacctggccctgaccggcctgatcctggga

SEQ ID NO: 46706 - DNA, 352 bp, Zea mays
  Clone ID: LIB3066-015-Q1-K1-B11
tctttctcacaatcttacgatctcgagttttcagactcttggctcatactacttctaagtgacatttgcctatgttacaagtatctactgatgtattatcttatctaacatttacagaaagatctacatatactattacctgatcttctaaacctatgcaaaactactcttatccacattcataataacaaactattgatacacctccattcaaagcaccacctcaacttaaatcaactcatcatctacaagatcaattttaaagcattcaaactagacgttcaacatatctctctccttatttttaatgattactactcaaatcttgatgatgtattatacattttaaatt

SEQ ID NO: 46707 - DNA, 331 bp, Zea mays
  Clone ID: LIB3066-015-Q1-K1-B12
cactcaccccgccttcacgccgtccttaccaaataaaggcccggccttttccgacattcacagggggggccggaaatcaaccgccattgcctcgattcccgcgaccaccttcgccgtcatcttatccgtcctcttctgtgccgcggcttgcaccggcgtcgacaaccaacttcccgactacctcatacaaggccgcgtctactgcgacacctgccgcgccgggttcgtgaccaatgtcaccgagtacatatcgggcgccacaatgaggctctagtgcaagcacttttgcaccggcaaactctagcgcttcattcaacgggtgaccgacacc

SEQ ID NO: 46708 - DNA, 422 bp, Zea mays
  Clone ID: LIB3066-015-Q1-K1-B2
tcgaataagatggcgtgtatagacaatgcaatgagagccttgttccttttagcgctcttctgtgtcgtgcatggtgagaaggcaaagtcaaaggacaacgatgcaaaagcgttcgggcccggtgggtccttcgacatcaccaagttgggcgcctccggcaatggcaagacggatagcacgaaggctgtgcaggaggcgtgggcatcagcgtgcggctgcaccggtaagcagacgatcctcatccccaagggcgacttactcgtcggaccactcaacttcacaggcccatgcatgggctacgtgaccatccaggtgaatggcaatctgctggcgaccacggacctaagccagtacaaggatcatggtaattggatcgagattctacgcgtggacaaccttgtcatcaccggcaagggaaaagc

SEQ ID NO: 46709 - DNA, 389 bp, Zea mays
  Clone ID: LIB3066-015-Q1-K1-B3
ggaagatgcgcatgatgccttcttgcctccctcattctcgctcgcccccattccaccttcgacgaccccggtctgcttgtccctcctcaatcacctgcagcgaaaaggaaaagggtgtcagaccgcaactaagagctatttagcaataatacatacatagctataccctctttaggtcaagagggtggagttctccttattcggaggaagagctccatcctcattctacaagaccaaaccaataaatggcctctagcccacagtcctcgccatcatactccaagaagtcgccgccaccacaagaagcatcagctttggcgccaaaatcatcttcaaagtcaccctcgccaccaaagggtgaatcaaattcatcgtccagtcccccatcg

SEQ ID NO: 46710 - DNA, 379 bp, Zea mays
  Clone ID: LIB3066-015-Q1-K1-B4
atttaagaaatttgccgcttgatgtgtggatccgccgtggctgccgtcaggcatagactcggggaaccggacctcggtggtggatcatcggggtcgcggaggtctactggatggggtctagaagtatccgggcaagtcgtctctgggaaccctgcttattgctcgccgatatgttttcaggcgtcgcgatgcagctgagtgccatggctgggtctcattgccgtcttcaatagaggtgaggccactaggatctgaagaatcaccctggtaactggaatctcaagtgccaggtgtgacagccgacgtcgacccgagacttcaacgtcttcccgtcgtcctccatgtgctcccgggttcgcactcatggagaagaataggt

SEQ ID NO: 46711 - DNA, 352 bp, Zea mays
  Clone ID: LIB3066-015-Q1-K1-B5
catgtgacgacctctcctcctcgctgtctctctgtatctgcaactgcaagcaaggaaattggttaaaagaagatcggcgccatggcggcaacgacgacgactgggatgcagatgatgcaggtgcagcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacatgcagcacaag

SEQ ID NO: 46712 - DNA, 455 bp, Zea mays
  Clone ID: LIB3066-015-Q1-K1-B6
tcgcggactcgtgggctgcagtgtatacaggagataagcggccatctagcagagttgcgaagaggtgtgactcgctaaggaaaatggttttgccccgagtccacactgttaggtcatcgtgaggtcttctcatgcagcagactaacgagggtgcttccagtgagtgcccacaatcccatctatctgaagatggatgccgttgcaggaaatacccatgctcttcacttctgatcgggctcaacagcagaccaaaattttccatctcttgcacttgagttcctcatcgacatttgcagactactgaagcagatggaactctaaaagaagtgctgaaagagacgaaccatctcttgtatgtgatatggtggttgttgagaaagtaggagcaagcctgtaactgtagatgtaaccaaccttgatggttcctgcccaagagttaaattgtacatgatata

SEQ ID NO: 46713 - DNA, 353 bp, Zea mays
  Clone ID: LIB3066-015-Q1-K1-B7
tcgggatccccccacaccttgagacctgcgttgtcacccacccatcaaggttggggccgccaggggagttcagccgttcctgttcctgataaaacgagagaaggatggcagtgtctcagggagctgtcctattcttgtttctcctcctcgtcgcagcatatgtgggaaccatcgatgccaaaatgggagtagccatgcccatgcatgccttgataatggagaaagcgaaacatcaggagaaggagaagaaggaggagaaaagcacggagaatgaagagagtcaatgcttatcgccgagtcttcagttcgagggcttctgcttcaacagcgacagatgcgccgaggtgtgcatg

SEQ ID NO: 46714 - DNA, 459 bp, Zea mays
  unsure at all n locations
  Clone ID: LIB3066-015-Q1-K1-B8
cattccatgtcctccgtatcaacaagatgctttcgtgtgccggggctgataggctccagagtggaatgaggggtgcctttggcaagcctcagggcacctgtgctagggtggacattggtcaggtcctcctttccgtgcgatgcaaggacaacaatgctgcccatgccagcgaagctctgcgtcgcgctaagttcaagttccctggccgccaaaagatcattgagagcagaaagtggggcttcaccaagttcagccgcgctgactacctgaagtacaagagcgagggtagaattgttcctgatggtgtcaacgcatagctgctcggcaaccacggcagacttgagaagcgtgctcctgggaaggctttccttgatgccgttgcttaagtgctgatgcgaatnctgacgttttgctttagcgtatcttaacttgtttcgtggaacatgaatttcaagtgtt

SEQ ID NO: 46715 - DNA, 458 bp, Zea mays
  unsure at all n locations
  Clone ID: LIB3066-015-Q1-K1-B9
gttctagatcgcgagcgcctcctgcaggaaaaggagcgaagagagagagagagagagagacgcaggcccgccggcgacgatcgaggagggaggaaccagagacccggcggcggcgacgatggctccgcgcagctcatcggcggcgacgtgcctgtgcctcgctctcgccgcggccactctggcgctggcccacggtgcgcaaggaggaggaccatcggcatcggcggcggacctggacaaggtcacggccgagaccttcttcgacatcgagatcgacggcaagcctgcaggccggatcgtgctgggactgtttggggacaccgttcctaaaactgcagagaacttccgagcactttgcacaggggagaaaggaattgccaagtccggcaagcctctgtggtacaaggngtcgacgttccacaggatcatcccggggttcatgatccatggaggcgact

SEQ ID NO: 46716 - DNA, 436 bp, Zea mays
  Clone ID: LIB3066-015-Q1-K1-C1
acgcacaatttgtcgccggagttggagcaaactcgcgacaccggggaacaccgtgggcagcatggatttttggacagtcgtagacgagcaagcaaccgaggaccccgatactcatcaggtggataatactgagcaggagctcgttgaagcccccccattcccataccctcttggacgatcccatacgatctacttctttctcaagcacttgcagccacacatcataccctagcccccccatctactgctcccaaggtgccattcgttgccgctcggatctctgtcgcgtggtgcaaatcttcaacggtttccggtggagggaggaaaggaggaaaggaggaagaaaagggggagaacccaaagtgggggacttccggatcgtacttagggatttgcccgaacttcccggaaaggtacttgatacatgttgggaatg

SEQ ID NO: 46717 - DNA, 395 bp, Zea mays
  Clone ID: LIB3066-015-Q1-K1-C10
gtggattttccgcaatgacggccacgccggtaactacattatggtacacaatgaaaccccgtgcttttcggcgggattacattagaaatcagatagaaatgtatagttattgttacctttttggaaatacatggaggaaggaaactgttcaaggtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaagggatcaaagtttatttccccttccttccaacataaaaccttttttatagggtcccgaaattaaattcaagggcccttgttttaaaaaattagagattggaaaaaccttggttttcccaatttt

SEQ ID NO: 46718 - DNA, 358 bp, Zea mays
  Clone ID: LIB3066-015-Q1-K1-C11
cccacgcgtccgcccacgcgtccgcacacagtctcggccgggccctctcgaggccgccgtggaaggacccccagcgatgggctccggcgaggaggacacaggaggcggaggaggggcggtgcggtgcgcggtgctgaaggcgctcgtggttgtcggctgcgtactgccgctccgtagactgcgccggtgtactacgcggaacgacctcgcactagccgacaccgactcgatcgataaagagcggtgatccttggaacatacacactcacatgccagatcgtttgtggactctagaatgcttgcacggatatgaacattgagcgtgcatgatgtaagtattgcacgctccttgtaagct

SEQ ID NO: 46719 - DNA, 410 bp, Zea mays
  Clone ID: LIB3066-015-Q1-K1-C12
cccacgcgtccgactagttctagatcgcgatctagaaccgcagatcacgctggagaacgtgcagaacgtgatcctgcacaacctgcacatccacgactccaaggcgcactcgggcggcatgatccgcgactcgaagcggcactacgggctgcgcacgcggagcgacggcgacggcgtctccgtgctgtcgtccagcaacgtgtggatcgaccacgtgtccatgtccagctgctccgacgggctgatcgacgtggtgaacgggtcgacggccatcaccgtgtccaacagccacttcaccgaccacgaccacgtgatgctgttcggcgccagcaacgacagcccgcaagacgcggtgatgcaagtcacggtggcgttcaaccacttcggccgcgggctggtgcatcggatgc

SEQ ID NO: 46720 - DNA, 451 bp, Zea mays
  Clone ID: LIB3066-015-Q1-K1-C2
aaacgctactgattcataaataaaatcgacccagcatgtacacactcacagcttcaggctggtccaagcaaaaactgcattcatgtttttgcttgtacactgcaccgtactcatattggttttagcagtaagagcgtgcttatgggtgcaaaatgtcatagtgaaagatgttttattgcattgcatttagttaataacatgtcattcaaagttttgtggtaaaatttcttctgacctggatatggcgcggaaaatttgaacggtcctatgggagaattataccagaaaagagaagggtatgcgttactagtagcttcccccaaactgctggcgctatgatcaaaatgtgctttcccaatttagccactgcatgttgcctcataatttctagtttttcgatatctgacaatgccctgaccgccgcggaatgtcacgccaacggacaccgaca

SEQ ID NO: 46721 - DNA, 315 bp, Zea mays
  Clone ID: LIB3066-015-Q1-K1-B1
gatcgagaacgtcgagaacctgttcatcaacggccactgcaccatcgactgggagggagccctggtgtggagcaagaaccagtgccagcattcttacaattgcaagatcctcccgaatagctcggtgctggattttgtgacgaacgtccagatccgcggcatcacgctgctcaacatcaagttctttcacctcaacatcttcgagtgcaagaacgtgctgatcgacaaagtgacggtcaaggcccccggcgacagccccaacacggacggcatccacatcggcgactccagcaacgtgaccatcagcagcaccac

SEQ ID NO: 46722 - DNA, 480 bp, Zea mays
  Clone ID: LIB3066-014-Q1-K1-H6
ccgcggacgcgtgggcgcgcctaggggcggaaggccgccgtgccggttcttgccaggtgcagcagccggccagtgcgcgcggttgcgttgcatttgcatggctgcgcgctgcgctctgggagcttgcactagcgggtctgcggcctatgcgcggggcatcttacgagtgcgtgcgtgtctgttcaagctctgatcgtctctccggcccattcgccggaggaaactgaccgacgtcttctcgctctcgctctctaccctattcccggggctgaaaggggaggagagaaggccacgtccacaccataaagcaggacggtacagacacgtgtacgagggggatcacggtcggctgaagcgactaagctggcggacggaacgacgacgatggcgaggagcggcggcgggatggaaggcagctgcgggctgaagaacgggccgtggacgcaggcggaggacaagctgctgagggaccacgtgcgg

SEQ ID NO: 46723 - DNA, 459 bp, Zea mays
  unsure at all n locations
  Clone ID: LIB3066-014-Q1-K1-H7
agcagaacatcgcgaccgcgcagggccgcgcggacgcgcgcgaggccacggggttcgtgctgcagaagtgcgagttccaggccgaggccgcgctccgggactccgggcgcccgcccatccgcaactacctgggccggccgtggcgcgagtgctcgcgcaccatcgtcatggagtcggagctcccggacttcatcgacaaggcggggtacttgccctggaacggcgactttgggctcaagacgttgtggtacgccgagttcggcaacacagggcccggcgccaacacggcggggcgcgtcagnctgggccggggttcaagaaggtgatcagcaaggcggacgccaccaagttcacggtcgagaacttcctgcacgcccagccatggatcgatcccacaagcacgccggtgaagtacgacctgttcacatgaggacacagctggaccggggatcggatcgg

SEQ ID NO: 46724 - DNA, 481 bp, Zea mays
  unsure at all n locations
  Clone ID: LIB3066-014-Q1-K1-H8
cccacgcgtccggagatcgtgaaagagacagaaaccgggatagggatagagaccgccaccggctgcgagatgatgattacaatcgcaacagggatagggacagggagagggatggtagggaaagggagcgccgagacagagaccgtggcaggcacaggagccgctcaaggagcagagatcgacgggacagagaccgtgaagatggagagtaccgcaggaggcgtggtcgtggcagtgtgagtcctcgtggacgtggtgaggatggtggcccaagagaggaaccgaagaggaagaaggaaaagaaagagaagggttgaaggaaatgctccggacccgaatgaccctgagatcatagaaatgaacaagctacgggcctcactggggttgaaaccactcaagtagtttacacgagtaatgttcaacttgacctgcatccaacctttnttgtgctggactttttcagcttgatgtaactaaactt

SEQ ID NO: 46725 - DNA, 465 bp, Zea mays
  Clone ID: LIB3066-014-Q1-K1-H9
cccacgcgtccgaattagcctcttatgacaaataatattttgagagagctcatctggaccaagtgccagcgagctaatatttaatttttttctttggttatattgaggcaccacacgagccaagaaaaaagttatgctacatgtcccttcttgcgccttattgcgttaggttgatatgcatgattacatagattaaaatacacttttattcaagattttttggggagaaatatattgatctggtccaccttcattatccagccaagtccccttccctcgcctcgcgttagtagcctgcttccgacccgcacatctccctccggttctcgccatgggcgccggcgccaacatccacgaggagtcgagccccctcatcccagctgcggtcgccgtccccgcgtacgagaagcccccgcaggctccggcgccggatgccgccaattactatgccgacggggtcccggt

SEQ ID NO: 46726 - DNA, 391 bp, Zea mays
  Clone ID: LIB3066-015-Q1-K1-A1
tcgcccacgcgttcgccgactcgttggagcgatcaaacgctcatcatggctgggaatgtgagacacgatgtaggcgtcaatgcgatctcaggctagaacggctgtaactctcgggagatcggcgagcaggcaatgatgcaggcctacctaagggcctgccagatcgaacatctcggctatctattgcaaggactgtctgtacgatcaatcgacacggtatgacatatcgactggtgtggctccctacaatcacactcggggctgcttgtacactgacgtgtacacgaccaccttcaatagcatgggcacatgctgcatcttaccaaccttcgaggattgtcagtgttgtaggtgccgcttatagatcatgtgccatcagcctgtaaagtgc

SEQ ID NO: 46727 - DNA, 430 bp, Zea mays
  Clone ID: LIB3066-015-Q1-K1-A10
atcccgccacactgcttcgagcgctcggtgctcaagtccttctcgtacgtgggccacgacctggtgatcgccgcggcgctcctctacttcgcgctggccatcataccggcgctcccaagcccgctccgctacgccgcctggccgctgtactggatcgcgcaggggtgcgtgtgcaccggcgtgtgggtcatcgcgcacgagtgcggccaccacgccttctcggactactcgctcctggacgacgtggtcggcctggtgctgcactcgtcgctcatggtgccctacttctcgtggaagtacagccaccggcgccaccactccaacacggggtgcctggagcgcgaccaggtgttcgtgcccaagatgaaggaggcgctgccgtggtacaccccgtacgtgtacaacaacccggtcgggcgggtggtgcaca

SEQ ID NO: 46728 - DNA, 460 bp, Zea mays
  Clone ID: LIB3066-015-Q1-K1-A11
actgcctccgcatgcggcaagatcctccctcattccccaaacatgagaggagcagaggaggagagatctggcgccgccactgatgcgggaggagaggaggagaaacgggagaggagcgtcggcctgatggccggcctcatggacaaggccaagggcttcgtggtggagaaggtgacgcaaatccccaagcccgaggctgcgctggatcacgtctccttccagagcatcagccgcgagggcgtcgagctgcatagccacgtcgacatcagcaacccctactcgcaccgcatcctcatctgcgagatcacctacacgttcaagagcgccggcaaggtgatagcgtcgggcacgatgcccgaccccgggtggatcgcggcgagcggcagcaccaagctagacctgcccgtgaaggtgccgtacgacttcatcgtgtcgctgatgaaggatctcggaggggact

SEQ ID NO: 46729 - DNA, 408 bp, Zea mays
  Clone ID: LIB3066-015-Q1-K1-A12
cggacgcgtgggcgggcgcggcgcgcaggtgcacatcgccaacggcgccgggatcacggtgcagctggcgcaaaacgtcatcatccacaacctgcacgtgcacgacgtcaagcacaccatgggcggcctcatgcgcgactcccccacgcacatcggctcccgcaccagggccgacggcgacggcatctccctcttctccgccaccaacgtctggatcgaccacatctccatgtccaactgcgaggacggcctcatcgacgtcgtgcagagctccacggggatcaccatctccaactgccacttcaccaaccacaacgacgtcatgctcttcggcgccagcgactcctggccgcaggaccagatcatgcagatcaccgtcgccttcaaccacttcggcaggggcctggt

SEQ ID NO: 46730 - DNA, 443 bp, Zea mays
  Clone ID: LIB3066-015-Q1-K1-A2
ctcgccgagtacttcaacgccagcgacggcgtgttcaagtacaacctcatcggggacgtgccgccctcgaacacggcccccaccaagatggcacccaacgtcatcagcgccgagttccgcacgttcatcgaggtggtcttcgagaaccccgagaagagcatcgacaccatccacatcgacggctacgccttcttcgccgtcggcatggggcccggcaaatggacggcagcgtcgcggagtacgtacaacctcctggacacggtgagccggcacacgatccaggtgtacccaaggtcgtggacggcggtgatgatgacgttcgacaacgcgggcatgtggagcgtccgctccaacatctgggagaggcagtacctcggcgagcaactgtacgtgagcgtcatctcgccggaagcgtcgctcagggacgagtacaacatgcccga

SEQ ID NO: 46731 - DNA, 445 bp, Zea mays
  Clone ID: LIB3066-015-Q1-K1-A3
tcgcccacgcgttcggaactgtccgctgtcgtgactgacgttggggaggtcggcctcattcttgatggggcgcagacctgggcgtcgcgcagccgcctctcccacgtggcgacgttgcgtgagcagtgctggagacgacatcaggagtgcggaaggtggaggggaatcaaccactgcattggtgtagattggcgggcaacctgtccgggctgccatcgtcggacggcgaccaaatctaggcagcgcgggtgttggtggcctccaacgaggcctctactcgactgacgtggtggacgcgacagccatcgatcgcaaggtggagataatggtgttctcgaggatcctcgcgttgcgcagtacacataggtcatctaatctcgggacacgcggaccgttcgagcccaagggccggaccgtccgcttattatggtgtccaacacacccg

SEQ ID NO: 46732 - DNA, 391 bp, Zea mays
  unsure at all n locations
  Clone ID: LIB3066-015-Q1-K1-A5
tcgcggactcgtgggttcactaatccaagacaaaacatggctgtgaatgtgagaaccatgtggtcgtcgatgcggtcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgactggtgccggtcccgacgataacggtggcggctgcgggtacaaggacgtgaacaagccccccttcaatagcatgggcgcatgcggcaacatccccatcttcaaggatggtctgngttgtgggtcctgctttgagatcaagtgcgataagcctgtggagtgctccggcaagc

SEQ ID NO: 46733 - DNA, 437 bp, Zea mays
  unsure at all n locations
  Clone ID: LIB3066-015-Q1-K1-A6
cctcgccatcccggccgtcgtcgtgagtgcgagtgcctccatctggcgttgcgcgcgcatggtcgcgactgctcagtccgcagggcacttgtgcgcgcaagcgcgtcatgtccgcgccaccggcttccgctgttcaggctccacggtcgagccccctactgtaactcacgctcctagtctcgccgtcgtctcgccgcggcagcgcctcatcgacctcgcccctgtgaccgtgtcgtcgtcctgagattgcgatccgtttccgagcttcgaggaatcaaagatcgagcgttggcaaccaagagatcaagctttttgaggtctacaacattgaacaccctgagcatctgtttggtgaaggttgcctttggtgtaatctatgctcangtcaagaagaagtcgtcgaggcggatctncaagaattctaagacttcgacgag

SEQ ID NO: 46734 - DNA, 321 bp, Zea mays
  Clone ID: LIB3066-015-Q1-K1-A7
catggatatgatggtcaggggcctgaacattctagtgcaagattggaacgctttcttcagatgagtgatgacaacccttatgttatacccgagatggatccaacactgcggaagcaaatccagcagtgcaattggcaggtcgttaatgtaacaactcctgcaaattatttccatgttctgcgtcgccagatacaccgggacttcaggaagcctttgattgtgatgtccccaaagaacctccttcgccacaaggactgcaagtcgaacctatctgaatttgatgatcttgcgggccaccctggattcgacaaacaggggaca

SEQ ID NO: 46735 - DNA, 460 bp, Zea mays
  unsure at all n locations
  Clone ID: LIB3066-015-Q1-K1-A8
agggcctcctgtctcctctcacttcctcagtcctcgtccgtctctgctccctcctctctcggcctagctagctagccagccttcctgtagcgcggcagagatggctgcccctgcatccaccacggcggcggcggcggcggcgctgctgcttctgctcgtgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgccgtcgacgcgggcgtgcactccttccgnctcggcctcaaccgcttcgccgacctcaccaacgacgagtaccgcgccacctacctcggcgccagtaccaggccgcagagggagagg

SEQ ID NO: 46736 - DNA, 451 bp, Zea mays
  unsure at all n locations
  Clone ID: LIB3066-014-Q1-K1-H4
gcgttcggccgacatcttctacaccaaccggagtgggctgacgaacatcgagtatcgcacgcttggagtggacgaccagcctctcttccatgggagaactgccattcagctgtatgctgattacatgaagagcttcagggagaacatggcagacttcttggatgctggtgtcgttgtggacattgaggtgggacttggccctgctggcgagatgaggtacccatcgtatccccagagtcagggatgggtgttcccaggcgttggagaattcatatgctatgataagtacctgcaagcagacttcaaagcagcagncagaagaggctgggcatnctgagtgggattgcctgatgatgctgngacgtacaatgacactcctgagaagacccagttctttgcggataaacggacataccagaccgacaaggggaagttcttcctcacatggtac

SEQ ID NO: 46737 - DNA, 374 bp, Zea mays
  Clone ID: LIB3066-014-Q1-K1-G10
gcgcccacgcgtccgcacacgcgtgcgcacacgcgtgcgaccacgcgtccgaccactcgtgcgggaacaacaagactgacagcgacgatgatgccacagctgcgtaccactggtacgctggtcctcgtggccacggccatagccgccgctcccggagttgggtttgtcgtgaccggccggatatactgcgacaactgccgcgccgggttcgagacaaacgtgtgcgacgccatacaatgcgcgacagtggatacgtactgccgccacttggagtcgcagcatgtccaccacaaagcggaggcaacgaccgccccctgcggctgctacaggatggagatcagcggcaaccaccaatacgagatctgcgacgtgcg

SEQ ID NO: 46738 - DNA, 463 bp, Zea mays
  Clone ID: LIB3066-014-Q1-K1-G11
cccacgcgtccgggaggttctaccacgtggaatcgctctttaatggaactttcgctttagctggtcgtgaccaagaaaccaccggctttgcttggtgggctgggaatgccagacttatcaatttgtccggtaaactacttggagctcatgtagcccatgccggattaatcgtattctgggccggagcaatgaacctatttgaagtggcccatttcgtaccagaaaagcccatgtatgaacaagggttgattttacttccgcacttagctactctaggttggggagtaaggccggggggagaagttctagatacttttccttactttgtatccagagtacttcacttaatttcctgcgcagtcttaggcttctgtggcatttatcacgcgcttatgggacccgagactctcgaagaatcttttgcattctttggttatgtatgggaagatagaaataaaatgac

SEQ ID NO: 46739 - DNA, 338 bp, Zea mays
  Clone ID: LIB3066-014-Q1-K1-G12
cccactcgtccgaggcatggtacgtaagaagttctctccacacttgcactctcgctttaggggacattgagactgacaccaccgacattcctcagcgtcctgggattgccatcacttatcattttgtccacttaaatactcggatctcatgtagctcatgccgcattaaccgcattcttatactgagaaatctacctatccgaagtcgccactttcgtaccacaaaagctcatttatgcacaaggtgtgattgcactccctcacttagatactctagtgtgcacagtaacgccgatgagacaactcctacatactgatccttacttagtattatcagt

SEQ ID NO: 46740 - DNA, 192 bp, Zea mays
  Clone ID: LIB3066-014-Q1-K1-G2
gcgcccacgcgtccggagggtcgtcgtcgtcgtcgtctcgttctgtggctcgtgatatccgcgggaacagtgctagttgccgccgcggccggcgccaagcggcaggcgccggtgatgttcgtgttcggcgactcgacgctggacgtcgggaacaacaacttcctgtcgggggcggccgtccccagggccaac

SEQ ID NO: 46741 - DNA, 440 bp, Zea mays
  unsure at all n locations
  Clone ID: LIB3066-014-Q1-K1-G3
gatcttccgaagaaggaagagaccatcaccctaaggccgctgagcatggcagatctgaaggagagcaaagaaccaggtggatccatgccttaccaagtgcaatttgaaacgatgcggatgcagattaacacttttcaacttgaaaaataaactaatggcagttcgaatgttataataccctgtaaactctcaaattcaggtggctgcaagtttcgcttccgaaggtgtctgcatgagcgagctgaggcaatggaacgagttgtatggtgaaggaggctccagaaagaaggaacaattaacatancttccttctgagcaatatgaaaatctatggaccatcacacgcaaaaatgtatgggcattttggaaagtatagtgcacaaaatagtcatgaggaaataggccgaacatgtatgagaactttgggaaacgcgggagtg

SEQ ID NO: 46742 - DNA, 417 bp, Zea mays
  unsure at all n locations
  Clone ID: LIB3066-014-Q1-K1-G4
gcgatttttaatttcttggttcggtttttgatcacctgttcttccttatgaccttatccaggaggttagatgatcaggtgcattttgtgtgaggatccagacgcaggaggatggctctcaagaagttgctgcagctcttttgtgtcggaaagaaggattccaagaagaaaggtaaacccatcgatccactctggcaagcctctgcctcccgctcctctgtgaatgtcactgcaaacaagactcatttggatccctgttcaagtgggaatgacactgtaagcgtgcaaaaccatgaagttgaatcctcaagtacgggttttcctcgtgggcaaggacagagcatggaactgagattactcatcatacgccctttagtcanattcgatgtgtccaagaattctcggatcaccactatgc

SEQ ID NO: 46743 - DNA, 357 bp, Zea mays
  unsure at all n locations
  Clone ID: LIB3066-014-Q1-K1-G5
gcgtccacccacgcgtncacccacgcgtccggattcatgcaaagaaaacaacgatccgtgtccagtanacagggagatgggtgacatagaataatgcatgaagaattgccaaaatcaaaaaccacatgcttcttcattagataataaattcagagaagaaattatcacagtattagaggaaagcttggacttatggttgaggttcagtacatcatatcattatatccataaattccaaaagacatttcataaagcaaaacctgaactacatagacttactgatgcaaaaattcatgatggctttatgacactggttctgctagtcagtctgttaaaaacaaaactcggctttccttt

SEQ ID NO: 46744 - DNA, 405 bp, Zea mays
  Clone ID: LIB3066-014-Q1-K1-G6
cccacgcgtccgcccacgcgtccggattttacggaggcttttgatgctgcatgctgccctcgtacactcttttcaaccaccttcgaccaaggatgggcatcaggaatatcagcagctgcagtacaaggccttttagagttgttggtagaaggtggtgcaaaccatgtgaaccaatgctttcttgaaacctgacgctattgcaacactgaacttgtgccgatcctaactcaaggtggttaaaggaaccacttggaccatggatgtgaaccaacccttggcttttgccgaacactatggaaggatcgaacccaatggaatgctgggttgaagaaggtaatgctatggcctttctgggcccttggatccttgctgttaaacgtgggtgcttccaagttgtggaatggt

SEQ ID NO: 46745 - DNA, 382 bp, Zea mays
  Clone ID: LIB3066-014-Q1-K1-G7
ctggctgacttgtacttgtcagttagccgggccagcggaacaatgaatctagttgaagactggccaccacgtggacgcactacaaaacataaagttcaaacagtatatggtgtgataggagttctcaaacttgcagttggatcatattttgtggtgatcacggatcgtgattgtgtgggatcctactttggacacgcaatttttaaagtgacaggactaaaagttcttccctgcaatagtgcacataacaccacctttgctgagcagaaaaaaatggaaacagaattcttagaactcctgtgaatgcttcaaagaggactattggccttcacttttcctacgatatcaacctaacactttctgcacagaggctacatgatct

SEQ ID NO: 46746 - DNA, 480 bp, Zea mays
  Clone ID: LIB3066-014-Q1-K1-G8
gcgttgtcacccacccatcaaggttggggccgccagcagagttcagccgttcctgttcctgataaaacgagagaaggatggcagtgtctcagggagctgtcctattcttgtttctcctcctcgtcgcagcagaggtgggaaccatcgatgccaaaatgggagtagccatgcccatgcatgccttgataatggagaaagcgaaacagcaggagaaggagaagaaggaggagaaaagcacggagaaggaagagagtcaatgcttatcgccgagtctccagttcgagggcttctgcttcaacagcgacagatgcccgccgaggtgtgcatgaaggagagctttcccggtggcgagtgcaagcgggacgtggccatgcgcaagtgcttctgcaagaagccttgctagttcatcggtcttgctaattgttgatgggtgcttcattaatttgatttgatgggtctcatggctacgagaaacaaaac

SEQ ID NO: 46747 - DNA, 306 bp, Zea mays
  unsure at all n locations
  Clone ID: LIB3066-014-Q1-K1-H1
gcgcgcgcatcgacaccttcagctcgtgtgtccgttcgagctggcggtttcctcgccaagaactggcgcgcgggtcgggggattgaggaagagagtgtctgcngctgctgctgctacgactactgatttttctggcccgagattcctggtcaaggcaatatgaagtacgtccttgtcaccggcggggtggtgagcggcctgggcaagggcgtcacggccagcagcatcggcgtcgtcctcaaggcgtgcggcttccgcattacgtccattaagatcgatccttaccttaacaccgatgctgggact

SEQ ID NO: 46748 - DNA, 321 bp, Zea mays
  Clone ID: LIB3066-014-Q1-K1-H10
gcgcccacgcgtccgaattatcctcttatgacacataatatcactagagatctcatctgtaccgggtcctagcgacctaatatttaaatgcttcgtgagattataatgaggcaccagacgatccaagaaaaaagttatactacatataccttctagcacattattgaattacgctcatatgcatgattacatacattaaaatacacttttattcaagacattttggagaaaaatatatgcatatggttgctcattattatagatccatgtcccctctaatagcctagcgttactatcctgcttccaaaactcacatctgcc

SEQ ID NO: 46749 - DNA, 428 bp, Zea mays
  Clone ID: LIB3066-014-Q1-K1-H12
ctctttgctggcatcatagcacttgtgatgagcatcgcaacgatggtccgtctgacccgcggcatgatgcctgggaaggttctcggtgctgccataggtggagctaccctctcagaaggtaaatcaaaagtacaagatcgccagctgtccaagctatcagaagaggctgtggaggaagctgaagacgccgtctctgcaaagcgcctctcggagcttgaggagaaggtcattgcactcctgacaaaacccgcatcaatgcctgctgataaggaggaagttctgcatgctgctgtctgccgcgttagtgcactggaagaggagcttgcagctacaaagaagaccttgcaggagactcttgagcgtcagttggagatcgttgcatacattgagaagaagaaagaaagcaagcgtttctttcgttggtagaa

SEQ ID NO: 46750 - DNA, 478 bp, Zea mays
  unsure at all n locations
  Clone ID: LIB3066-014-Q1-K1-H2
actctggaagcgtactgcgatgaaacagggacagggctggagatcattgtcccgaagtttcgcgttggccctgaagaacacgaagtgcatgtgtccatgaggccaccctcgtcctggtgccaatgaaacctgtttccaagcttgcggggggagacacgcatacggtgtggaggtttgccgtaaggctaaggctactgcacaacaaatgcagctcagttttgctaattttgatgggaaaccagtcgttaattgattgaagcattctggtagttggccgccgcagcgtttggaacattttaggaaatatgctacccggtcgcaaggaacatgcttgcattacttagttcttgtatggngatacacctagtgtgttacatttcgtttccgttgtgtcgaaagactggttgtctgctcgatgtgccccgacacgagcaacaatctgtttgtggtgtacacagaatggcaacttgatgtatag

SEQ ID NO: 46751 - DNA, 341 bp, Zea mays
  Clone ID: LIB3066-014-Q1-K1-H3
gctcctgattgcctgctcgctgcgcgctactgctgccacgctcggcagcggcaggtgcaggaggagacgacggtcgacaccggcgccctgcaccggcggatgtcagatcggcagctccgcccggtgcgctgcatcagaatcacaggggacggtcgatgcctgttcaagtgcgtcgactacggctcctgactgaggataggcaagcatgcgcccagcgactgcgcccagaacgaactggacgacgagctccgagccaaatgagctgctgagtacgttaagcgaacatgagacagccgaatggtaccttgaaaggcagctgtgagagttatgtgagacacatg

SEQ ID NO: 46752 - DNA, 393 bp, Zea mays
  Clone ID: LIB3066-014-Q1-K1-G1
cccacgcgtccgcccacgcgtccgcccacgcgtccggaatcatccaaagaaaacaacgatccgggtcgagaagacagagagattggtgagatagaagaatgcatgaagaattgccaaaatgaagaaccacatgcttcttcattagagaagaaattcagagaagaaattagcaaagtattagaggaaagcttggacttctggttgaggttcagtacatcatatcattatatccagaaattccaaaagacatttgataaagcaaaacctgagctggatagacttactgatgcaaaagttcaggagggcttaaaacactggttctgctggtcagtctgttaaaaacaagactcggctgtccttgaaaagaacttcgtgacttgagtactgatctac

SEQ ID NO: 46753 - DNA, 475 bp, Zea mays
  Clone ID: LIB3066-026-Q1-K1-D2
cccacgcgtccgcccacgcgtccgcgggagcacagagctagctagccagccagccagcagccagcttgctcgccgcgcccgtccttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaagaagagacgaagcgggagagagagtgacatggctgcgcgcattccgatgcgtgggcatgtttttgattcgacacaccttttgtcctctttttctttgttccctctttctgcttaatttaacg

SEQ ID NO: 46754 - DNA, 212 bp, Zea mays
  Clone ID: LIB3066-026-Q1-K1-D3
atgaaaattaatgcgtccaatgattcatatctctatatgcatatctctctgctctgccttgttggctggctcttctcatcattccctagcagatcgcatagtattagttgcatgcattatattgatgatgcaggtatttcgtcgagcaacaaggcgtactatcaattgtttttgtaatacccaaaattagtgaataaagggaaactggttat

SEQ ID NO: 46755 - DNA, 471 bp, Zea mays
  unsure at all n locations
  Clone ID: LIB3066-026-Q1-K1-D4
cccacgcgtccgccgaagagagaaacgcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaggccgtcgcccacctcaacggcctcgtccgggagcccaccgacgccaagttcctcgagctcaagtcgtggctcttctncacgctcggcggcacc

SEQ ID NO: 46756 - DNA, 397 bp, Zea mays
  unsure at all n locations
  Clone ID: LIB3066-026-Q1-K1-D5
cgcagcgtccaatccccgcgcgtcttcacgccgcgccacgccgtccgggccatgggccaccaatggcgacccccaccgccaccgcactcacctgctcctgccgcccttcgtcgccctcctcatcatccgccgccttccgccggctgaacatcttcgcccccgtctcgggcgcccattctcctcctcgacgccgcctccgtctcgcgccattgcacgtcgtcgacgactccaaggacccccccgaggagaggtctgagacggataagatggtcgacggcatggacttcggggagctctgcagcgacttcgagtgcataagcagccnctacgtggagtcgacggcgaggcaggtcgcgcgggacatnctggagctccgcgaggacaaccgcgcattcaa

SEQ ID NO: 46757 - DNA, 402 bp, Zea mays
  Clone ID: LIB3066-026-Q1-K1-D6
gcgatcgtcggagcagagagagacttcctcgcctgcatcccatcccgccgccgccgtctctacggtcgctaataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttc

SEQ ID NO: 46758 - DNA, 395 bp, Zea mays
  Clone ID: LIB3066-026-Q1-K1-D7
tgctcatggtgttttcactaatccagatctttttcccactgggcaagatctctgtgatgatatatggtggattggcatctcttatcttctgtggctatatcatctatgacacagacaatatcatcaagcgccacacatacgatcaatacatatgggcagctgtttcactctacctcgacgtcatcaacttgttcctgtctctgctgcagctgctgagggcagccgatagctgagctcattaatggagtgtttggtttgagaaatgatatagtccatcatcttctcactcctcacttttttgtttggtttgtggaatggagtgagttaatccaccaccacctcattctttataattagttgtttagtactaatatgtggaataaagtcatcccact

SEQ ID NO: 46759 - DNA, 472 bp, Zea mays
  Clone ID: LIB3066-026-Q1-K1-D8
cggaatggaagtcccggcccgagcgacgcgtccgcccacgcgttcgccgaagagagaaacgcgagcaaccagcgatcgccccatggccgccatggctagatccgtctccctcgtcaaggcgccccttctactactctccctcctcgtctccgccgcggccagtgcgcggaccgtgggcgacaccgtgcatgacgcgtgcagcaagacccagttccccaagatctgcgtggacagcctcgccgtcaagccggagagccagaaggcgacgccgcgcaagctggcggagctgttcgtgaacatcgcggccgacaagggatccgggatggccaccttcgtgcaccgcaagtacagcgacaaggaggacagcgacatattcaagtgctacgacagctgctccgacgacgtggaggaggccgtcgcccacctcaacggcctcgtccgggagcccaccgacgccaagttcctcgagctc

SEQ ID NO: 46760 - DNA, 365 bp, Zea mays
  Clone ID: LIB3066-026-Q1-K1-D9
cggacgcgtgggcggacgcgtgggcaaagatagcatagcagcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcaaggcgccggtgccgtcggcgccgcgccggcttgatcgcccaacgcattcatcgcttcagctcgatataatc

SEQ ID NO: 46761 - DNA, 372 bp, Zea mays
  Clone ID: LIB3066-026-Q1-K1-E1
gccgccaccacgctcattagccccaaatagaggcagacatgcagataaacgtgcgatatccagctcgagcagtacttcaaacagcacaagcggcgaatcatttaaaaatagaagagtaccaaatcgtcccggggataataacagtaatctgagctcaaattctgatgttcataaaccacggcgcaaaaggaggcataagaagaaaagaaagctgcaggcatgatgaatattcccaaagcgcgtgaactgtgggggtccggtggaaattcagattcccagcgaagtttggactttgagcatggccaatttggagaagttgaaaaaaaaatagacacagcatgtgcgatgtgtctgagcaagttgattgattct

SEQ ID NO: 46762 - DNA, 428 bp, Zea mays
  Clone ID: LIB3066-026-Q1-K1-E10
caatcatccaccgcgccgccgcagaggcctcgtcctcaccttccccgtaggaagccgaagtacagccagcagcgtcgccatcagcaccgatcatggccgactacgagcaggagcaggatatggaggtggaggcactgcaggccatcctcatggacgacatcaaggagatcgacccgagtgagagtgggatcgccaccaccgcccggtgcttccagatcctactctctcctcaggatgatgattttgatgagtcagcttatgtcccagttcaactggccctgatttttgcgcacactgagaagtaccccgatgaaccttcactactaaatgtgaaaagtgtacgaaggattaaaccacatgatcttgcatccctgaaggaaaagcttgagcaagaggcaaaagagaatcttggcatggctatggtctac

SEQ ID NO: 46763 - DNA, 447 bp, Zea mays
  Clone ID: LIB3066-026-Q1-K1-E11
cccacgcgtccggacgacggcaccaaggtggcggtgaagcgcgggagcgcggagtcggagcagggcatcaacgagttcaacacggagatccagatgctgtcgaagctgcggcaccggcacctggtgtccctgatcggctactgcgacgagaaccaggagatgatcctggtgtacgagtacatgcacaacggcgtgttccgggaccacatctacggcagcgaggggaaggcgccgctgccgtggaagcagcggctggagatctgcatcggcgccgcccgggggctgcactacctgcacacgggcacggcgcatgggatcatccaccgcgacgtgaagaccaccaacatcctgctggacgacaacttcgtggccaaggtgtcggacttcgggctgtccaaggacgggcccgggatgaaccagctgcacgtgagcaccgccgtgaagggc

SEQ ID NO: 46764 - DNA, 282 bp, Zea mays
  unsure at all n locations
  Clone ID: LIB3066-026-Q1-K1-E12
ctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgtcgtcatcctatgcctatgcgtcgtcctctcctgtgccgcggctgacgacccgaacctncccgactacgtcatccagggccgcgtgtactgcgacacctgccgcgccgggttcgtgaccaacgtcaacgagtaca

SEQ ID NO: 46765 - DNA, 429 bp, Zea mays
  Clone ID: LIB3066-026-Q1-K1-E2
cccacgcgtccgcccacgcgtccgcccacgcgtccgcccacgcgtccgcccacgcgtccggccacgcgtccgcgagagaggaacgcgaacaaccaacgatcgcctcatcgccatggctcgctctgtccccatcgccgtcgccgtcgcgcctctgctcctgctcctcctcgtctccactgcgtccgctgcacggaccgtgggcgacaccgtgcaggacgcgtgcagcaagacacaattccccaagatctgcgtggacagcctcgccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgt

SEQ ID NO: 46766 - DNA, 457 bp, Zea mays
  Clone ID: LIB3066-026-Q1-K1-E4
cccacgcgtccgcccacgcgtccggcgacatttcgaataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgtggcaacgtccccatcttcaaggacggcaagggttgcggctcatgctatgaggtgagatgcaaggaaaaacctgagtgctcgggcaatccagtcacggtgtacatcactgacatgaactacgagcctatcgctccctaccacttcgacttgagcg

SEQ ID NO: 46767 - DNA, 375 bp, Zea mays
  Clone ID: LIB3066-026-Q1-K1-E5
ggtgatcctaagggagtactaatctcgaacaagagcattgttaccattgtttcagcagtagatgagttcctcagcaactcaaacgagcagcttaacatggatgacgtttacatttcctatcttccgcttgctcatatatttgaccgggtgattgaggaggtgttcattcgtcatggtgcttcaattggattttggcgtggggatgtcaaactcttggttgaagacattggagaactcaaaccaacagttttttgtgctgttccacgtgttctagacagaatttatggaggattgcaagataaaattacagctggtggtttcctaaagaaaaccttgttcaatgttgcttacaaatacaaacaaggcaatatgttg

SEQ ID NO: 46768 - DNA, 454 bp, Zea mays
  Clone ID: LIB3066-026-Q1-K1-D12
ggaactacagtgaaagataaatgtatgcatattacgtagagaaatgaaagataaatgctctggcatatgtatctgtacgtagactcagccagtcggcggctagcgatatcgccagcgacaggcgcagcggaccacggaggacaaagatctccgctttgaaagggacgcgacatgaacaaagacaaaggtcatgacacggagactcacggaccaaggaggcagataactgggaatacacctgtggaaacggtgaagggtcccaatctgcttgagcgagcaaaggaagagatcgaggcccttgccggagctgttcatactaagatggagcaccattccagtccccacgcgaagaaggatgaatcacataaggaaggcaaggaggggagcctgcacaaaataaaagcccacacggatgaaactcacggaacaagtgctgacatatatgagaacacac

SEQ ID NO: 46769 - DNA, 262 bp, Zea mays
  Clone ID: LIB3066-026-Q1-K1-E6
gcgatcgtaggagcagagagagacttcctcggcttcatcccatacagacgtcggcgtctcgacgggcgctaataagcagccgcgtccagggatggagatgaagaagatcgcctgcgccgtcctcatcgccggctcggccaccgtggcgctggccgcggaggcgccggctacgaattacaccagcgggtgcttcaccgtcagagccagcatcgtcggggccgccaggggctccttctctgcggactacagtgactgatccggc

SEQ ID NO: 46770 - DNA, 405 bp, Zea mays
  Clone ID: LIB3066-026-Q1-K1-B8
cccacgcgtccgcccacgcgtccgaggagacgcactgtgttgttgcaatcaaaattgtgggcttcttggggcacattttgctcttgatttcattagtacgatggtgaatggagggcacattgtgatttttagatcagaattgtggttccttgggctgccttaatgtgttgatttcttttctttatacgatgatagatatagaattgtctaattgcaggtacaaggtgctaaagccatcatgtttaccagtttgctacatgttctctcaatttggtagtaattttcagtttggaacatgtaatctgagtgttagtcagtttgctacatgtttctgaatttgtgtcaatctgagtttggaccatgttatcaacttttgtcaatttgccacctgtaagtggcgctgca

SEQ ID NO: 46771 - DNA, 451 bp, Zea mays
  Clone ID: LIB3066-026-Q1-K1-B9
cccacgcgttcgcccacgcgtccgggacatctttaggactgcagtgacgcttcagatacccacagattcagataaaacatggcatatgtagtcatagtgctctccttctatttcctgtcacttgatgacctgtttcacaaagctcaattcatattaaaaaggatactctgcattctcctcatctttaagtacggtgatccatatttttataaacattgtcttggaaagctggaaggtgctatacattatccatgtgttaggtgggcaagtcatcttacgccaatgagaagcttacgttgaagtcaatgccttggcacaactaatgacatggaaaacaacggtctaagttaacatgggcttcagattgcattgctgggaaagatggaatggaattcaaattttggtggccgcacaagtgtgaagacttgaattcatatatatacttagttag

SEQ ID NO: 46772 - DNA, 326 bp, Zea mays
  Clone ID: LIB3066-026-Q1-K1-C1
ggactcgcccgccgtggcggacgtctggccgtccacctccgcgttcgatgggtacctctccgcgctctccccgatccagcttgttcgcagcaacagccgccgttttatgccttctcaagctgatgaagaaattcatcagttgtcctttctgcaaaagcatatggcgaatattcttactctcttggcagattctgttgagggtgagggtgacgattcactggtattgacaatggagacttttgagcaccttggatttctagttcagttctcagaaggaacttctttaaccaggctgctacatttttgcaaactcagacccagacatg

SEQ ID NO: 46773 - DNA, 432 bp, Zea mays
  Clone ID: LIB3066-026-Q1-K1-C10
ggactatgactcgagcatgccatgctgtggcgatgacatatacaaatcgacgcacaagattgtcatatgtgacatcgagccacctgcattgatccgagagaactgtgggtgcgcattatggttgacgccacctgaatagatgtgtggcatgatggtcgatggcagtcaatgattgactgaacctgagaaaggttattgggctacaatctatgcagagctagatgtacttatgcccaatggaatgaagtgaatggcttcgtcgctagcaccttgttggcaaatgtacgaagatgttgatcatatacaccatggcaaatgtaacacgatacggtaagtgcttatggcatgcctggactaacctagtgtcgatccacctatagtgaagtagatgtgcaccgcatagcgctactgctttgcttattgactgcattc

SEQ ID NO: 46774 - DNA, 451 bp, Zea mays
  Clone ID: LIB3066-026-Q1-K1-C12
cccacgcgtccggtcaaaatcatgatcctggctaagcatgaaaagttttttgatatcttatatctacagaaactatagttgaggcagctgcatgcttgctggcaccggccatccaaactttgacatgggagtacgtccacccagtttcctggtgacagtgagatttttggccatggcttccatgatatgctctagttttgctgttaaacttcaactgattgttctatggcagcaacaagagaacagcaccttgtgattattccggaggcacatcaggggtcgttgcagcggatgcaatcatcatatggtggatagtggatagtgaatagttggcgtcacaatttttgttcccatagtcgtcacgattagccatctgtcaaagtactctctctcttcgttgaataaggtcatcaagaaggccggtcatttacttgtgtattctgtactttat

SEQ ID NO: 46775 - DNA, 479 bp, Zea mays
  unsure at all n locations
  Clone ID: LIB3066-026-Q1-K1-C2
cccacgcgtccgcccacgcgtccgcggacgcgtgggggaagagcagtttgctgaaaattttactcccaattatactgtgtgtgctgctactcatgcttggagcccttgtctggacatgtaaaagcagaggcaaacggcaaaagaagagagttcaaaagagaaggatgctagaatacttgagttctactgatgacgctggggacaagaacataaacttcccatttattagctttgaaaacattgtcacagcaacagataatttctctgaatctaatttgcttgggaaaggaggttttggcaaagtgtacaagggaatgttggaaggcacaaaggaagtagctgtcaagagacttagcacgggttccggccaaggcaaggaggagttcaaaaatgaagtagtcctaattgcaaagttgcagcacaagaacctagttaagcttctcggttgttgtattcatgaagatgagaagctgntagtt

SEQ ID NO: 46776 - DNA, 351 bp, Zea mays
  Clone ID: LIB3066-026-Q1-K1-C3
cccacgcgtccgcccacgcgtccgacgacgcgtactatcgattcgcaagcggatggtcggcgtcttactatccaacaccgcgccggtccggattaattccttctcgaccggacagcgcaatgctgtgcctagatcgatcggtgcgaaggcaagtgatgccgctatatatatatatatatatatatatctatgtatgtatatgtatataggagattcttgtagcgagctcttaacgcgatgggtttacccgtcctctactactgcatttgcattggcggcgacgttgaattggcgacatgcaaggtcagcgttaggtacgtcgctacatgggaaacccccaaggtcattttg

SEQ ID NO: 46777 - DNA, 413 bp, Zea mays
  unsure at all n locations
  Clone ID: LIB3066-026-Q1-K1-C4
gcggccgctttttttttttgttaatgtgtatttctcgtgttacacttgtaaccaataacttggctgctttacacaattacacctatacaacataaacatgactatgcacattctgatacctcaaaaccctacgtcagctgaccatctgcaaaacttcattccctaaccggagatcaattattgcccccgtcccaattttgggggaatataatgacacgaaagggaacaacttgacagtactgtgaaccctttgaacgcccttcataacatcaaggagcaagtacaagaacttttatgggtccctgactggtagcagttaacatcgtanggctatcactcttncagcagacagcactaatgaaaatagaccaggatcatcatcggcatcatccgggtcagaagatacaaatcta

SEQ ID NO: 46778 - DNA, 301 bp, Zea mays
  Clone ID: LIB3066-026-Q1-K1-C5
aaaaaaaaaaaaaaaaaaaaaaaaaaaaaattaaaaataaaaaaaaaaaaaaaaaaaaaaaaggaaaaaaaaaaaaaaaagaaaaaataaaaaaaaaaaaaaaaaaaaaaaaaaaaaaaaaaaaaaaaataaaaaaggggtggcggttttaaagtttccaagttaagtttcgggggcttgcaatgcttaagtttttttttggggaaacttaatttaattctatgggcgtgatttttaaaaattcgtgtctggaaaaccttgggcgttaccaaatttaatggcttggagaaatatgcctttt

SEQ ID NO: 46779 - DNA, 431 bp, Zea mays
  unsure at all n locations
  Clone ID: LIB3066-026-Q1-K1-C6
caagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaagacgccgnctgcgtgctcaccgtctncaagatccactacgagaatatcaagatggaggactcagtcaaccccaatttcatcgacatgaagt

SEQ ID NO: 46780 - DNA, 400 bp, Zea mays
  Clone ID: LIB3066-026-Q1-K1-C7
acaacgagctccgtgtggctcccgaggaacaccccgtcctcctcactgaggcgcccctgaacccaaaggctaaccgtgagaagatgacccagatcatgttcgagaccttcaacacccccgctatgtacgtcgccatccaggccgtcctgtctctgtatgccagtggtcgtaccacaggtatcgtgctcgactcgggagatggtgtcagccacactgtccccatctacgagggatacgccctcccccacgccatccttcgtctcgacctggctggccgcgacctcaccgactacctcatgaagatcctgactgaacgcggctactccttcaccaccactgctgagcgggaaattgtcagggacatgaaggagaagctcgcctacattgccctggactacga

SEQ ID NO: 46781 - DNA, 312 bp, Zea mays
  Clone ID: LIB3066-026-Q1-K1-C8
cgtttaagaaattcgccgcttgatgtgtggatccgtcgcggctgccgtcaagcatagacaccaagaaccagacctcggggtggatcatcggggtcgcggaggtctactggatggggtcaagaagtatccgggcaagtcgtctctgggaaccctgcttattgctcgccggatgctagcgccgtcgtggactgcgcggctccgagaagtcgaggtcgtcgcgacatatcccaggtaaagagccatccgataggatcgtagtgttgcgagcatcgtgttgctcggttggcggtgtagtttggggcattggcgtgc

SEQ ID NO: 46782 - DNA, 440 bp, Zea mays
  Clone ID: LIB3066-026-Q1-K1-C9
atcaaatgcttgttataagcagtggtaatgagaaatatgagataatgaatgctataaattccttaatgcttgatgggaaatggtcaaatcaagaatcttctgtcaaggaagtagtttccactgctagggtccaaagtttaaagaaactggtgaaagagaagctgcatcaatggctcatctgcaaagtaaacgatgatggaaagggtcccaatgttctgtgcaaggaaggacagggtgtgattcatttagtagcagcactgggttatgattgggctataagaccgataatgattgctggtgtcaatgtgaacttccgggatgctcatggatggactgcactccactgggctgcatctttgggaagagagcggacagttagtgtcctcatagcaaatggagctgcagcaagagcactaactgatccaacttctgagttccct

SEQ ID NO: 46783 - DNA, 276 bp, Zea mays
  unsure at all n locations
  Clone ID: LIB3066-026-Q1-K1-D1
tgatctcttcggtgctagagaaatataggccgncgncgnctnctcctcattcggtgaaaggtgcgcagttagggttgggagatctcttgcctcacgacacgagcagcagaatttgtcgagggccgctggttgctgcgagagggccgggccttcgtgggatctttgaaattgaatgttctaatggagtccaaaggtggcaagaagaagtctagcagtagtcgttccttcctgatgtacgaaagctcccttggctacagcatcgaggatatcccgcct

SEQ ID NO: 46784 - DNA, 75 bp, Zea mays
  Clone ID: LIB3066-026-Q1-K1-D10
ctccactcgtccgcccacgcgtcctgtcacgcgtcagaggactcttgcgcagacgcgtgtggggtttcacacaac

SEQ ID NO: 46785 - DNA, 415 bp, Zea mays
  Clone ID: LIB3066-026-Q1-K1-D11
cttcgtgatggtcatcgccctgcacttgtgcagcagccagcctagcagcagccgccgtgcccgcaagctcgacatggagggcctcgaggagaagtcgcccgagtacgtggccgtcaagaaggcgtcgtcgacaccgcagaagagctcctcgtggctcgggaggagggcagggtcgtcgcttggtgggcttggacacagacgggccgcttctgccgcgaaggtggacgatctaagcagcagatccgcgggggatctggtcatggtgaacgaaagcaagggcgtctttgggctcacggacctcatgaaagcggcggccgaagtgatcgggagcggtgggctcgggtcggcatacaaggcggtgatggccaacggcgtggccgtcgtggtcaagctgctccgcgacatgaaccgggcg

SEQ ID NO: 46786 - DNA, 390 bp, Zea mays
  Clone ID: LIB3066-026-Q1-K1-B7
cgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggacctcaagcccggcgctcagttccgcgagaagctgttcctgaacatcagcaagccgttcatcacgttccggtcggaccccaagaagcccgccgtcgtggtctggaacgacacggcggccacgaacggcaaggacggcaagccggtgggcacggtggggagcgccacgctggcggtggagtcggactacttcacggcgtacggcgtcgt

SEQ ID NO: 46787 - DNA, 472 bp, Zea mays
  unsure at all n locations
  Clone ID: LIB3066-026-Q1-K1-A2
gattcaagttgattaaggaagttggcgatgggactttcgggagtgtatggcgtgctataaataaacagaatggtgaagttgttgctgttaagaaaatgaagaaaaagtattattcttttgaggaatgtatgggtttgcgtgaagtaaagtctttgcggcgcatgaatcatcctaacattgtgaagctcaaagaggttatccgagaaaatgatatattatacttcataatggaatacatggagtgtaatctctaccaacttatgaaggataaggtcaagcctttctcggagtctgaagtacgcaactggtgctttcagatatttcaggctcttgcttacatgcatcagaggggctactttcatcgtgacctcaaacctgagaatctgttagttagcaaagatgtcataaagctagcagactttggtcttgcaagggaagtttcatcattgccgncatatacagaatatgtctc

SEQ ID NO: 46788 - DNA, 367 bp, Zea mays
  Clone ID: LIB3066-026-Q1-K1-A3
gcggcagcgagcagcaagccccgccggaagacgagaactaggagaaagagcggtagctggccgaggagaaggcgtacgcggcggagaaggtcgttcagcaagagatgctcaagtacaccaaggagaagggtctggtgtgcccgaccaacggcacggagtggtacaagggcatcgaccgggagttcgtggacgtccacaacgagcttcgcgcgcgctacagcgtgccggccatgaagtgggacaaccagctggcgcggcaggcgcggagctggttcaacgccatgcgcaaggactgacagatcctgcacagcggccacgagtacggcgagagcgtgttcaggagctacgacgactggaacgtcaccga

SEQ ID NO: 46789 - DNA, 418 bp, Zea mays
  Clone ID: LIB3066-026-Q1-K1-A4
cccacgcgtccgcccacgcgtccgcccacgcgtccgagatgctaaagggcatcggcgtggtcggaatgatcgtggtgaccccggagttgttcggtccggtaatcattccgaggccgcacgccatcccgacggtgcaagtctctaacgcggcggggcagaagatcaaggcctacatccacaaggcgcggggcccgacggcgacgttcgtcttcaaaggggcagcgttcaacaccccaaggtcgccgatggtggcgcccttatcctcgcggggcccgaacaggacgagccgtgggattctgaaacccgacatcatcggccccggggtgaacatcatcgacggcgtgccctcgatcgaggacgtggacctgctgcgcaacgcggaggtgcccaggttcgacatcaagtccggcacgtccat

SEQ ID NO: 46790 - DNA, 444 bp, Zea mays
  unsure at all n locations
  Clone ID: LIB3066-026-Q1-K1-A5
gcgtccgcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgncagctctttcaccctgagcagctcattagtggcaaggaggatgccggttacaatttcgccc

SEQ ID NO: 46791 - DNA, 333 bp, Zea mays
  Clone ID: LIB3066-026-Q1-K1-A6
gccacgcgtacgacaactctgacgagcgggaccacctgtcattgtctgacccgccgctcgccggacggcagcgcgacgaggacccgattgccgcttactgctacaggacccagcatcgcgtgctacaccgctgatcgagcgaaccccatgcaccctgatcgctccgtccgatcgaccgcctaggggttacgcgtaccactggctccccgcgccttattggaggcggtcccagatacctcaaactcacttcgcagctggatccgctcgactcaacaccggcgaattcgagaagtggcatacgctgcagagctgctatgcgtacaagtagaacca

SEQ ID NO: 46792 - DNA, 411 bp, Zea mays
  unsure at all n locations
  Clone ID: LIB3066-026-Q1-K1-A7
cccacgcgtacgtccacgcgtacggtgatcttccccgaacccagcgccgctcccggtggacagggctaccgctaacgtcggcgtcgacgcctcaagggcacccgtgtacggctctcgcgcgaccaggttcatggcttggacgaggtcctagcggcagtcggcgtgctccgacgaagctgcgcctgcagtactgccggccatcgaggagcctcagagattgctgaagaaagtggtggccgacggcatcagtgcttgagagagctgtggcggcgcgacgggagcagcacaggacatgagtgccaccaagaaccacgtcatgtgagaccgaaagcgacgagagaagctcaacgagatgctcctcgtngctaagtcactgcttccgttcatgcacagggtgaacaaagcgtcgat

SEQ ID NO: 46793 - DNA, 436 bp, Zea mays
  Clone ID: LIB3066-026-Q1-K1-A8
cggacgcgtgggggccagaagacagtgcagcttgttctacttctgcttgctctggtgtctgtgccttggatgttgattccaaaacctcttctattgaagaagcaacatcagcaaaggcatcaaggtcaccagtacgcaatgcttcagggcgttgatgaatcagtgggagcagagctgggggaacatcatgaggaagcacatgaccatgaggagtttgagttcagcgaagtttttgttcaccagctgattcacacgatcgaatttgttcttggtgcagtctcaaacacagcttcgtaccttcggctttgggctctgagtcttgcacactccgagttgtccactgtattctacgataaagtactactgatggcatgggggtttaacaatgtcatcatccttattattggcatcatcgtcttcatatttgccacggttg

SEQ ID NO: 46794 - DNA, 228 bp, Zea mays
  Clone ID: LIB3066-026-Q1-K1-A9
cttaaaaaggcatatggaaatgccatgcatatggttcttcatgtaggccctgatagttgtacagtagtttctaatttgttgaaagaaggaaaggttgaagcttggggagtggagccttatgatttggaagatactgacagtacttgcaaaagcctcgtgctcatggtctttgtccgtatgtctgatattaagttgctccttccgtaccgtgcagattcttttaatctt

SEQ ID NO: 46795 - DNA, 429 bp, Zea mays
  Clone ID: LIB3066-026-Q1-K1-B11
cggacgcgtgggcggacgcgtgggctggggcctcatcggcccgcgcaggatcttcggcgacctcggcacctactcggcggtcaactggttcttcctgggcggcgccgtcgcgcccctcctcgtgtggctcgcgcaccgggcgttcccgagccagagctggatcctgctcgtcaacatgcccgtgctcatcggctccaccggcatgatgccgccggccaccgccgtcaactacaccacgtggatcattgccgggttcctgtcggggtacgtggtctacaggtaccggcgtcactggtgggagcgccacaactacctgctctctggcgcgctcgacgctggcctggcgttcatggccgtgctcatctacctgtgcttgggcttggagaacgtcggcctcaactggtggggcaatgatctggacgggtgccc

SEQ ID NO: 46796 - DNA, 453 bp, Zea mays
  Clone ID: LIB3066-026-Q1-K1-B12
gaattagggagcttcggccggatccgcaacatcggggaacggcgggaaccagggagctcccgccgcctagaaccggagctcccaatcgatccactggccgttgagccgacacttcaatggaagcccacgcctcgcggggccgccgcaccctggaggagattcggcagaagagagccgcggagaggatgcaacacgccgtcccgatcgcggcgtctcacgtcgactctcacgggaaccaaagagctggagctgagcatcttgctcgagttcaagaacttgaaaatggcaacacggaattggagagggaaaacaaaatgctcttgtccaagatcgctgagaaggaagttgagaaggacgcccttgtaaaccgtttgaatgatctcgagcggaatgtagtgccctctttgaaaaaaagcttgaatgacatttatttggagaaagatgctgctgtag

SEQ ID NO: 46797 - DNA, 472 bp, Zea mays
  Clone ID: LIB3066-026-Q1-K1-B2
cggacgcgtgggggtgcgcgcgcccgcggcgctgtgccgcaaggcggcccgcgtgagcaagggcgggcggcggcgctccgcctccgtggggcaggccacggagatctacgagctcccggtggacaacgccggcgtcgtcgtcaaggtggacgccagcgccgtcgaggcggtggcgctgccggtgaagcccgccttgcagctggaggagacgggggagcttgagaaggaggtgtgggccaggttctacggcacgggcttctggaggagcgtgtctcagctcgacgacgacgacaggtgaccggaacaatcaggcccgtgagtgagcgagcgatcgaccagctcctccggcgatgcttaagcaatagcatgcgtttccttggttgggtttccttcgttgttttccgcggaaataagagaagatcgaggaaaaggaaatgtgatgcatggtcgtcgatcgactatacgagtttct

SEQ ID NO: 46798 - DNA, 466 bp, Zea mays
  Clone ID: LIB3066-026-Q1-K1-B3
ggagccatgaagcatacctacttttccctgttcatctggatggtactttgtttgacaacgctaacatcatgctgtccagaagggaattctattccacagctgatgttctgcaaatattccagcagatgtgtgaagggctgaaacacatgcacagctttgatcctccatacgctcataatgatgttaagcctggtaatgttcttataacctggcgtaaaggacaagcacctgttgcaactttaatggattttggaagtgcaaggcctgcaagaaagggaaatccgtctcgttctgaggcactacagttgcaggaatgggccgctgagcattgctctgctccttaccgggcccctgaattatgggactgcccaagccatgccgatattgatgagaggacagacatctgggctctaggatgcactctttttgctatcatgtacaatgtttcaccatttgagtatgctct

SEQ ID NO: 46799 - DNA, 410 bp, Zea mays
  Clone ID: LIB3066-026-Q1-K1-B4
ctcacacggtgtcccactcccacgggatgtacggccacggccacggccacggcaagttcaagcatggcaagttcaagcacggcaagtttggcaagcacaagaagatgtttggcaagcacaagaatatgttcggtcgcaagtggaagtgattaacgtacagctttaatccgattctggacgagcagacgtatatatatacaccggagtccagaatgctaagttatgctattttgattgtgattcgaatacgggaggttgttagggttttcgaagtacgtactgacggctgcctgtaagctttgttggagctgttcttgccgtgttggcagtccgaattaatttaaccatcgattgtgtcgaacagcatctccagctgccgacaaatagacgagtgatcaaagttttttttt

SEQ ID NO: 46800 - DNA, 419 bp, Zea mays
  Clone ID: LIB3066-026-Q1-K1-B5
cccacgcgtccgcggacgcgtgggtgaaacagttaagaattcatatataagagtgcatatatatatatataattctgccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagtttcgatggtggacgtttattctatctattggcttacttgattatttttcccctaacaataagaaaacgcacgtgctggcatgt

SEQ ID NO: 46801 - DNA, 440 bp, Zea mays
  Clone ID: LIB3066-026-Q1-K1-B6
cccacgcgtccgcaacgcttctcctgctggttactccgcgcgccttctctttctctcccggacgtcgatcgtgttcttcagcacgggctagctagctccctccctcccagccatggcgacgccgttgcatctccatttcgttctggaattggggcgttgcacacccatgccgtcgcgttgccttgggttgtaggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccggcggccttcaggaacggcggcggcgacggcgggtacaggcccgacttcggcgacggcaaccagtacacgctcgccaaacggaagaagt

SEQ ID NO: 46802 - DNA, 454 bp, Zea mays
  Clone ID: LIB3066-026-Q1-K1-A12
gttttagttaatattttatgttattcgcatgtcatgatcaggaatgtgaaattcagttgtaatataaacatttttactccagtattctttgtatgatagtctaacggtttctcatatgcagagactcttgtacattcaacattggatcagtgcgacagtgctgattataccctagaagttctcttcaatatgaaaaatcacacagtgcatgtgaagaaaaggccttacctgaaagtgtttcttgagaaggttgctcagatgtttgagctcgtcattctcacagctagtcagagaatctatgctgagcatcttatagataaacttgatcctgatggaaaatatatctcacggcgtatttatcgtgaatcttgtatattctctgacggttgctatacaaaggatctgacaatcttggggatcgacttggcgaaagttgcaatagttgacaatactc

SEQ ID NO: 46803 - DNA, 431 bp, Zea mays
  Clone ID: LIB3066-030-Q1-E1-A12
cgggcctccccggccacccgcaccacgcgcgcctggccgccatgggcaacccgggctacggctgcggcggcatgctgtgcctcgacatgggcaccgaggagcgcgccaaccgcctcatgcaccacctccagaacaccacccagttcggcctcatggccgtcagcctcggctactacgagacgctcatgtcctgctccggcagcagcaccagcagcgagatgccgcccgaggaccgcgcgcgcgcgggcatctccccgggcctcgtccgcatgtccgtcggctacaacggcacgctggagcagcgctgggcgcagttcgagcgcgcgctcgcgctcatgcagacgccgacgcccacgcaccatctcaaggccgccgccgccgaccgcgacgggcccgaagccgccaacaacaccaccgcaagcactgacgcg

SEQ ID NO: 46804 - DNA, 241 bp, Zea mays
  unsure at all n locations
  Clone ID: LIB3066-030-Q1-E1-A2
cacatgcgtccgcccacacgtccgattttaaataaaaataaagctcgacgtcgtcgtcacctctctcgccgtccacgagtcacggcgagcggcgtcgacggcgggcgggggtcctggccgttcaccaccatgcctgaccccaccaccaaacccccttcgccacgcccccgccgtcgccgcaagctctgcggnctctgcctcgggaacgcgctcctcgcgctcctcgttggcgcgctcgttc

SEQ ID NO: 46805 - DNA, 422 bp, Zea mays
  Clone ID: LIB3066-030-Q1-E1-A3
cagggtcgaggacgcgtccgcctcagtatgcacgtggtttagctgctcttggacatcaattgcatgcgcttggttttatagaatctccagaactaggtttagaagctcccttggcccatcatttgatgcacttttatgagatgatgggtgacacacttgctgtacagtatagcggttctgctgctcataacaaggtattctctgcaaagagaggtcacttgaagctttttattcagtcacaagagttctttaggacacttcagcggcactacagcaacacctgtatagatgctaacaaacaggctgctataaacttgtttttgggatacttccagccacagcaggaaaaacctgcactgtgggagttagaatcatctgctgggaagcataacaataatctttttgatgggcacccaagtaca

SEQ ID NO: 46806 - DNA, 395 bp, Zea mays
  unsure at all n locations
  Clone ID: LIB3066-030-Q1-E1-A4
cccacgagtccggggttctccgccgggcttgtanacgacagcaacatcttcgagtggcaggtcaccatcatcggaccgcctgacaccctatatgatggaggctacttcaatgcaataatgaccttcccccagaactatcccaacagcccgccatcagtaagatttacttctgagatgtggcatccgaatgtttatcctgatggacgtgtttgcatttctgttcttcatccacctggtgaagatcccaatggttatgagcttgcaagcgaacgatggacaccagtgcacacggttgaaagtatagttctgagcatcatttcgatgctctctagtccaaatgacgagtctccagcgaatatcgaagctgccaaggattggagagaaaagcgggatga

SEQ ID NO: 46807 - DNA, 323 bp, Zea mays
  Clone ID: LIB3066-030-Q1-E1-A5
ggcattagcgctggccgccgcgctcggcccggccacggcgcgcgcccatctgcggcgggaccaccaggcgccgccgggcccgcgcccgcacagcgtcaccatcaccgaattcggcgccgtcggggatggcaagacgctcaagacggtccccttccagaacgccgtcttctacgttcgctccttcgccgacaagggcggcgcgcacctgtacgtgcccaggggccgctggcccaccgggagcttcaacctcaccagccacctcatcctctacctggaggaaggcgccgtcatcgtcggcgcaaaggactcatcacaatggctga

SEQ ID NO: 46808 - DNA, 416 bp, Zea mays
  Clone ID: LIB3066-030-Q1-E1-A6
gactagatctaggaaattggtgcttcaaaaacaagagagcttatccagtttgtcattgcaatgccacaacttgattgatgtggatcttactgagtgcgagtcattaacaaatgcggtttgtgaagtatttagtgatggaggtggttgccctatgctaagatcattgatccttgacaattgcgagaatttgagcattgtagaactgaacagcagttctttgtcctgcctctctcttgctggttgccgctcgatgacattgttaaaactctcatgcccaaatctgcaacatgtcaatcttgatggctgtgatcaccttcaaagtgcagcattctgtccagtgggtctcgaatccctaaatctgggaatttgtccaaaattgagtgttcttcacattgacgctccaaatatgtctatat

SEQ ID NO: 46809 - DNA, 200 bp, Zea mays
  Clone ID: LIB3066-030-Q1-E1-A7
cggccactgaccgactcacgcgcgtgaaccggacggcgtaccaacaatgctgcatggccaagggttgcgcctcaagatggctactaaattttcccccttttttctttatgttttttcattttaacgtgtttcattcacccatcttattgtgattgatcgcttgcaataaaaaggccatctttactaactaaaaaaagaaa

SEQ ID NO: 46810 - DNA, 159 bp, Zea mays
  Clone ID: LIB3066-030-Q1-E1-A9
acggacgcgtgggcggcaatgctgtcatgcttaaacatgtgtcgctgctgctccgtgatgccggcgacggctgctattagtgttaatgttagtgtcgatcgggtctccttgaacaatggcaggaatctgttgcttgtttactttcttctaatggcaagt

SEQ ID NO: 46811 - DNA, 374 bp, Zea mays
  Clone ID: LIB3066-030-Q1-E1-B1
accacgcatccggccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggtggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgagaggcgcagtgggccacggcacagaggacgctgcacggcctcaac

SEQ ID NO: 46812 - DNA, 412 bp, Zea mays
  Clone ID: LIB3066-030-Q1-E1-B10
cccacgcgtccggaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgctccgtcgcgtcggggctc

SEQ ID NO: 46813 - DNA, 423 bp, Zea mays
  Clone ID: LIB3066-030-Q1-E1-B11
accacgcgtccgcggacgcgtgggcggacgcgtgggcagccccagcagcgctgtctcatgttgctgaagcagtgtttatacacgaagctggacacctgagatgcagtcgctctgagattggtagatttgtttccatgcttcggaatccttcaccaattcttcgtgcttgtgctgcctttgcccttcttcagttcacaatcccaggaggtcggcatgcagtgcatcacgcaggtctcttgcaggaagcaggggcaggtcgggtgttgcgcgcaacagcggcagcgacaacagcttctattgaagctaaaatctttgccaggattgtactcacgaacttggagcaccatcagttagggatgtcaacatgaacacccagcagaggttcatcctccaataaacaaaggcctctgcatcgatgggctg

SEQ ID NO: 46814 - DNA, 76 bp, Zea mays
  Clone ID: LIB3066-030-Q1-E1-B12
gcgtgggcggacgcgtgggttctagatcgctatctgcagctctccatctttaccgaataattcgtcctcttaattg

SEQ ID NO: 46815 - DNA, 422 bp, Zea mays
  unsure at all n locations
  Clone ID: LIB3066-030-Q1-E1-B3
aggaggaacaaactttagagtgttaagagttgaagttggtgctgggtctgtggtcacccgtcggaaggttgaacttcccatccctgaggaattgaccaagggtacaattgaggagctattcaactttgttgccatgactctaaaggaatttgtagaaacagaagatgggaacgatgaacaacgagcgcttggtttcacattttctttcccagttagacaaacatcagtatcttcggggtcattgattaggtggaataaagggtttttgattgaagatgcggttgggaaagatgtggctcaatgcttaaatgaagctcttgctangaatggactaaatgtgcgagttactgcactggtgaatgacaccgtggggacattagctctaggacattatcacgatgaggatacagtggctgctgtga

SEQ ID NO: 46816 - DNA, 433 bp, Zea mays
  Clone ID: LIB3066-030-Q1-E1-B4
accacgagtccgggttgattcatcacctgccttttgggattcacctgaggggactgacaaaactacagtactgattctggctgatccacactgctcatacgaagtcacttctcgtgcttcactaagtgatgcggcaagcagattctttttgttgtactcatcagagattcttggtttcatggtggccataatgttttttggaattatgcgacagacttcagcatgggaatgtgattcttctatgccatccattttgtcagccatagagtctaatcttggactcccaaaggcattcatgtttctttgcttcatgccaatacttgtattttgtgcctttttcattttcacggcggagcaaaaaccaccatttgggaccttcttattggttactctgatctgctacatagttgctaatggtttcacaattttgttg

SEQ ID NO: 46817 - DNA, 411 bp, Zea mays
  Clone ID: LIB3066-030-Q1-E1-B5
cccacgcgtccgatccatctcgcccgcgagatggatggggacaggttgatgtcgtgagtgggaatcgggacacgggcgagccgacggtgggtctccatccatctcgcccgcgacgtttgatggagtctctcctcgcctcgcgatccattaggtcttccttctccgccgtcgccagcatcaggggcgccgcttcccccaggccctcgcgcgtcgccaccctcgccagcgcctgcgccggcgcccgctcccgcgcgctccgtgctggccacacggactcaatccttgaggtgctggcacaggacgatatgctgaacgcaaaggagctggtccaatgggagaatggcttgtcattcaatgacatagcggctaggcaggggattcgcatccgcagacactgccgccccactgcct

SEQ ID NO: 46818 - DNA, 386 bp, Zea mays
  unsure at all n locations
  Clone ID: LIB3066-030-Q1-E1-B6
cccccccccccttgcccccgccccaaaatccggcaccgcccgctgctcgaacccgcaccccacgcccgcaggccgggaccggtgggcgcgcgccgggcagtangagggagaggaagggcggcatggcggcgccgccggcgagggcccgggccgactacgactaccttatcaagcttcttctcattggggatagcggtgttggcaagagttgcctcctgttgcggttctctgatggttccttcactacaagctttattaccacaattggtattgactttaagatacggacaatagaattggatggtaagcgtataaagctacagatttgggatacagcgggccaagaacgcttccgtactattaccactgggtactaccgtggagct

SEQ ID NO: 46819 - DNA, 428 bp, Zea mays
  Clone ID: LIB3066-030-Q1-E1-B7
cggacgcgtgggcgagaggagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgcctcggggccctccgccagcagcggcgcgcccgccctcgccgccgcgcccggcgcgctcctcttctccctcctcggctactacctccactaagcgtgtgcgtgcgt

SEQ ID NO: 46820 - DNA, 367 bp, Zea mays
  Clone ID: LIB3066-030-Q1-E1-A11
cccacgcgtccgtgccgctccagcctttcgctagggtttatccaccggcggcgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctggaactgcagttagagaaaggatcatccgtgctttcctggttgaagag

SEQ ID NO: 46821 - DNA, 440 bp, Zea mays
  Clone ID: LIB3066-029-Q1-K1-G6
actgcagcgaggagagaggaaagagaaaaaggaaaggaaaggacgaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaagcggtgggcagaact

SEQ ID NO: 46822 - DNA, 437 bp, Zea mays
  Clone ID: LIB3066-029-Q1-K1-G7
cagcaattgaagggagttggtttggatcttgggcaccagagaggatgttatgggatcacattatttataaaccaatacgggcaatgctcggaggacgtctaagatttgttctttgtggtggtgcacctctgtcaagtgacacacaaagatttatgaatatatgtctaggtgtcccagtgggtcaaggctatggattgactgaaacttgtgctggagcagctttcactgaatgggatgatacaaatgtgggtcgtgttggtccaccacttgcttgctgctatgtgaagcttgtctcatgggaagaaggtggttacaagatttctgattctgcgatgccgagaggagaggtcgtggttggcggacacagtataacataaggttatttcaacaatgaagcaaagacgaacgaagtatacaaggttgatgagaggggcata

SEQ ID NO: 46823 - DNA, 425 bp, Zea mays
  Clone ID: LIB3066-029-Q1-K1-G9
atcacaataagatggcgtgtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaagggaaagctc

SEQ ID NO: 46824 - DNA, 444 bp, Zea mays
  Clone ID: LIB3066-029-Q1-K1-H1
cccacgcgtccggaggccgccgcccagaccgcctccccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctgcctttctttctcatcttatgaaaggagatttgccacgaggaactacatgacccagagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctgtttcgaagactgcagctgctcccattgaacgagtgaagctgcttattcagaatcaggatg

SEQ ID NO: 46825 - DNA, 424 bp, Zea mays
  Clone ID: LIB3066-029-Q1-K1-H11
cccgttcgcctcttctactgcctcctgtcgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtggactacgagaagatcgtgcgcgacacctgccgcgagatcgggttcacctccgacgacgtggggctcgacgccgaccgctgcaaggtgctggtgaacatcgagcagcagtcccccgacatcgcgcagggcgtgcacgggcact

SEQ ID NO: 46826 - DNA, 444 bp, Zea mays
  Clone ID: LIB3066-029-Q1-K1-H12
cccacgcgtccgcccacgcgtccgaccatgaacccctcgggcgagctctccagcgccggcttcagcgagaaggagctgatcagcgccatcgaccgcgaggccgtgttcacgtacgcggaggacgcggccagcgccagcctgccgctgatgcagaagctgcgcgccgtgctggtggaccacgccctcagcagcggcgacgcggagcgggagccctccgtgttctccaagatcaccaggttcgaggaggagctccgcgcggtgctgccccaggaggtggaagccgcccgcgtggcggtcgccgagggcaccgcccccgtggcgaaccggatcgcggacagccggtcgttcccgctgtaccgcttcgtgcgcgaggagctcggctgcgtgttcctgaccggcgagaggctcaagtccccccgcgaggagtgcaacaaggtgttcgtc

SEQ ID NO: 46827 - DNA, 430 bp, Zea mays
  Clone ID: LIB3066-029-Q1-K1-H3
cccacgcgtccgcggacgcgtgggttccactttgctcatctccgccaacttcctgttttggtcccttatattcctacagaaaatcctcagctgagtgatactgcatatgaggttgcccttgttgctctaactaccaatccttctttccatgaacttctcttgactactataaaaaattggccaccaacattatactcagcctcaccggtcatatctgccattgagccacagctaaactcctcatcgatggctgattcattgaaagagtcattagctgaattgtatgtgatcaatggtcaatacgaaaaggcactttctctttatgctgaactcctgaagccagaagtattcgagtttattgagaaatacaacttgcatgatgccattcatgataagattgtcaatcttatgatagtggacaataaaagaa

SEQ ID NO: 46828 - DNA, 191 bp, Zea mays
  Clone ID: LIB3066-029-Q1-K1-H4
taccgtctcggaatgctcgacccaagcgaccgaattcgttgatcaatccgcggagcgccatacatatgtcgatccatattgtatttgtgtgttgatagtatatatcgatgtggggtacgtttatatgtacctgccattgtcatttcattaggtacgttgttgcaaacttttaccacagtatttatcttcac

SEQ ID NO: 46829 - DNA, 441 bp, Zea mays
  Clone ID: LIB3066-029-Q1-K1-H6
cccacgcgtccgcggacgcgtgggttcgaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcg

SEQ ID NO: 46830 - DNA, 421 bp, Zea mays
  Clone ID: LIB3066-029-Q1-K1-H7
cacaagacattgaagcttctgaagtattggacctggcaatttgttattgttaggccagtatgttccattctgattattgcactccagcttcttgggctgtaccccagctgggtcagctggacgtttagtattatactgaacttttcagtctccatggccttatatgcattggttctcttctaccacttgtttgctaaagagctggcacctcacaagcctcttgcaaagttcttgtgcatcaaagggattgtcttcttctctttctggcagggttttgcgctcgatgttttaacccaagcaggcgtgatcaaatcccaccatttctggctggacgtggagcacatccaggaggcgatccagaacgtcctggtgatccttgagatggtggtgttctccgtcatccagcagtacgcataccacg

SEQ ID NO: 46831 - DNA, 446 bp, Zea mays
  unsure at all n locations
  Clone ID: LIB3066-029-Q1-K1-H8
cggacgcgtgggtgccaagagcattgatctggtccaaagcacagggagtatcaccaccgttgactgtacaaatattgatttgacgagcaaaaaaggcagctccactggaacttgtgataagactgttgatgcaaaatacaacacaagaagcattaccagcaatgctaccatgaacacttacgtacaacccacttctggaagttttgccaacagacttgcgaaaaatgttgatgtaaatccgaacattggatccatcagtaatagagatgccaagagttctgatatgaaggcccacatgggaagcaacaccatcagtgacgccaaaagctctattgtaaagctagatacaggtaacatcactgatagaaatgccaaacctgtcgatataaagcccaactctgacaacatctncagcagagatgacaagagcagtaatgtggatacta

SEQ ID NO: 46832 - DNA, 430 bp, Zea mays
  Clone ID: LIB3066-029-Q1-K1-H9
cccacgcgtccgggtcaatgatgttaaagatgacctgtctcaaattggatttgatgtcgaatcaattcagaaaatggttgctggattggagggaaagatcgagttacttgagaacaaacaggacgtggctaatactggtatctggtatctctgccaagtagcaggcggtttaaaagatggaataaacaccaggtttttccaggaaaccagtgagaagctgaagctctcacattcagctcaacctgaaaacaagccagtgaaggggcttgaattttttttcggaaagcaccatggaacagaaagtagctgactccaaaccaattgcggtgacagtcgacgctgagaagcctgagaaaaccgctgctgtaatgggcaccacagtgcacaggtctatcaggttctcatatcggaatgcaggccttgctttgtg

SEQ ID NO: 46833 - DNA, 364 bp, Zea mays
  unsure at all n locations
  Clone ID: LIB3066-030-Q1-E1-A1
accacgcgtccgcccacgcgtccgcccacgcgtccggtgcaggggcagttccggtcgctggtcctgtcgtacaaccagctgacgggcccgatcccgcgcgacgacgcgcgcgacgagatcaacaccgtggacctctcccacaacaagctgacgggcgacccctcccacctgttcgccgccggccggcccatcggcaaggtggacctgtcgtggaactacctcgacttcgacctgagccagctggtgttcccgccggagatgacgtacctggacctgtcccacaacctcatccggggcaccgtgccgctgtcgctggagccgctgtccacgctgcanaagctggacctgagctaaaccgcctgtg

SEQ ID NO: 46834 - DNA, 413 bp, Zea mays
  Clone ID: LIB3066-030-Q1-E1-A10
gggcaccatctcacaaaaacctgacctacgagctggtgcagaaaggtccggcgacggatgtgtccggacgtcccgtatccacagcgacgaacgcgtcgaacccgtggtggctgacgttcgagagggccatcgcctccgcgggtggggagctgtctaagcctgagatcctgtcttcgaccacggactcacgctttgcgcggcagctgggcatccctgccctcgggttttctccgatgaccaggacgcccatactgctacatgaccataacgagtttctggaagacagagtgttcctgaggggcatccaagtgtacgaacatgtcatcagagcactaagctcgttccaaggctgattcgtaaaaaaaaaagaaaagaagaaggaaaagtggcagtgctgttgcgtggagtgtaac

SEQ ID NO: 46835 - DNA, 436 bp, Zea mays
  Clone ID: LIB3066-029-Q1-K1-G5
gtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaaggactacgtggtcaaggcggctgaggtcaccaaggcctgcaacaccacctgcgccaaggagaagcagcctctgctcagcgagaactgcaggaggtcctgcacccctcctccttcctgaacgcagagcacgcccgccggtcgtcgtcttctgcctgcttgcgtgacactgaatcactgatacatcatacatgcatgcatgggatgcgatgacgatttgatgcatgcatgcatgggtataccta

SEQ ID NO: 46836 - DNA, 413 bp, Zea mays
  Clone ID: LIB3066-029-Q1-K1-F12
cccacgcgtccgcccacgcgtccggtgatgagcttgatgccgtctgtgctgccgtcggaaacgtcccctttgtgtcagcgtcacctctgtatagtgatcaagctgaagcagagcgtgcatctattcttgagaactttcgtcaagaaacaactcagtggaataaaactgctaaagctaccaatattgccgaaagttctaagcttgaaagtactggctctaaaataagcattatagttgcaacagatgcttgcttgcctcaggcagcgatggcagaggcaccccttatggctcgagtgctgataaactatgagcttcccacaaagaaggaagcttacttaagacgcatgtcaacatgtttggcggcagacggaattgtgattaacatggtcgttggtggtgaggtggttacactc

SEQ ID NO: 46837 - DNA, 439 bp, Zea mays
  Clone ID: LIB3066-029-Q1-K1-F2
ataaaaataaataaaaagtgagagagggaggaaggcgcacacttcctccttccttctttccctcttcgtcttcgcttggccggtgggtggtgcggtggggatgcggcggctatggcggtggtaccagcagtgcctggccgcgcacccggtgcgcacgcaggtcgtcagctccggcatcctctggggcctcggcgacatcggcgcccagaccgtcacctactactccgctcgccccgaccgtcgcggccacgacagcagccctcccgaccccgaggataaagataataaagacaataaagagtttaaagttgattggaagagggtgggcatcacaagctccttcggatttgcttttgttggtccagttgggcattactggtatgaatacctggatcgcatcatccggcggaggtttcagcctaacacgttcaaattcgtc

SEQ ID NO: 46838 - DNA, 439 bp, Zea mays
  Clone ID: LIB3066-029-Q1-K1-F3
cccacgcgtccgggttactgaaattttcaatttttcacaagatgatctgttgaccgaagacatgatgatacttgatacacactgtgaggtttttgtttggatgggtcagtgtgtggagacaaaagaaaaacagaaagcatttgacattggccagaaatacgtacgacatgccgtggcctttgaaggtatttctcctgatgtgcctctctataaagtcaatgaagggaatgaaccttgcttcttcaggacatacttctcctgggatagcgcacgatccgtgattcatggaaactcttttgagaagaaactttcagttcttttcggaatgcgttcagagggtggcaataagggctcaggtgatggtgggccaactcaaagggcatcagccttggccgctctttcatctgcattgaatccatcgtcgcaaggaaaacagtca

SEQ ID NO: 46839 - DNA, 435 bp, Zea mays
  Clone ID: LIB3066-029-Q1-K1-F4
ggagcacagagctagctagccagccagccagcagccagcttgctcgccgcgcccgtcgttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgccttcttcttcgcctactacattcagtgagccggccgcggccggtcgcccggaggccgaagaagagacgaagcgggagagagagtgacatggctgcgcgcattccgatgcgtgggcatgtttttgattcgacacaccttttgtcctctttttctttggtccctctttc

SEQ ID NO: 46840 - DNA, 370 bp, Zea mays
  Clone ID: LIB3066-029-Q1-K1-F5
atgaagtactgccccaacaagttgtgtactgccaacggcgcctccaaggtcaccgtcaaggacatcaccttcaagaacatcactggcacctcctccaccccggaggccattagcctgctctgcactgccaaggtcccatgcaccggcgtcaccatggatgacgtcaacgtcgagtatagtggcaccaacaacaagaccatggctatatgcacgaacgccaagggcagcaccaagggttgcctcaaggagcttgcatgcttctagaccctcagtcgactgacccatctctctagttataatttttctctcgtccttgaattgtccattagttgctatccatttgtaacgcacaacagtaaaataatatagc

SEQ ID NO: 46841 - DNA, 442 bp, Zea mays
  Clone ID: LIB3066-029-Q1-K1-F6
cggacgcgtgggcaaaccctaaacccctaccggcacgcggcggccgtctccccggccccgtcgcccgtcccgcaccgcggccacccgccgccgcatgccgtcctgcacctccctccccgccgccgcctagcgggcggcgccgcccggccgctcgccgtcgctgccgccgtctcgggggccgtcaacgaggccaggaggcgtggggttcctcaagagggcggggaggacgggaggaaggacacggacctcgccacgctcggaaacctatgcgtcgacgtcgtgctcagcgtgccccagctcccgccggcgcagcaggaggagcggaaggcctacatggagcgactcgccgcctcaccgcccgatcagaaattttgggaggctggtggaaactgcaatttagcatttgctgcagctaggcttgggcttaactgttccactctgg

SEQ ID NO: 46842 - DNA, 437 bp, Zea mays
  unsure at all n locations
  Clone ID: LIB3066-029-Q1-K1-F7
gaaagtccccggcctctctcttctcgcctcgcggcgttggattgaatggcgacgacgatgaacgtcagggcgctgtgcctggccgtcgcgaccgtcttctgcgtgctctcacggcagagcctcgccgccggcgagggctccaaggaggcggacaggatcgccacgctgcctgggcagccaccggacgcggccgtccagcagtactccggctacgtcagcctcgatgacaaggccggcaagtcgctcttctactacttcgtggaggccaccgctgatccggctacgaaaccgcttcttctctggctcaatggagggcctggctgctcttcgtttggaatcggagcattccaggagataggtccgttccgcgtggacacagatggcaagacactctgcaattntaaatatgcctggaacacagtggcgaacgtgctgta

SEQ ID NO: 46843 - DNA, 439 bp, Zea mays
  Clone ID: LIB3066-029-Q1-K1-F8
cccacgcgtccgggtcaaaatagtggtagcgctacaagtttaagttcttctaccggacttatggggccatgtttctccatgaatggggtttctggatcagcaactatggtgcctaaagttgatgctgctacaagttcagctatagctgcgcccttggtagcttcagatgttaaaccctctcagccggtcagtaattcagctaccaagatgattatgtcaagcaaatccactgctaaggaatttaaactcaatccttgtgcaagggttttctctccatcttttgcaagttctaggcaagtacttgcagctatggcccctgttgacacatactacatttcacactctgcccctgaagtaccaatgggcgtacctgtatatgagtcaaagtctgtgcctggcgtttcacctctaaccaacaaggttcattgtagtaacctgt

SEQ ID NO: 46844 - DNA, 403 bp, Zea mays
  Clone ID: LIB3066-029-Q1-K1-G1
cccacgcgtccgatacgaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacg

SEQ ID NO: 46845 - DNA, 411 bp, Zea mays
  Clone ID: LIB3066-029-Q1-K1-G10
ctttcgttatcctcctcgatcttaattacaggtcatagctaagcaggtctgacaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaaaggatctggaggcataactgtgaaaaagacagggcaagcgatggtggtcggcatctacgacgagcccatgacccccgccagtgcaacatggtggt

SEQ ID NO: 46846 - DNA, 425 bp, Zea mays
  Clone ID: LIB3066-029-Q1-K1-G11
cccacgcgtccgtccacgcgtccgcccacgcgtccgataccatttgttaagaaggcgcctcaagtgacatttaaaaagcctattgggagtgtcagcgtctctgggcacaagtttgttggatgccccatgccatgtggtgtccagataacaagattggagtacataaatgccctgtctagcaacgtggagtatctggcgtcaagggatgcaacaatcatgggaagcaggaacggccatgctcccatcttcctctggtacaccctcaacaggaagggctacagaggctttcagaaagaagtccagaagtgcttgagaaacgcacactacctaaaagatcgcctcatggaagcacgaatcggagcgatgcttaacgagctcagtagcacagttgtgtctgaaaggccataggatgaagtatttgtccg

SEQ ID NO: 46847 - DNA, 438 bp, Zea mays
  unsure at all n locations
  Clone ID: LIB3066-029-Q1-K1-G12
aggctccccaaagatagcatagcagcagcactcacaatagcaaaaaccaccatccgtcgtcgcgaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcaaggcgccggtgccgccggcgccgcgccggcttgatcgcccagcgcattcatcgcttcagctcgatataatcgctgctccgtcagcaacccacatatgattcgatcaattntcctgctctaatttctcgaccccgtcgaatttttttcctttctattcttc

SEQ ID NO: 46848 - DNA, 444 bp, Zea mays
  Clone ID: LIB3066-029-Q1-K1-G2
gaacaatcggaagccttaccatagtgtgaactttgtaattgctcatgatggatttactttatgtgaccttgtttcatataactccaagcacaatgatgcaaatggagaaggtggtcgtgatgggtgcaatgacaactacagctggaactgtggcattgaaggagaaacaaatgatttgaatgtgctaagtcttcgttcaaggcaaatgaagaacttccatgtggcattaatgatttcccagggtactccaatgatgctgatgggagatgaatatggtcacacacgttatggaaacaacaatagctatggacatgatactcacataaataattttcagtggggccagttggaagaaaggaaggatggccatttcaggtttttctcagagatgatcaagtttcggcataaccatcctatattgagacgagacaggtttctcaacaa

SEQ ID NO: 46849 - DNA, 375 bp, Zea mays
  Clone ID: LIB3066-029-Q1-K1-G3
cagacgcgggctcgaacgcggaaacccgaagcctgcgacggacgcctgtgacatgacggggctcacaagcaatgcgatgagagcctcgaacactgatgctgactactctgcatggcgcatagtgagacatgaagatgtcaaagggcttacaatgctatagcatacgcacctggagggtccatcaacgtcacctagctgatcacctacggccctggcagaacacacagcgcgcttgctgtgcaactcgcatgagcctaggagtgcggcagcacttcgaatgtgaccaacctgatacgctgagacgactgttctgtacgtccactaaactctacatgcccttgctgggacgacctgaccattcatgtgcatgcgcat

SEQ ID NO: 46850 - DNA, 446 bp, Zea mays
  Clone ID: LIB3066-029-Q1-K1-G4
cttgaatgacacaaggtttgagagggccatgcgattttatttcgtgtatctccgattggattggctctggtcacttaacctatttgctttgattctattgaatttcctagagaagcctctctggtgtcaaaagtatgccccacatacttgtgatcaaagggatctttactttcttggacagttgccatacctaagcaaaacagaatcactcatatatgaggtaacgcttccttgacatgtgtagtgcttgtgcttcagtgcccaggcaagaacttaatgactcaaaccttaaagcgttattatggtcagtagtgtgtttcagggcatgtatatttaccttcagtttccctgaagcattcttttacaagttttctgactttcagttggagttggagctatcatagtatgcaattgtgcatgttttgaatgaaaatatatagcttctt

SEQ ID NO: 46851 - DNA, 426 bp, Zea mays
  Clone ID: LIB3066-029-Q1-K1-F11
cccacgcgtccgcgcccggccccaagctccgcggaagccaggagactgtgaacccgggcccggtggtgtccggcgccggcgccgaggaggccgacaagcaggagggggcggcggccctggaggagaagaagaagaggaacatggccaaactccgcggcggtgcctaggcccagcagagcacaaggatcggagcaggtgcctactgcctaggcccagtctgccaggccgcgctgcgctcccgtcatcatctattcatctcctcacccagattttgcttccctcgctcgctctctcattcgtttgtgcagctgattacgctaggtctatttacgcaactgtcctgtgtcgaattttaacagcgacggccatgcaccaaacccccaccccacacatcattttgtttcttcctttcttttgattcgacga

SEQ ID NO: 46852 - DNA, 469 bp, Zea mays
  Clone ID: LIB3066-014-Q1-K1-E6
gtcagaaaatagtgggatcgagttgtttcactgcacgagcacatcctccggcgacgaccgggctccctctccgtcgtctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctggggaggcaccaagtacatggtcatccaaggcgaacctggagctgtcatccgtggcaagaagggatccgggggcatcactgtgaagaaaacagggcagtcactcatcattggcatctacgacgagcccatgactcccgggcagtgcaacctggtggaaaggct

SEQ ID NO: 46853 - DNA, 355 bp, Zea mays
  Clone ID: LIB3066-014-Q1-K1-E7
atcgtcacactggtgagctctgcattctgcattctgcttagctccgagcttcagtgccttcgttgctagctgttagctccacagttcacagttccacacacacattcagctgcactgtaacaatggcctacttcatggttcacgtattgactgatgctcccgactaggaagctgctgctgatgttgcagcggttgtacaccctccgcaactgtaagatctctatatcagagctgacgaaagcgctactgacgctgtggtccacctctgccgactaggtgcagcgcatgattgcctagatcctacaccgactgctactgctgcatcgacttcaacgagttcatcaccttcttcaac

SEQ ID NO: 46854 - DNA, 448 bp, Zea mays
  Clone ID: LIB3066-014-Q1-K1-E8
gcgtcgttctctcttcctggtccaagtgatcttgccaagttacgagcagcgagcagagatcggatcatccatcggcaatgtcgaacatcgggcagtccttccaggccggcaaggctgaggcccagggcgaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtgtggcgggcgtggcggcgggcgtcacgaacacggtcacgggcgccgtggcgggcgtcacgaacacggtgaccggcgcggcggcgggtgtcaaggacaccgtgaccggcggccactgatcgacgacccaagaatgcttcatg

SEQ ID NO: 46855 - DNA, 437 bp, Zea mays
  Clone ID: LIB3066-014-Q1-K1-E9
agaagttcaaagaaaaggttcctctgtcaatgcaaccaatcagctggtctagtgagaaatactatttgaggcagatcttgcctctagtacgaaaacacaaggttgtacgttttagcaagacagattctcgccttgcaaacaatggcctgcctctgaagctccaaaaacttcgctgtcatgttaactacaacgcattgagatttgccccatctattgaggctctaggaaacaagatgatctcaactctcaggagaactggatcttttgttgtgcttcatctgagatatgagatggatatgcttgctttctctggttgtactcatggatgttctgatgaagaaacagaagagttgacaacaatgagatatgcatatccctggtggaaagaaaaggaaatagactctgagaagaaaaggcttgagggattgtgccccctt

SEQ ID NO: 46856 - DNA, 360 bp, Zea mays
  unsure at all n locations
  Clone ID: LIB3066-014-Q1-K1-F1
gcgcggacgcgtgggcgcgtgcatgcgcagacgttgaggtcgagggacacggtatctctgagctgcatcagggagcgacccgccaccgccacgcttggccgcaagccgagaagagtgccgggccgggagaccggacgataattgatccgtagcagattcgctaatggcggagacggcggacatggagcggatcttcaagcggttcgacaccaacggcgacggtaagatctcgctgtcggagctgacggaggcgctacggacgctggggtccacctctgccgacgaggtgcagcgcatgatnggccgagatccgacaccgacggcgacggctgcatcgacttcaacgagttcatcaccttc

SEQ ID NO: 46857 - DNA, 449 bp, Zea mays
  Clone ID: LIB3066-014-Q1-K1-F10
cccaattccgggtcgaccgactcgttcgcccactcgtccgcccacgcgtccggaatgatcttcacaactgcttcggctacaccggtgagggtgtggcaattaaagttatccggaataagcagaccggacagtctgaaggatacggatttgttgagttctacagccatgctgcagctgaaagggttcttgaaggattttctggtcatattatgccaaacactgaccagccctttagattaaactgggcatcgtttagcatgggagataggcgctcagatgttgcttcggatcattccatattcgtaggcgaccttgcttccgatgtcaatgatgccacactgctggaggttttctccagcaggtactcctctgtcaaaagtgccaaagtcgttatcgatgctaacactggtagatccaagggttatggcttcgtgagatttggagatgac

SEQ ID NO: 46858 - DNA, 415 bp, Zea mays
  Clone ID: LIB3066-014-Q1-K1-F11
cccactcgtccggcgatgagagccttgttcctcctggtcctgttctgcatcgtgcatggtgggaaggaagagtcaaagggcatcgatgcgaaagcgtccggtcctggtgggtccttcgacatcaccaagttgggcgcctgctgcaatggcaagacagacagcacgaaggctgtgcaggaggcatgggcatagtcgtgcggcggcactgggaagctgacaatcctcatacccaagggcgacttccttgtctgacaactcaacttcacaggcccttgcaagggcgacgtgaccatccaggtggatggcaatctgctgtcgaccactgacctaagccagtacaatgtccatggtaattggatcgagattctactcgtggataacctggtcatcaccggcatgggaaaccttgactggc

SEQ ID NO: 46859 - DNA, 417 bp, Zea mays
  Clone ID: LIB3066-014-Q1-K1-F12
tcacgacaagatggcatgcacaaacaatgcgatgagagccttgtgggtcctggtcctcttctgcatcgtgcatggtgagaaggaagagtcaaagggcatcgatgcgaaagcgtccgggcctggtgggtccttcgacatcaccaagttgggcgccttcggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctgggcatcaccggcaaggg

SEQ ID NO: 46860 - DNA, 469 bp, Zea mays
  unsure at all n locations
  Clone ID: LIB3066-014-Q1-K1-F2
gcgtgctatgctacagcaacatataacccatagagataattcagtagatctagtagtttaactcgataattgttggatttcaatacattcaggttcttgctaatttgatcggttttaaatgtttgatggaatcggttggactgtggaccgaggccggcgaatcaatcaagaacgccatctcctaggttagggtgtgttggacctgccatgggggacaggccggcgccgatcgagaaggtcgcggtgccggagaagatggccttgttcctccacgccgccgtcacgtcaccgggacaccagcagcagcacggctgccttcgtcgcacgaggcgcccgccgcgaacatcacgccgcggacaacagccaggaataagcagcagcacctgccggtgagccccggngcgtgcctctgctcgccgaccgttcacgagggctcgttccggtgcaagcttcaccgcggcagcggcag

SEQ ID NO: 46861 - DNA, 364 bp, Zea mays
  unsure at all n locations
  Clone ID: LIB3066-014-Q1-K1-F4
ggcggcgagggaagggctccgcgtcgtgtcccttctcttcctcctcctctctccaacacccgatccatgagcgctgccctccgcattgctcttgataccatccagtacatcgattctgcccccaagatcaaaggccggagaaggaggaagaaaggttagggagtcggctatggcatgcttcttcctcctgccaacgttgtcgtcatctgccacacgcagcatcacaaatagagagagagacaaaaacaaagaggggtcgacaagcactgacacgacccatgtcaatgtggcgcgtcttccgctccctccttcgcgcccgnctaggcggtcgggcgcggcgccgtgcccagccggtgggtcccgc

SEQ ID NO: 46862 - DNA, 293 bp, Zea mays
  Clone ID: LIB3066-014-Q1-K1-F5
cctgagatgcgcaaggaagctgtgttcgagcggggagacgcggtggatggactctccaacgtgagggacatgcaggcacataattttctatctaaggatgcgaagtagaggcgcagaaaaaccatccatcctagagcagcataagcctgctgcatttgtaatatattcgaaatccgtattttttttcttcacaagcactactctatatacgatgaataaaagggcgacaatacagtgtcaaaaaataaagacgcttgggtccaactatgccgacaaggtgcagcgcatgatgg

SEQ ID NO: 46863 - DNA, 421 bp, Zea mays
  Clone ID: LIB3066-014-Q1-K1-F6
catgccggcaacgtcgcggtagcgcctgagcgtgaggagcaccaacgccgatccggtccgggcgatggtcaccaggccgagcgtcgccgacgcgtcattcccatcctcgtgttggacggaggaaagtagaggatcaaacgaatgtggcctcagctgaagtgctagacctcggcgataatggtggccatcgcggggggtgaggacgactagatgttgggtaggcgcagctgctgccgacagaggctgatgagctgttcgtggacacaggggtaggaagggaatgtagattctacaaatggccattaactccgaagccgataccaaacgttcaagaagaccagtattataatgtcagtgtgagaattgcgttcttcggaatgccatcttttttaagcccgttgtagccgatgccaacgttgaa

SEQ ID NO: 46864 - DNA, 416 bp, Zea mays
  Clone ID: LIB3066-014-Q1-K1-F7
gtcggaacaaggaaggcgtgcgcgccacttttgccaagaaggcggcgctcctagggctggggttgtttaggcaaatggtggaggatgggctggagatctcagatgtcacggtgacaggcgtgctgcatgcttattctattactgctgataggaatgagtgcgagcagcgttatgcgaatgctatcacttgtggatgacgattcaagcttacatatattatatccagacattgcaatgtacatttcatatagcctatcctgagatgcatagacttactgatgcaaaagttcacgaagagcttgatgacactcgttctgctggtcagtctgttaaacaacaccactcggctgatctttaagagaaacttggtgacttgagtactgatctacaagtttggtcgtaaaaaaatgttctat

SEQ ID NO: 46865 - DNA, 469 bp, Zea mays
  Clone ID: LIB3066-014-Q1-K1-F8
cccacgcgtccgcccacgcgtccgggcgtcgggaatggccgtttgtgacgaatgcaaactcgagttcctggaactcaaggcgaagaggagcttccgtttcatcgtgttcaagatcaacgagaacgtgcagcaggtggtggtggacaggcttgggggaccaggtgaaagctacgatgcgttcagggcctgctttcccgccaacgagtgccgctacgcggtgtttgattttgactttgtcactgatgagaactgccagaagagcaagatcttcttcatctcttgggccccagatgcatcgagggtgagaaggcaagatgttgtacgcaagctccaaggaccggttcaagagggagctcgacggcattcaggtggagctacaagcaactgagccgagcgaaatgagcatggacatcatcaagtcgcgagccctctgaaacagcccggcatcagctcctgcatgcccgtcgat

SEQ ID NO: 46866 - DNA, 429 bp, Zea mays
  unsure at all n locations
  Clone ID: LIB3066-014-Q1-K1-E5
aggcagagttactggcccaagctaaagagaatgaatcatgattgtcatttgtccagtggttgcaggcagttccttgatcgtatttcctctgctgtattttccatgcaatatcttgactgatgtatgctcatgctcagcacctccaataaagcgagacatgctatagcattgttgaatgcaagtgggtatgcagtttgcagtatgcttatgttgaattgatgtaacttagccgaactgaaagaggctgccccagcttgattggaacagaggaatttgctgctgtttttgttcttattacngggaacaacacaagtcaactctaaaaaaaaattgtttatgagtctggttataaggtgttgttttgtactgagatttcattgttcacttgaagaaacctctgtcggaggagcagaatgcttggtgctgttt

SEQ ID NO: 46867 - DNA, 378 bp, Zea mays
  Clone ID: LIB3066-014-Q1-K1-F9
cggacgcgtgggttttcggcttgcatgtggatccaggacttcctgtaggcaccgtttcgtcgaggccagggccgtttctagcagcagcaggtagatttctggtgacggtcactggaaaaggcggacatgctgcagggccacaggatgctgtggatcccattgttgcggcatcctctgccatcgtcagccttcagcttcttgttgcccgcgaaattgatcccctccaggctgcagtggtctcggtcacgttcatgaaaggaggtgatgcttacaacgtcattccagagtcagcatccttcggcgggaccttcaggagcttgacaacagaaggcttttcgtatctcatgaagaggatcaaagagatcatagaaggtcatg

SEQ ID NO: 46868 - DNA, 398 bp, Zea mays
  Clone ID: LIB3066-014-Q1-K1-D10
cccactcgttcgcccactcgtccgcggacgcgtgggcaagtcgccgacgaagggtcttgatggagagccggtccgcgctcaaattacacctgacgaacctggacttactgcataggaacctatcaagccgactcctatgaaaggagggagttgtgccccagcttccttttatcacattttgctatttctgcagtaaactgctggctggtattatgtattagaattagtctcagcaccaggagcttgaagagtggcaagtgacaccgtgtattctttatcttagtttctgttgacataccaggtatttgtagttggcagacaggcagaattgtatattattctccagggctaccagtcaattaagttgccgtccaagtaagatatgtacacgattttgc

SEQ ID NO: 46869 - DNA, 385 bp, Zea mays
  Clone ID: LIB3066-014-Q1-K1-D11
tcccactcgtcctcccactcgtccgagctcatggaaaatatcctggagaaacaagagtgagtgtttcttgcgagaataagcgtggcacaaggttcactcctatggtccaatggcccgataagtctgtttcattaggagttactcaagccttgtcatggaaaagatctggccttatggtgagacccatcatacaagtcagtgtgtgccctacgtatggaggaagtgatcctggggtacgtgcagaagttgtccattcattgaacgaggaattgaatctgatgtgtggcctctcttgctcacagcgcccatcatcttatactgctctctctattggacgatcaaagtggaatggtcaagtgggcagttctggagtggtaatcacctt

SEQ ID NO: 46870 - DNA, 434 bp, Zea mays
  Clone ID: LIB3066-014-Q1-K1-D12
agcacccatcagccaagagctatccatacgcacagcgatgcaccagcacgagatactagccggcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggccctggagctggagttgccccgggtgg

SEQ ID NO: 46871 - DNA, 360 bp, Zea mays
  unsure at all n locations
  Clone ID: LIB3066-014-Q1-K1-D2
gcgcccacgcgtccgggccaatttgcccctattgattgcgaaattttaaaaaggggagctattaggagtcaacgaaatgttacctactagactgggggtcttaaatttatgtctggattggtagaagaaccactcttgaaaaaagggaaccaaggcggctaacttgttgagaattactacgtgaaaggaacccgcaaaaatcttatattattcggctcatggaaaggatttgagactgtcacaatcaaaataaaagtttgataaatggccccaagaaagctgatgcagttgtgtcggattgaaagcaganngaaaagtggcccagctcttcttaagcgacaaggatttaatttcaagatc

SEQ ID NO: 46872 - DNA, 391 bp, Zea mays
  Clone ID: LIB3066-014-Q1-K1-D3
ccctcccgagtccaaaccctaaacctaaacctctcacccggcgccgccgccgccgtcgccagcgccgcggccccgaggccccatcccagcgaaaccgacttccgcctcggattgaagcaatgtcgtcggacgacgaggtcagggaggagaaggagctcgacctctcctccaacgatgtcgtcaccaagtacaagactgccgccgaaatcctgaacaacgctctgaagctggttgtgtctgagtgcaagccaaaagcaaagattgttgacctttgtgagaagggtgactctttcataagagagcaaaactgggaatgtctacaagaatgcaaagaggaagattgaaaggggcattgctttcccaacctgtgtttcggtgaacaacacagtct

SEQ ID NO: 46873 - DNA, 334 bp, Zea mays
  unsure at all n locations
  Clone ID: LIB3066-014-Q1-K1-D4
gcgcccacgcgtccgcgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctnctcgcagggcgcttcatggggnaaagagagtggtgtttct

SEQ ID NO: 46874 - DNA, 435 bp, Zea mays
  Clone ID: LIB3066-014-Q1-K1-D5
cccacgcgtccgcccacgcgtccgcccacgcgtccgctctttctctctcgcacgagccgcgccggcgccgccaccacgcgcgcgggagacagagaccacagccgcagccaccgacgggcggaataggaatggtggcgccggggggaggagcaggaggaggtccgttgcggtggcccggcggcggaagaggaaggatgcgtgcatattagtttccgatgaccccacctgatcatgtacctagctgaacaaatgggactggaactgatcttgtcaaagttgcatgatctcaaatgggaatacccccatcttgacactgtacggaagaaggtggtggagattagtggaagggatgaacaagaggttatggttgctgcttgcccctacagaatttgccctctgggggctcatattgatcatcatggtggagtagtcaca

SEQ ID NO: 46875 - DNA, 410 bp, Zea mays
  Clone ID: LIB3066-014-Q1-K1-D6
aacaaacatacaaacactcaataacatacacaactatacaatctatgtatattatacgagccccagcggcactcgacaccgaggcgcgcagggtagatcagatatccatcatccgcagaccacaagactcacttcaataggaatactggctccaactccgagtagcatgataaggtccttttcactgacctaaatcggatgacaaatgatgcgtgcatattaatttccgatgacaccacctgatcatgtacctatctgaacaaatgacactcgaactgatcttgtcaaagttgcatcatctcaaatggcaaactcatatcgtttgacactgtacggaacaaagtgttggatattactggaaggcatgaacatcatgttatggttgctgcttgcacctacagaatttgccc

SEQ ID NO: 46876 - DNA, 251 bp, Zea mays
  Clone ID: LIB3066-014-Q1-K1-D7
cccacgcgtccggcggaccgtccctccagtctttcgctctccgtcactcccacgagctctacgatcactttcacgaggcgcgcggaaatcatatactacatacgatcatatctactgcctgaataacaatcataccgccttactaattcatatgaacctgaccttacctgtacccctctaaagcataactttcatgcatacatattacatacctattacactacctgatcatgtacttaactcaacaacta

SEQ ID NO: 46877 - DNA, 467 bp, Zea mays
  Clone ID: LIB3066-014-Q1-K1-D9
gcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaaaggggactacta

SEQ ID NO: 46878 - DNA, 297 bp, Zea mays
  Clone ID: LIB3066-014-Q1-K1-E1
cccacgcgtccgaaaaaaaaaaaaactaagtttataaattaaagcataaaaaaaaaaaaaaaaggttaaaggttaaaaaggaaaaagatgcgataaaaatctacttaaaaaataaaaataaataaaaaaataaaaaattaataaaataaaaaaaataaaaaaaaaaggcctctccttttaaaatttcccaatttaattccctttcttttacacctttaacttttttttattttcacctaaatttaaattactttgccccttttttaaaaattgatttttttaaaaacctttgttttt

SEQ ID NO: 46879 - DNA, 438 bp, Zea mays
  Clone ID: LIB3066-014-Q1-K1-E10
cggactcgtgggcggactcgtgggcagcccccaactacccccagcctcggaaggaaccttcgagaatcgcaagactctaaaggccgtcgccttcccattcttcctcgccgcgggggtcgcctgagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggaacagatggtgttgctaatatcaatgtcaccgaca

SEQ ID NO: 46880 - DNA, 452 bp, Zea mays
  Clone ID: LIB3066-014-Q1-K1-E11
gactcttcctcccactcttcctctgactcgtgggcttctagatcgcaagtggacgcccttatggaacctttgagaatctcattacgctaaaggccttctccttcccattctttctctcctcttttgttctcctatatcacataaacaatggttaatgctgttgctgtgcttggtatcatctatggtgtcaagggctccatctttttcacccaagatggagatgtccctaccgctgtcacctgaagtgtctctggcctcaatcctggcctccatgggttccatgtacatgcacttggtgacaccaccaatggatgcatgtcaactggaccacactacaatcctgctagcaaggatcatggggcaccataagatgagaaccgccatgctggtgatcttggaaacgtgacaacttgatcagatggtgttgctaatatcaatgtcaccgacagcca

SEQ ID NO: 46881 - DNA, 426 bp, Zea mays
  unsure at all n locations
  Clone ID: LIB3066-014-Q1-K1-E3
cggacgcgtgggggagaaaccgccggcggccgtcggcggtttcacggacacgtctacggcggccgagagcgggctcgcagatgtctgcagcggcggcgtgaaggagcttgtgccggacccgggccacttcgagtggccgtcgggctgcgatctggggtcctactggggcaccagcgtgttcgccgacaccgacccggcgctgttcctgaacctgccgtgagccgtgacaacgccacggcgtccatgctcaactaatcaaccatcacacgacccacgagatagatgagatgtgaaccgagcacgctgtagcgtcaagctcttgaaggcttgaagctgtgctgtagtntcctgagcttactagcgatctctgctggtctctgatctgataatctcttactagtcgccggttgtgctccgatctagtaa

SEQ ID NO: 46882 - DNA, 343 bp, Zea mays
  Clone ID: LIB3066-014-Q1-K1-E4
tttctgtcttcagtagtgcaaacaaaattgcttatggtgattctcgcacatatttacgcgacgtcatggctgactgtcagcacgttacaacctatccaaactccaaccataaatgtaatttaatacataccaatactatcatctcatatgctctatcgactacaaccacatcacatattctatcatacaccatcaccaatgtgccacatactataatatcatccattatcacagaattaaaacccaagctcatatattccatcatgactcaactcaacaaaccgatcacacctacacctacctctcttatcctgagtactcacaaaatacataatcatccaac

SEQ ID NO: 46883 - DNA, 292 bp, Zea mays
  Clone ID: LIB3066-014-Q1-K1-D1
gctcctgctcctcgccggcgcctccgcggcgcacggctcgttccaggctaggcgtgctctgtgagatgagcatgggagcggtatagtggcgcgatggcggaggttgctcgccgacgctgcgactccagcgaacaactctcttgtgctggctgcggcgaggactcaccggagcgaccccttcgccaaccttaccgcgtacagcggcggctggaacattagcgacgagcactactgggcttccgtgacgtacaccgcggtgcccctcttcctcatggccgtgctgtggttcgtc

SEQ ID NO: 46884 - DNA, 294 bp, Zea mays
  Clone ID: LIB3066-014-Q1-K1-B3
tgtacacattcgatcctgccacaatgaatttcagaagtgtggagctcgtgttctcaagtatgtttaacgatgtcaggcccgtgcaacggcttggtgtgtgcctatgatataaaaggcgatgctgaggtcttgaataccacaactaggaagcatttgaggctcccagattcaccactcacgtcacgggctctttactccgaatatcctgttggattcgtgcactctacaacacagtacaacgtgagctctatatgtcacacatgtgcgctacttgacattcgcaatctgaactat

SEQ ID NO: 46885 - DNA, 298 bp, Zea mays
  Clone ID: LIB3066-014-Q1-K1-B4
ggatggtcgtatcagctacccagagttcgaattgatgatgaaaggtgggtcagactggagtgatgcctgtagacgggactcgagagagaatttcagtagcctcagtcgaaagctgtgcaaagacaccttatgaaacaagaaagtagttttgcaagcagcagttactgactgacagtaccacgccctcgactaagcagcaagcgtcggaagacaatgcaaaagcaggattactggatctggtggaactgtggaaataagggttaaaggagatttgcgtcgattgacagactccgtcaaa

SEQ ID NO: 46886 - DNA, 288 bp, Zea mays
  unsure at all n locations
  Clone ID: LIB3066-014-Q1-K1-B5
cccacgcgtccgacggcgtggtgggtctagagctggctggcgggcgtgctcctgctggtgtggggtttgtggcgtgtgggctggatctgcactcagcagctggcgctggcggccggtggcgggtgcatccatggcaggttgggggctcgtgcatgtgctgtggcacggggctctcttctttgccaccccttccctaccttaacggcctggctactggtaatggcgggcatcaccgtgcagccgtgaggagcgaaggatctggctnctcaatgggtggtgtgtggccgt

SEQ ID NO: 46887 - DNA, 423 bp, Zea mays
  unsure at all n locations
  Clone ID: LIB3066-014-Q1-K1-B7
gtcgttcgttcctcaagtgatcttaatcgtcgagaagttaccagctagcggagggcatcgggaatgtcgaacatggggcaatccttccaggccggcaaggcgcaggcccagggcgagtgccaggcggagcgcgcagcgcagtgcgttagggacggcgccggcgccaccgcctgcgccgtgaccgacaccgccggagccgcggccgacagcgcgcagctgcaggagcaccgcgccgccggcaccgttcagcaggtggcgcagacggcggcgggcgcggcggcagccgtcaaggacacgggtggcgggcgcggcggcggccgtcaaggacacggtggcgggcgcggcggcaggcgccaatgacgcggtgaccggcggccactgaccgactcacgcgcgtgaaccggacngcgtaccaacaatgct

SEQ ID NO: 46888 - DNA, 405 bp, Zea mays
  Clone ID: LIB3066-014-Q1-K1-B8
ggggataaaaaaggcacagtttttggtggtttagttgaggccccattgcagccatctagttgaaagaagggaccaataattcctttgttttcactaatttacacaatcgccctgtcatctatcgaccgacaggtgcaaataactactttacgatgtgctctaccgactatttggctctggggggaggaggtcatttcgcactttatcttgacgcagaccttttgattggttcaagttctaattcagagacttttaacaacgggtgtttatcgcattcttcagacttctcagtgaaagatgttgaagctttggggcttcgtctacccttccaaatacgaggagatgctgacactctgccggactgagaaaccaggaatctgtccatggtgagtggtgaccaatccc

SEQ ID NO: 46889 - DNA, 310 bp, Zea mays
  Clone ID: LIB3066-014-Q1-K1-B9
tcgggccgtcgtcgcgactacactttgggtcatctatcatcctgcgatccgtcgcctcgccgtcgtccggcgagcccgagagtaggaggccatgacgcttgcgagcacggacaaggtggtgctgggatgcgtcgcgttcagcatcttctgggtgctggccgtgttcccgtcggtgccgttcatgccggtggggcgcaccgaggtgtccctcctgggcgccatgctcatggtgctgttccgcgtgatgacccccgactaggcgtacaaggcgatcgacctcccgatcctgggcctcctattcggcaccatg

SEQ ID NO: 46890 - DNA, 415 bp, Zea mays
  Clone ID: LIB3066-014-Q1-K1-C1
gcgtcgttctctcttcctggtccaagtgatcttgccaagttacgagcagcgagcagagatcagatcatgcatcggcaatgtcgaacatcgggcagtccttccaggccggcaaggctgaggcccagggcgagtaccaggcggagcacgcggcgcagtgcgtcaaggacaccgtcgcagccgcggccgacagtgcgcagctgcagcagcactcgcccaccggcaccgttgagcaggtggcgcagacgggccagggcgtggcggcaggcgtcaaggacacggtggcgggcgcggcggttggcgtcaacgaacacggtggcgggcgtggcggcgggcgtcacgaacacggtcacgggcgccgtggcgggcgtcacgaacacggtgactctgcgcgcggcgggtgtcaaggacaccgtga

SEQ ID NO: 46891 - DNA, 345 bp, Zea mays
  Clone ID: LIB3066-014-Q1-K1-C10
aattccctgttcgaccgactcttacttttatcttctgaaaaactcatcacatagagtttaatcctaagatatcataattgcactatagtttatttcggaccggtattcaagttacatattatatcatatacatatatataattattactaccatttcgataatacatatcaatactaaactatctattaagatttattacaactaaattatctacaattattaacatctaaattaaaactatacattataatattctactaaccataaatctctttcaaaaaaatcaaacctggtccatcacataattatacaattcaacatacaattcacctatcataatatca

SEQ ID NO: 46892 - DNA, 443 bp, Zea mays
  Clone ID: LIB3066-014-Q1-K1-C11
agaattcccccctcccccgtagcgaaaccctagccgccacgccaaaaccaaatcccgccgagcccgaaattttccggcgggttccttgccgcgaatcgattgatttcgagcgattcgactcctttgtgatctctcggcggggtagagcgcggtcgaccgtcggccatgtcgaggtgcttcccctacccgccaccggggtacgtgcggaacccagtggccgtggccgagccggagtcgaccgctaaggtttgttgaaccttcggatttacacacgcacgtgccagatcgtttgttcaatctgtaggttttgcgcggatctgtggtttgcgcgtgcgtgatgtgggtattgcccgtgccttgaaagctaaccgagctgaggaagtgtatggatcttgtgtagctgcacgaggtcctccaaatcgattggtaaaattaagttgtat

SEQ ID NO: 46893 - DNA, 238 bp, Zea mays
  Clone ID: LIB3066-014-Q1-K1-C12
ccactcgtccgcccacgcgttcgcggacgcgtgggcgagatgtgaaccagcagcctccaatagaagccagcgcatgggaagtaaaaccgacagacctcagccctcatgcaagcctaccgtcgacttaccaccgctccaacccgagagaaagatggagacgatcaagacgatcctcatagccgcgcttctcgtaatcgccgtctcggccaccgcagtgctgacctacaccgatgtcgac

SEQ ID NO: 46894 - DNA, 412 bp, Zea mays
  Clone ID: LIB3066-014-Q1-K1-C2
gcgaagcaaacaaaccacacgagcgcggcgcggcgcggctgccacctagaaaacgcccgcgggcgcacgatgaagaaagcggcggcggcggcggcagtcctggctacccttctcctgtcctcggcggtgtccgccaccggcgtgtccgggcaggaaccggggacgaaccaacagacggcgggcaacaacccgcggctgcacaaggcgtacgtggcgctgcaggcgctgaaaccgcgcgatcacggaggaccccaggaaccttgacgcgggctggtgcgggccccaacgtgtgcgcctacttcggcgtctactggcgccggcggcgcccgacggcgacgcggacacggacacgcagaccgtggccgggctcgacctcaaccacggcgacctggcaggggacgctccggaggag

SEQ ID NO: 46895 - DNA, 287 bp, Zea mays
  unsure at all n locations
  Clone ID: LIB3066-014-Q1-K1-C3
ctgatcgacccgatgtcgaaccaggcctgcgagaaggaggccggccccaacgtctccgtgaggggctacgacatgatcgaggagatcaagacggagctggagaagaagtgcccgaacgtggtgtcgtgcgcagacatcatctcggtgagcgcccgcgactcggtgaagctgacgggcgggcccgagtacgcggtgcccctgcgaccgcgcgactcgctggtgtgcaaccgccaggacgccgacaacctgncgggctcagacatcgctgtgcccaacctcatcgacga

SEQ ID NO: 46896 - DNA, 258 bp, Zea mays
  Clone ID: LIB3066-014-Q1-K1-C4
ctgacgcgtgggctgacgcatgcgccgtcgtatacttactacttcgtctacatcttcgcccagcccagcgaaaacgtctacgcgattctccgtgctctcctaatccacaccgtatactccgcctcctgccgagacgacaggtacggcagcatccgtgactcaaccaacttactgctttcaacaacctccggctgcacaaagcgtacgtggctctccaagcgctgaaacactcgatcactcaagaccccatgaacttta

SEQ ID NO: 46897 - DNA, 431 bp, Zea mays
  Clone ID: LIB3066-014-Q1-K1-C5
cccacgcgtccgagcatgacccggtcgaggtcgccaaccaacttaaccgtgcagggcacagatccgtcgagaaggaggacattggcacgaggcgggagatgatggggacgacgacgaggaagtctaagttcagcgggccgtgcagggcgacgaacccgatcgaccggtgctggcggtgccggcaggactgggcgacggaccggaagcgcctggcgcggtgcgccaaggggttcgggcgcaacaccaccggcgggctggccggcaagttctacgtggtgacggacggcaccgacgacgaacgtggtgaacccgcgccccggcacgctccggtggggcgtcatccagatcgagccgctgtggatcaccttcgccaagaccatgatcatcacgctcaaggaggagctcatcatccgcggcgacaagaccattga

SEQ ID NO: 46898 - DNA, 382 bp, Zea mays
  Clone ID: LIB3066-014-Q1-K1-C6
agaacctggacgccggcaaggggatcgggcggcccgcggggctcgtgatcaacggcaagaacgagaaggacgcgtcggacccgcccatgtacaacgtggaggccggcaagacgtaccggttccgcgtctgcaacgtgggcatcaaggcgtccttcaacatccgcattcagaaccacatcatgaagctggtggagatggaaggctcccacaccatgcagaacgactacgactcgctggaccttcacatcggccagtgcctgtcgttcctcgtcaccggcgaccagaagcccggcgactaacctgctgggcggtgtccacccggttcatcaaggaggtgaacagcatcacggccgtgatccgctacaagggcttcaacgccccg

SEQ ID NO: 46899 - DNA, 241 bp, Zea mays
  Clone ID: LIB3066-014-Q1-K1-C7
cgttccgccatgcgcgcaccgaggcacggcagcatgcgcgcccacgtcgccctggccttcggggcgctggtgctggccggcgacgccctgcacacggcgctggccggcagatgcagtttcgactacaaggatgccctaagcaagaccatcatattcctggaggcccaacgctccgggaagctgccgtgcagcaatcgcgtcaagtggcccggcaacttagggcttaacaacggcaagctcg

SEQ ID NO: 46900 - DNA, 333 bp, Zea mays
  Clone ID: LIB3066-014-Q1-K1-C9
gaaaaactcagcacaaacattcaaatgttcagatattcaaattcttcgaaagtgttcagactttagacaaaaagtaactctaatatagcagcttcacacacgctcaggggacaactccaaaactgagtgggctgaagacttaacacggtctaaaagctaaagcctatgggcgagcagcaaccggtgctggagatggagctgtaacagcagcaccaggaccagggctgtagccttcttgtccaccatcaagcctatcctacatgcgcacgttccacttcgaccgtttgctctctatgcgctgctcacatctcaacactgataccacctcatatg

SEQ ID NO: 46901 - DNA, 387 bp, Zea mays
  Clone ID: LIB3066-014-Q1-K1-B2
gcgggtcaccgctgtccccgccgacgaagaagagatctgcggtgccactttcaaggtggtggaagggtctggtgtcctgacggcgctgcactgatcgatcatcagctggcggaggcgatgcgacgatgatgcagaactttgtacatgcgtggtgggtgtgtaacatagtgtggctggcaacaagccatgctcatgcaaaccgatgaatctatctctgtatcatgcatcgatctcggttgcttgctagtcccgactccagactccagacatggctatatatagctggtgctaataaataggagtattaatcgtcaaatatcgatcgattgcgtgtggaatgccaatcaagtgtgtaatctgttcccagataccaacccttggttcctc

SEQ ID NO: 46902 - DNA, 425 bp, Zea mays
  Clone ID: LIB3066-030-Q1-K1-G9
cccacgcgtccgggttgattcatcacctgccttttgggattcacctgaggggactgacaaaactacagtactgattctggctgatccacactgctcatacgaagtcacttctcgtgcttcactaagtgatgcggcaagcagattctttttgttgtactcatcagagattcttggtttcatggtggccataatgttttttggaattatgcgacagacttcagcatgggaatgtgattcttctatgccatccattttgtcagccatagagtctaatcttggactcccaaaggcattcatgtttctttgcttcatgccaatacttgtattttgtgcctttttcattttcacggcggagcaaaaaccaccatttgggaccttcttattggttactctgatctgctacatagttgctaatggtttcacaa

SEQ ID NO: 46903 - DNA, 432 bp, Zea mays
  unsure at all n locations
  Clone ID: LIB3066-030-Q1-K1-H1
cgggcctgcccggccacccgcaccacgcgcgcctggccgccatgggcaacccgggctacggctgcggcggcatgctgtgcctcgacatgggcaccgaggagcgcgccaaccgtctcatgcaccacctccagaacaccacccagttcggcctcatggccgtcagcctcggctactacgagacgctcatgtcctgctccggcagcagcaccagcagcgagatgccgaccgaggaccgcgcgcgcgcgggcatctccccgggcctcgtccgcatgtccgtcggctacaacggcacgctggagcagcgctgggcgcagttcgagcgcgcgctcgcgctcatgcagacgccgacgcccacgcaccatctcaaggccgtcgtcgtcgaccgcgacggccccgaagccgncaacaaccaccaccgcaagcactgacgcg

SEQ ID NO: 46904 - DNA, 424 bp, Zea mays
  Clone ID: LIB3066-030-Q1-K1-H10
cctcagtatgcacgtggtttagctgctcttggacatcaattgcatgcgcttggttttatagaatctccagaactaggtttagaagctcccttggcccatcatttgatgcacttttatgagatgatgggtgacacacttgctgtacagtatagcggttctgctgctcataacaaggtattctctgcaaagagaggtcacttgaagctttttattcagtcacaagagttctttaggacacttcagcggcactacagcaacacctgtatagatgctaacaaacaggctgctataaacttgtttttgggatacttccagccacagcaggaaaaacctgcactgtgggagttagaatcatctgctgggaagcataacaataatctttttgatggccacccaagtacattgaaaagagtaaaatcagatg

SEQ ID NO: 46905 - DNA, 426 bp, Zea mays
  Clone ID: LIB3066-030-Q1-K1-H11
cccacgcgtccgcccacgcgtccgattttaaataaaaataaagctcgacgtcgtcgtcacctctctcgccgtccacgagtcacggcgagcggcgtcgacggcgggcgggggtcctggccgttcaccaccatgcctgaccccaccaccaaacccccttcgccacgcccccgccgtcgccgcaggctctgcggcctctgcctcggcaccgcgctcctcgcgctcctcgtcgccgcgctcgtccatgtcgtcgccccgcttccgcgcgccgcttccgcctccgcgcgcttctccgtcatcatagacggaggcagcacgggcacccgggcccacgtcttcgtcacggggcacgacggcagcccggatctggcgctctccaccgtgatgcgcgtctccccgggcctctcgtccttcgccgccgacccggcg

SEQ ID NO: 46906 - DNA, 332 bp, Zea mays
  Clone ID: LIB3066-030-Q1-K1-H12
cccacgcgtccgcccacgcgtccgcccacgcgtccggtgcaggggcagttccggtcgctggtcctgtcgtacaaccagctgacgggcccgatcccgcgcgacgacgcgcgcgacgagatcaacaccgtggacctctcccacaacaagctgacgggcgacccctcccacctgttcgccgccggccggcccatcggcaaggtggacctgtcgtggaactacctcgacttcgacctgagccagctggtgttcccgccggagatgacgtacctggacctgtcccacaacctcatccggggcaccgtgccgctgtcgctggagcggctgtccacgct

SEQ ID NO: 46907 - DNA, 415 bp, Zea mays
  Clone ID: LIB3066-030-Q1-K1-H2
cccacgcgtccgtgccgctccagcctttcgctagggtttatccaccggcggcgcccgcgacggcggcaagatggtgcagcgtctgacctaccgcaagcggtacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctggaactgcagttagagaaaggatcatccgtgctttcctggttgaagagcagaagattgtcaagaaagtgttgaaattacagaagaccaaagacaag

SEQ ID NO: 46908 - DNA, 432 bp, Zea mays
  unsure at all n locations
  Clone ID: LIB3066-030-Q1-K1-H3
gggcaccatctgacaaaaacctgacctacgagctggtgcagaaaggtccggcgactgatgtgtccggacgtnccgtatccacagcgacgaacgcgtcgaacccgtggtggctgacgttcgagagggccatcgcctccgcgggtggggagctgtctaagcctgagatcctgtcttcgaccacggactcacgctttgcgcggcagctgggcatccctgccctcgggttttctccgatgaccaggacgcccatactgctacatgaccataacgagtttctggaagacagagtgttcctgaggggcatccaagtgtacgaacatgtcatcagagcactaagctcgttccaaggctgattcgtaaaaaaaaaagaagagaagaaggaaaagtggcagtgctgatgcgtggagtgtaacatagcaggttttgtaataa

SEQ ID NO: 46909 - DNA, 158 bp, Zea mays
  Clone ID: LIB3066-030-Q1-K1-H4
cggacgcgtgggcggcaatgctgtcatgcttaaacatgtgtcgctgctgctccgtgatgccggcgacggctgctattagtgttaatgttagtgtcgatcgggtctccttgaacaatggcaggaatctgttgcttgtttactttcttctaatggcaagt

SEQ ID NO: 46910 - DNA, 399 bp, Zea mays
  Clone ID: LIB3066-030-Q1-K1-H6
ccggcggccactgaccgactcacgcgcgtgaaccggacggcgtaccaacaatgcggcatggccaagggttgcgcctcaagatggctactaaattttccttcttttttctttatgttttttcattttaacgtgtttcattcacccatcttattgtgattgatcgcttgcaataaaaaggccatctttactaaaaaataataagctatacacaatggatctaaaataaattgcctctgaaggaaacaagctgcctaatgtttgcacagtggaaaggagcgaatcatttgcaaaacatgcttattctgtgattctcaacatttgacgccttttacgcctttacccgatatttgccagatcacatgctcctagtctgcttattggccgattgctttccaactt

SEQ ID NO: 46911 - DNA, 424 bp, Zea mays
  Clone ID: LIB3066-030-Q1-K1-H7
gactagttctaggaaattggtgcttcaaaaacaagagagcttatccagtttgtcattgcaatgccacaacttgattgatgtggatcttactgagtgcgagtcattaacaaatgcggtttgtgaagtatttagtgatggaggtggttgccctatgctaagatcattgatccttgacaattgcgagaatttgagcattgtagaactgaacagcagttctttgtcctgcctctctcttgctggttgccgctcgatgacattgttaaaactctcatgcccaaatctgcaacatgtcaatcttgatggctgtgatcaccttcaaagtgcagcattctgtccagtgggtctcgaatccctaaatctgggaatttgtccaaaattgagtgttcttcacattgaggctccaaatatgtctatattggagctg

SEQ ID NO: 46912 - DNA, 423 bp, Zea mays
  Clone ID: LIB3066-030-Q1-K1-H8
gcgggcattggcgctggccgacgcgctcgttccggccacggcgcgcgcccagctgcggcgggaccaccaggctccgccgggcccgggcccgcacagcgtcaccatcttcgagttcggcgccgtcggggacggcaggacgctcaacacgggccccttccagaacgccgtcttctacgttcgctccttcgtcgacaagggcggtgcgcagctgtacgtgcccagtggccgatggctcaccggcagcttcaacctcaccagccacctcaccctttacctggaggaaggcgccgtcatcgtctgcgcaaaggactcatcacaatggctgatcgttgaacctttgccatcttatggcccagggctagacctttctggtcctagacattgaagcttgatcagcggattacacttaaccgattgttgtat

SEQ ID NO: 46913 - DNA, 422 bp, Zea mays
  Clone ID: LIB3066-030-Q1-K1-H9
cccacgcgtccggggttctccgccgggcttgtagacgacagcaacatcttcgagtggcaggtcaccatcatcggaccgcctgacaccctatatgatggaggctacttcaatgcaataatgaccttcccccagaactatcccaacagcccgccatcagtaagatttacttctgagatgtggcatccgaatgtttatcctgatggacgtgtttgcatttctgttcttcatccacctggtgaagatcccaatggttatgagcttgcaagcgaacgatggacaccagtgcacacggttgaaagtatagttctgagcatcatttcgatgctctctagtccaaatgacgagtctccagcgaatatcgaagctgccaaggattggagagaaaagcgggatgagttcaagaaaaaggtaaggcaatgtgt

SEQ ID NO: 46914 - DNA, 356 bp, Zea mays
  Clone ID: LIB3066-031-Q1-E1-A1
ttggcttggaacctttgggctgatttatgtgcttgtttatgtgcttgtggatgtgcggggctgtacctcccttggcccgttggccggggggtaaatcagaatcaggaaagcgccaagctccgtcgaactagcacccatcttcccttagagcctgtggaagttggctagggttcttgatcccaacagtaacaggtgccacagcaggatgtataacgtgccatcccggggacttcccgcgcggtcggcctagcgaccgagacagacccggaaagagcccgccccgtcgaaccgccacctaacatctatcaaggtgcgctttcggccatacgaaaaaaagagaaatcccgataagagta

SEQ ID NO: 46915 - DNA, 392 bp, Zea mays
  Clone ID: LIB3066-031-Q1-E1-A10
cttggaacctttgggctgatttatgtgcctggctctgcgtagtcgtcggcgaaagctccaggggtatgatacgctgacttgatgcgatccgaagagcgtgtcagacgctaacagctatggatatgttagtcgcggtccccgtcaatattgacacctactacgcatgcgcgatatggtcattaatcatcaataaggcgcctatgtctaagacagctacgcattcgaatacacgtgcgaatgatcccgataatccggtgctctgacgggaacgacggatagagtgtccttcggagttgagctcagatggtaccgatatgacgtatactaaggtgtctatgggtctatgtcggattcgatgaacaatagtcgccgttatacaactagagccactg

SEQ ID NO: 46916 - DNA, 405 bp, Zea mays
  Clone ID: LIB3066-031-Q1-E1-A11
tggaacctttgggctgatttatgtgcttgcgaaggtatacggcgataagagtagagatcacataaccttagtcggtgcaacttaaggggcgtgatggggcgcataagtcatacgtctcgggcggtaaggcaatgcctaagtagtcggggtacacgtcgttctatttggcgttttcctgtaaagttatggcgttaacggatacgcgtagaatcggaactttggtaatctagctcacgttttacttctaggattaggaatacacttaggttagacgcatctactctttctatagcacgtagtgctagggggtcatttcaacattttacttatcgtcctggtatatcacgtactactaaggggtcccttcaatattctcatcctagtctccttcggcgtcgtcatata

SEQ ID NO: 46917 - DNA, 436 bp, Zea mays
  Clone ID: LIB3066-030-Q1-K1-G8
cccacgcgtccgatccatctcgcccgcgagatggatggggacaggttgatgtcgtgagtgggaatcgggacacgggcgagccgacggtgggtctccatccatctcgcccgcgacgtttgatggagtctctcctcgcctcgcgatccattaggtcttccttctccgccgtcgccagcatcaggggcgccgcttcccccaggccctcgcgcgtcgccaccctcgccagcgcctgcgccggcgcccgctcccgcgcgctccgtgctggccacacggactcaatccttgaggtgctggcacaggacgatatgctgaacgcaaaggagctggtccaatgggagaatggcttgtcattcaatgacatagcggctaggcaggggattcgcatccgcagacactggccgcccactgcctttcttgaggagatagaggaggagct

SEQ ID NO: 46918 - DNA, 428 bp, Zea mays
  Clone ID: LIB3066-030-Q1-K1-F12
cccacgcgtccgggctatcgcagttgagcaccgtaaagatgttgattccgcggtggttactgtccttgatgaagtcatgccgtccatgactggttcagctggaactttgtttacccataaagaagtgttgccatctatggatgattctgttgggaatttgtttgctaatcgcagcacacatgaagtgggtagttcatcatgtgcaggacatgagatacatatcgatgagattgatgtaagtgttcaccctgcacaacacacttcttctggggaggctaaaactggcaagcaagaaaacataaacaatgaatgtgtgggaagacttgcatcagtcgaaggggtcagtgagcaactaaatctacattctgatcctataccaaatggcagtcagcatgatttgattcccaaccttgatgtgctatcatcaa

SEQ ID NO: 46919 - DNA, 412 bp, Zea mays
  Clone ID: LIB3066-030-Q1-K1-F2
cccacgcgtccgaaaaaaaaaagcagtttacctttaaaataataaatggataaaaaacgtactgtataaaaaaaagtttattggactgttatctaaagaaacggtcaaactaaatcgctctattcgcaattattctccatactacagacaattcacttagtacagatttaaagcactatgggtcccacaaggtacccatgacttttgagctctaatgcactattgaacacaacaactaggatgaccgctattgtcagagccatgaaggatcctcccacagacatctctattgcaaaaaagcccttcttaatttaagggcctgctccggaatgggcctttgctcaatcatttaacaattacgtggtaaagtctgctctattacctaccacatccataactctattgttggcac

SEQ ID NO: 46920 - DNA, 429 bp, Zea mays
  Clone ID: LIB3066-030-Q1-K1-F3
cggacgcgtgggcggacgcgtgggcggacgcgtgggctggaacgtcctatgatcaggcgtcccagtttaataatgttaattcacggtggaatgatcaagctgccagccttccagcagagcaagcactgaattacgatgatcaaagtggaaaccttccgccacctccttgggaggctcagccagcggcaagcaacgaaatgccaaatggtgaattgggaggcgtgcaacctcttcctgggacagctgggcagttcggcggcatgcagcaggcactgcaaccacaagttaaccacatgggagttccacaaaggcagccaatgtacagcaaccagccaggggttgtggtggcgccaacacagatgcaagcaggcttggggaaccagcagttgggttcgacatccatgatgggcatgcctccacagatgtatg

SEQ ID NO: 46921 - DNA, 175 bp, Zea mays
  unsure at all n locations
  Clone ID: LIB3066-030-Q1-K1-F5
cccactcgttcaactataantttttgcttttgttgcaacattcgattatcaagggttcgtatttaaaaatgttaattcaccgtttactgatcaagctatcaacctttcaatgcattcatcaatgatttaccatcatcaaagagataatctttcgccaatttcttagtatgatcag

SEQ ID NO: 46922 - DNA, 424 bp, Zea mays
  unsure at all n locations
  Clone ID: LIB3066-030-Q1-K1-F6
gagagagacgcaggcccgccggcgacgatcgaggagggaggaaccagagacccggcggcggcgacgatggctccgcgcagctcatcggcggcgacgtgcctgtgcctcgctctcgccgcggccacgctggcgctggcccacggtgcgcaaggaggaggaccatcggcatcggcggcggacctggacaaggtcacggccgagaccttcttcgacatcgagatcgacggcaagcctgcaggccggatcgtgctgggactgtttggggacaccgttcctaaaactgcagagaacttccgagcactttgcacaggggagaaaggaattgccaagtccggcaagcctctgtggtacaaggggtcgacgttccacaggatcatcccggngttcatgatccagggaggcgacttcaccaacggcaacggca

SEQ ID NO: 46923 - DNA, 277 bp, Zea mays
  Clone ID: LIB3066-030-Q1-K1-F7
cccacgcgtccggtgaaaaaaaaaaaattaaaaaaaaaaaaaaaaaaaaaaaaaaaaagaaaaaaaaaaaaaataaaaaaaaaataaaaaaaaaaaaaaaaaatgaaaatagatataaaagaatactagattaagtactcgtgcatgctacgtaatggtttttatattttgtatcctaaattaaattatagggccgtagttttaaatagtttgttctgataaaacatctgatgttactcatataaatggatttgtactaaatctgcttttcgcaatt

SEQ ID NO: 46924 - DNA, 434 bp, Zea mays
  Clone ID: LIB3066-030-Q1-K1-F8
cccacgcgtccgatcacaataagatggcgtgtatagacaatgcaatgagagccttgtgccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaagggaaag

SEQ ID NO: 46925 - DNA, 107 bp, Zea mays
  Clone ID: LIB3066-030-Q1-K1-G1
gcggacgcgtgggcggacgcgataggctatatagtttatgtgatgatcatgatcgggttggttccattgcaaaaaatctttcgataagattgtatcgaatttgctaa

SEQ ID NO: 46926 - DNA, 241 bp, Zea mays
  Clone ID: LIB3066-030-Q1-K1-G11
acgcgcacgcacacacgttgaagcattaactgccgtaacagatgcaccttatgtggccaggggacctacagtactgcttctgattgatccacaatagccatacgctacaactcatgctgcaccactctatgacgcgattaccgtatacgagccgaggtactcacaacatagtatcggtaatcaacacgcccttatgtcaacgagccatctacaagctagaccaacatcattatgctcaacc

SEQ ID NO: 46927 - DNA, 433 bp, Zea mays
  unsure at all n locations
  Clone ID: LIB3066-030-Q1-K1-G12
cccacgcgtccggccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggtggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgagaggcgcagtgggcccacgcacagaggacgctgcacggnctcaaccaggccaccggcaccttcgacctcttcggcgacaaccagggctaccgcgagctgtcgga

SEQ ID NO: 46928 - DNA, 437 bp, Zea mays
  Clone ID: LIB3066-030-Q1-K1-G2
cccacgcgtccgcggacgcgtgggcgtgtacgcgtgggcagccacagcagcgctgtctcgtgttgctgaaacagtgtttatacacgaagctggacacctgagatgcagtcgctctgagattggtagatttgtttccatgcttcggaatccttcaccaattcttcgtgcttgtgctgactttgaccttcttcagttcacaatcccaggaggtcggcatgcaatgcatcacgcaggtctcttgcaggaagcaggggcatgtcggttgttgcgcgcagtagcggcagcgaccacagcttctattgaagctaaaatctttggcaggattgtactcaggaacttggagcaccatcagttagggatgtcaacatgaacacccagcagaggttcatcctccaataaacaaaggcctctgcatcgatgggctgcttggccaatgc

SEQ ID NO: 46929 - DNA, 430 bp, Zea mays
  unsure at all n locations
  Clone ID: LIB3066-030-Q1-K1-G3
cccacgcgtccggaagccgtagccgncgtcgncggacgagacaagttgagggcgggcggcaatggccgtcggggaccttgaggtgctcaccgcgctcgacaccgcgaagacgcaatggtaccacttcaccgncatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgctccgtcgcgtcggggctctcgttcggccacaccccg

SEQ ID NO: 46930 - DNA, 429 bp, Zea mays
  unsure at all n locations
  Clone ID: LIB3066-030-Q1-K1-G4
cgaagccggagaatgaagagctagcctatcaaccatgcatggaagtagcaatggcccggtgagtcagctacaaaccatgatccaatcctagcggctagcgatctctagtttatattacaattaggagcaagcgatccaattatcgatagagcgcgagatcgatcgatcatgccgggccgctcggtggtctccatcctcctcctcctcctccatggcctcctctgcctgcagctggctgccttggccgagatggacgacgacgacgtcatggaggacggcagctgcatgcatttcagtgtgtccccgccgnctgctccgccggaggacgcggatgagcggcgcgactatttccgcgccatgcatgccaaggatctgttccggcacgagcagatgatcacgatgatgggcagcgaccggaacggcagcagc

SEQ ID NO: 46931 - DNA, 429 bp, Zea mays
  Clone ID: LIB3066-030-Q1-K1-G5
cccacgcgtccgcccacgcgtccgaggaggcgtccactgacgacaagagcaccggcggccaggctgacaacactactgtacaagaggcatccaccactgacgataacagcaccggcggccaggctaacaatagcaccaaggacacaccgacagagtcaaaagagaccgttggcggtgacgacggcacggcccagagccagacgagcttcgacgacatgaatggcagtacgaacgactcgcagcccatgaaagaagacgggaaggtcgccgagaatagctccgatgaaactgccagcggcggcaaggtggaaagcacagacgacgacgcgacaaccggcgcggcgtcaaacaacgcaacttccggaggccagaacgtcgcggccgagaccatggcatttgcagccgcggatgatggcgccaacggcaaca

SEQ ID NO: 46932 - DNA, 436 bp, Zea mays
  Clone ID: LIB3066-030-Q1-K1-G6
cggacgcgtgggcgagaggagaaccagcagcctccaataagagccagccagagaaacgaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgcctcggggccctccgccagcagcggcgcgcccgccctcgccgccgcgcccgccgcgctcctcttctccctcctcgcctactacctccactaagcgtgtgcgtgcgtacgtacgc

SEQ ID NO: 46933 - DNA, 421 bp, Zea mays
  Clone ID: LIB3066-030-Q1-K1-F11
ggcacatctatgggctccttgccatgaattcatggttctggagtgccatatatcacagttgtgacacaatttggacagaaaagctatatttttcatcagctgctgcctttctggggtactctctcattttggcgatactgcggacttcaagtttaagagacgaagcttctagagtcatggttgccgctcctattctggcatttgtgacaacccacattctgtacctcaacttctatgagcttgacaaaggcctaaacatgaaggtttgtactgtgataagcattgctcagtgtctcctgtgggcactgtgggctgtcatgagtgggcatcgttcgcggctcaagatcatatctgtcgccgtcggaggtgcggttgcagtacttgtggaagcctacgacattccaccgcgatggggatacgc

SEQ ID NO: 46934 - DNA, 422 bp, Zea mays
  Clone ID: LIB3066-030-Q1-K1-G7
cccacgcgtccgcggacgcgtgggcgtctcgctcccctctttgcgccgcccccagatccggcaccgcccgctgctcgaacccgcaccccacgcccgcaggccgggaccggtgggcgcgcgccgggcagtaggagggagaggaagggcggcatggcggcgccgccggcgagggcccgggccgactacgactaccttatcaagcttcttctcattggggatagcggtgttggcaagagttgcctcctgttgcggttctctgatggttccttcactacaagctttattaccacaattggtattgactttaagatacggacaatagaattggatggtaagcgtataaagctacagatttgggatacagcgggccaagaacgcttccgtactattaccactgcgtactaccgtggagctatgggtat

SEQ ID NO: 46935 - DNA, 417 bp, Zea mays
  Clone ID: LIB3066-030-Q1-K1-D7
ggaagaccaacatgctgacagctctcttggttccttacattttcttcaccctgcctaatgtgctgttttctctgatcagaggagaggtggggaaatggattgcgattattgctgttattctgcgtctattctttccacgacacttcccagattggttagagcttcctggttccatcatcctgctcacagtggtcgcccctagcctgttcgcggacagcttcaggggagacctcgttggtgtcttcatatgccttgtgatcggatgctacctgctccaagaacacatcaaggcgtcaggtggattcaggaacgccttcaggaagggcaatggtgtgtccaactccatcggcatccttctgctcttcatctaccctgtctgggccggtgtgctgcaagtcctgtaggcaccattgactc

SEQ ID NO: 46936 - DNA, 403 bp, Zea mays
  Clone ID: LIB3066-030-Q1-K1-D8
gtgatatcaggagaaacaactgttcactgtcaacaatgcttcacaataagatgctggcaaggacgaacagattcaaaccaattatttagcgaacagagttcaatcattttttttgaccatccagtcttttggttcacaaaaggtttctctgggagcaaaccatcgatgttactttttccagcgtgcatatgtatttatgctgggtaactcaaaacagtatctggcctttgcgtaccagattaggttttgttcggttattcctatcttcatgtggattgtatgagattggaaggaattatgagagatgttgacttgtttaggatttaaatcatccaataatccacataattcaagtttcgttggtgttaaaaaaaaaaatggaaaacagaaaagcaatcagttt

SEQ ID NO: 46937 - DNA, 360 bp, Zea mays
  Clone ID: LIB3066-030-Q1-K1-D9
cccacgcgtccgcctactcgagcgtacaggagggtcaggctggacattgtacgctcgacaacaagactgcgattgaggaccagttttggattcgatcggctgtgaatacccgtggttaacgaattgtcaacggcataattctagtcaatgccaatgtcaggaccaactactggacaaggctgaacatctaatacgcttcataggacgcatactatggtgagagagctcatttgtaccaaatgccgacaagctaatattgacttagaaaatcaggttatactgaagcagaacactggccaagatgaacatgatgctacatgtccataagttgagccatattgcgttaggatgatatgcatg

SEQ ID NO: 46938 - DNA, 428 bp, Zea mays
  Clone ID: LIB3066-030-Q1-K1-E1
cggacgcgtggggaacaagtcgtcgatcgacagccgtgctcatcgtaggcgcggcggcatccgggcatggacaggtgcggcggcggcgccatggcgtcgtacctggtgtcagtcgtcctgcttgttgcgctcttcgcgtcgtctgcaaaatgtcgtcctgagccactcgacggcggcggcaacgttaacggcaatggcacggcgccgccagtcaacggcggcggccccggccccggccccggcgccgtactgaagctgcagttctgcatccagaggaactgcgtgtacgaaggccgtggcaacgccccgtgcttctgctgcggggccttgaagcccaaccagtgctacgaaacgagggacgggtgcagcggcaactgcgtgtagcggtgtagccgccgccgccggcgagggcgagtgatgggagatcg

SEQ ID NO: 46939 - DNA, 426 bp, Zea mays
  Clone ID: LIB3066-030-Q1-K1-E11
gctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgtggatgccttccgccagcttcttgtacttgaagagctgctaccatcgcagcatgatgactaccacatgatgctaagatttctcaaggcaagaaagtttgatatcgagaaggcaaagcaaatgtggtctgatatgctgaagtggagaaaggagttcggtgcagataccattctcgaggaattcgaattcgaagaagctgataaggtggcagaatgct

SEQ ID NO: 46940 - DNA, 425 bp, Zea mays
  Clone ID: LIB3066-030-Q1-K1-E12
ggcggttgtaggggaagaggcggaggcggaggcggagacggagactgaaggcgaggcggaggcagaggtcgaggtcgaggccgaggtcgaggtggaggcggaggccggtgcatcgtctgcgaagaagaaccgtatccaggtgtccaccaacaagaagccgctctatttctacgtcaatctcgccaagaggtacatgcagaactacgacgaggttgagctctccgctctggggatggccattggtaccgtggtgaccgtcgctgagatcctcaagaacaatggcctcgccactgaaaagaagatcctcacatcaaccatcggcaccaaggatgaaggcgaaggccggcttgtccgtaaagccaagatcgagatcctgctgtgcaaatcagagaacttcaacagcatcatgtcgagcaagaagtccg

SEQ ID NO: 46941 - DNA, 433 bp, Zea mays
  unsure at all n locations
  Clone ID: LIB3066-030-Q1-K1-E2
cacacatcgtctattcagtgctcaatccaccattccggccccaaccaaggcattatgggggtggccctccgtgctggcgtcgtccgccgtcggcctcctcgtcgccgggtcctccctcgccgtcgctgcctccgatggcggtgggccgacgtacgggtacacggcggggagccccgacgggccggagaactggggcaagctgagccccgcgtacaagctgtgcgggcaggggaagcagcagtccccgatcgacatcgtcaccaagcaggccgtccccaacgccaacctcgacaccctcaaccgcacctacgccgncaccgncgncacgctcatcaacgacggccacgacatcacgatgacgttcgagggcaaggtcgggacggtaatggtgaacggcaaggcgtacagcttcgagaagatgcactggcactcg

SEQ ID NO: 46942 - DNA, 408 bp, Zea mays
  unsure at all n locations
  Clone ID: LIB3066-030-Q1-K1-E3
agcagactccaataagagccagccagagaaactaataaaactctcgccgccgccatccgagcgaacaagccaaccgaccccgtccccaaagcaatccggcggcgacgtaccaccaccaccgcatgagcgagatggagatgaagaagatcctcttcgccgtncgtcgtcgatcattcgcccggctcgggacaccgcagtgctgggccttcaccgaggccgccgccgcgggcgccccaactgcctccgagtcgtccgccgaggcttccgctggcgctggcgctggcgctgccgctggcgccgtcgactcggggccctccgccagcagcggcgcgcccgtcctcgccgccgcgcccgtcgcgctcctgttctccctcctcgcctactaccttcactaagcgtgtgcgtgcg

SEQ ID NO: 46943 - DNA, 297 bp, Zea mays
  Clone ID: LIB3066-030-Q1-K1-E4
atttgcaagttcttgtgatcatttcgagaccacctgctaagatatttttatatgatgattggagcatgcctcatacagccgcggtactgaaattccccttcgtctgggatgaggactgcttcgaagcagcaaaagacgaactctaggtcacaagtgtttcctgcaatgtatctgcttcatccatgatcctgctggactactaaaattcacatgcactagtcgtaataaagccagtgcgcttttcatgtataattctgtattgtggctcgctaaaataaaatttggcaacggtttatg

SEQ ID NO: 46944 - DNA, 428 bp, Zea mays
  Clone ID: LIB3066-030-Q1-K1-E5
ctcatgatcaagatcaacgaggacgcgctgccgtggatccgcggccacatcgcgaggaagaggatgcagaagaagggccctacccccaccatgggcaagacgccttcgctgagaggctacgtcgtcgatccggagctcggttccaacgagggctagaggtcgtgcttgctcttttgggtagcggaaaaaaaatagggtgtttctcccccccggctcttggtgttatattgtatatttaagatcaggggaaaaaaactggtatcacacgttttggaaccgaagctaatttgagtacaggtatacatacatgcatgtaatgtgagcgaagtggcatcggagattcggagagatcgatgccgagtgatacatgcatgactcgttgttcagaatttattgccttcgacttcgacagacgaagaagtggttgg

SEQ ID NO: 46945 - DNA, 416 bp, Zea mays
  Clone ID: LIB3066-030-Q1-K1-E6
cggacgcgtgggctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaggagtgcgacaaggcgtacgtggtg

SEQ ID NO: 46946 - DNA, 426 bp, Zea mays
  Clone ID: LIB3066-030-Q1-K1-E7
gcaagatcttctttatctcttgggccccggatacatcgagggtgagaagcaagatgctgtacgcgagctccaaggaccggttcaagagggagctggatggcattcaggtggagctacaagcaaccgacccgagcgaaatgagcatggacatcgtcaagtcgcgagccctctgaaacagccccggccgctgcacctgcacgctgcaggggcgcatcggctcctgcatgcccgtgggtcgtcgaatccttgcttgtgtgttgggaacggtcttgtgttttcgtgtccttgttttcctggaagcaaaagccctgcattctatatgagactgtatgccattttccatctttttctctccccatatctctgccctagtcctgctaccgctgtagactagaacttatttggtgtttgatctcgtggcattgt

SEQ ID NO: 46947 - DNA, 429 bp, Zea mays
  Clone ID: LIB3066-030-Q1-K1-E8
atagcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgccggtgagcgggcagaagggcgagcacttcgacctcaccataccggcg

SEQ ID NO: 46948 - DNA, 426 bp, Zea mays
  Clone ID: LIB3066-030-Q1-K1-E9
acagaatctcgttccaggccactcaggatctgtcttctctcaagaacatggcaggggaaaccgggaaaaagttgacatcgatggcatccaacatcatcactgatcttcaggaccgcatcctctgagctttaaactcacagtaaacttctgcgttgtttcagtggctggcttctcccgtcgacccgggtgacaaactggcctggcctggcctgcagatctgtctaggagttcgtaggcgtctgagaacttcctggcaatctggcatatctgtctaggagttcggaagcatctgaaaagtggcatatctgcctaggagttcgggagcagctaaaatcttgaagttagagagagagagagagaaagagagagagagggtgaaagaagagaacttatgaccaatactgtaattggctaaagtcatgtatg

SEQ ID NO: 46949 - DNA, 368 bp, Zea mays
  Clone ID: LIB3066-030-Q1-K1-D6
cggacgcgtgggcaggccaccgggtcgatggtgcacgaggccgccgtcgcgctgcggagctgaccggccgggacgggacgggacggaacggaagcctactatcgactgtacatacaggggttgggacttgttgggtcttcctttgggtggagagcgagggagcgcagtcgagagccagcgagcagtctctcgagcagtgcagtgcagctccggcgtagatgagattgtattgtgaccaagccgggatggaaagcaacggatggaggacaaagaagttttgtcacgtttcaagctacggccattggcggaagttgttcggggaatttattgaattccttattaaaaatccggtaaaattgatgggttcc

SEQ ID NO: 46950 - DNA, 442 bp, Zea mays
  Clone ID: LIB3066-024-Q1-K1-D8
cccacgcgtccgcccactcgtccgggtccaagccagaaaacagtaaaatggcccaatgtaagaccatcgtcgcagcagtcctcgtggttgctctcgtggtttcgacgatcccagccagcgccgatacgaacctggaacctgcaggaggctctacggagggcagtgcccgcaccttcggcatgcagaaggaagagacccgaggcaacaagaagccagcgaccctcgctggatctcttggttcaggcaagaatgccatctacgggtaaatgattagaaggaatcctgcttcggaaggtatgaaaacaatggggatgtgctcaacaatcaatctcaaccccaggtgacggcaatgagtcacccacaggaatgtaaccggatatagatggacattgctcgttccatatttctttttcatattttctcttcaaattcaattgaaata

SEQ ID NO: 46951 - DNA, 325 bp, Zea mays
  Clone ID: LIB3066-024-Q1-K1-D9
gcgcgagcaggcactgagccacctcgcgattttgcacgtatccgcagaggtggccagcgagtggagctatgagatgccaggggccaatccggacccggatcgctctctaccggatagcgatggagagggggaggatgctattacaagcaatcagccgtcgcacgatcgatacgctgacttgcacgaccactatagtcctgttgcagataatgcatctaatcactagatgctgcttaggaagttccacttacaccatgacatgctcaactaacgaattcaccacctgcaacactaggtggattcagaggaggctaccaacgaccta

SEQ ID NO: 46952 - DNA, 448 bp, Zea mays
  unsure at all n locations
  Clone ID: LIB3066-024-Q1-K1-E1
cccacgcgtccgcccacgcgtccgcccacgcgtccggcgtcgcccgcgaagggacgaggccagcgtcggctccccgtctccctcccttgagtcccttcctccagatctcggcgcgagttcaccctgcagattgactctacaatacatcggcgaggaagaagagctgcggttcggaagagtaaactctacccgccgtctcgcgccggttgaccggcgcgaaggcgagatccgggcggagatccagggcgcggcgccggccatggcgagctccggactcgcctaccccgaccgcttctacgccgccgcggcctacgctgggttcggagtcggcgaggccacctnctccgcagctatctcccgcttccagaacgacgtcgccctcctcctctacggcttgcaccagcaggccactgttgggccatgcaatgtgcccaagccaagagcgtgg

SEQ ID NO: 46953 - DNA, 390 bp, Zea mays
  Clone ID: LIB3066-024-Q1-K1-E11
gacacgcttgcatgcacacacaatgcgatgtgagccttgttcctcctggtcctcttctggggggtgcatggtgagaaggaagagtcaaagggcatcgatgcgaaagcgtccggacctggtgggtacttcgacatcaccaagttgggcgcctacggcaatggcaagacagacagcactaaggctgtgcaagaagcatgggcataggcttgcggctgcactcttaaacagacaatcctcatacccaaaggacacttccttgtcctacaactaatcttcacaggcccactcaagggcgacttgaccatccaagtggattgcaatttgctggcgaccacagacctaagccagtacacggaccattgtaatcatatccagattctactcgtctat

SEQ ID NO: 46954 - DNA, 121 bp, Zea mays
  Clone ID: LIB3066-024-Q1-K1-E12
ctttgtagctaggggtatagtagtgcgtgtagggggtgcatcgatcagtttggtcatttgggtaaaatgcttgtagttgatggtttggacttcgaataataaaaatactacttcccttctc

SEQ ID NO: 46955 - DNA, 447 bp, Zea mays
  Clone ID: LIB3066-024-Q1-K1-E2
cccacgcgtccgatgagaacgaaggcggctcggagacgaatgccagtcgcgtttggcacgacaatacacaagtgtccaccggagtagctggacctctcgcaaccgcacggtaggaggacgtgcggcggtggctgcgcctgtgcatcggatttcgtttgttttctccatgaattttgcatcgcgtgttagtgctccctaatatttggggcaaaacatatgtttagtagagggatatgggtcgactcagattaagtaattagcgagccaaatgtggtatcgtcgtccggttattggtaatgtatctgctgtggtataaatgtatctgctgttggtatacattatgaaatcacattttaattttctatgtagagaccgacgggccattttatcctcttgtacatcacatgtgtgaaatgaaagtgtgggttctaattgagggtctgtttg

SEQ ID NO: 46956 - DNA, 336 bp, Zea mays
  Clone ID: LIB3066-024-Q1-K1-E3
tgcactcttccgcccacgcgtccgctttattattattatttcattcctcatgttgttggttgtttcatgttttttccaccactaatattgtcctaattgatgcatacaagttgtcactcaaagcattttctatgctttacttattggttaaataaatacaaaggcttccttttacctatgagctatgtttagttcatcgtacatgtatttcattggaagaggtgatgtggagtcaacaaaatcctatatggtgggtaacacatgtcagttcaagtgatgagctacccaacaagtttcatgagtactagacgagtgctatccctagtcaaccgtcct

SEQ ID NO: 46957 - DNA, 445 bp, Zea mays
  Clone ID: LIB3066-024-Q1-K1-E4
ggcgtgcacagacaatgcgatgagagccttgttcctcctggtcctcttctgcatcgtgcatggtgagaaggaagagtcaaagggcatcgatgcgaaagcgtccgggcctggtgggttcttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtcatcaccggcaagggaaaccttgacgggcagggcccagccgtgtggagcaagaac

SEQ ID NO: 46958 - DNA, 435 bp, Zea mays
  Clone ID: LIB3066-024-Q1-K1-E5
cccacgcgtccgacattattacgggaacaaaaagaaaaaaaacacgagaaaaatcaaatcaggagacggggattccagagagcccctgtcgggtagggaagggaaggagaggcgaagcggaggcgagatgggggcggccgaatccgtgccggagacctccatacacgaattcaccgtcaaggattgcaacggcaaggaagtgagcctggaaacctacaaggggaaggtcctccttgttgttaacgtcgcctccaaatgtgggttcacggagaccaattacacgcagctgacggagctttatcagaagtacagggacaaagacttcgagatattggcattcccttgcaatcagttcttgcgacaggagccaggtactgatcagcagatacaagactttgcttgcaccagatttaaagctgaatacccaggttttca

SEQ ID NO: 46959 - DNA, 159 bp, Zea mays
  Clone ID: LIB3066-024-Q1-K1-E6
ggaatagagaaggcacttccatttctaaaacccttgattgacttgccattcattaaagcagtcatccaagggtttcttcctggaattgctttgaagatcttccttatagtgcttccaactatactgatgtttatgtctaaatttgaaggactgatatcg

SEQ ID NO: 46960 - DNA, 408 bp, Zea mays
  Clone ID: LIB3066-024-Q1-K1-E7
cccacgcgtccgcccacgcgtccgcttgattattattatttcattcctcatgttgtttgttgttgcatgttttttccaccactaatattgtcctaattgatgcatacaagttgtcactcaaagcattttctatgctttacttattggttaaataaatacaaaggcttccttttacctatgagctatgtttagttcatcgtacatgtatttcattggaagaggtgatgtggagtcaacaaaatcctatatggtgggtaacacatgtcagttcaagtgatgagttacccaacaagtttcatgagtactagacgagtgctatccctagtcaaccgtccttgggaagtacagagatccgaaagaaaagatatacaatagtttctgctatactttgtagtatatgtaagtctt

SEQ ID NO: 46961 - DNA, 447 bp, Zea mays
  Clone ID: LIB3066-024-Q1-K1-E8
cccacgcgtccgggcaggggagtggaggggaggggaagcatcgcaattccgaacccccacgtcgccgctcccaccaccgcggccgggttgcgtccgtttcgattgcccaggatgagcaccgagtccggggagctgctcgggatcgaccccgtcgagctccggttcccattcgaattaaataagcagatctcctgcacgctgcagctgacgaacaagacagacaagcaggtcgcgttcaaggtgaagacgacaagcccgaaaaagtactgtgttcgcccaaacaacggcatggtggcgccccggtccaaggctgacgttgttgttacgatgcaagcgcagcgggacgtgccaccggacatgcaatgcaaggacaagttccttgtgcagagcgccaccgtcgccaaggaggtcgtgccaaaggaggtcactggagacatgtttaccaaa

SEQ ID NO: 46962 - DNA, 358 bp, Zea mays
  Clone ID: LIB3066-024-Q1-K1-E9
cccacgcgttcgcccacgcgtccgcagatgcttcgacgacagcagtggccttcaagcatggcgtcctcatgcgagtaagcatgggcagccttcgtcctagctggcataggcagactcctcctcgcacctgaagcgaatccagagtcactgcctgggctctgtaccaatgggcgaaattatacggcccatatacacgccaagagacggcaagctctccaccgcctgaagcccgggcctacggcagagaggaccttccatgcgggaacaggaggcttcagcccgcagtaaacatgacacagtgtccgtatggagatctacgtcgttcgaggactgagagagctacttctgcatatccctc

SEQ ID NO: 46963 - DNA, 448 bp, Zea mays
  Clone ID: LIB3066-024-Q1-K1-F1
cccacgcgtccgttttttttttttttttaccgtcaaaccctcgatatcgataaatacagtaggtgaggacatgataccctgccaaatgggaataaaaaagcaatgacaccaccagaaatacaaccattcggtggacttgatttcttttctttaattccacagcttcatctgttgttttcaagtataatatgtacagattgccttgcaatcctgaataatgccggatcttcaggtcaatactgatccagcacacctagatagcaatgcatgatggagaaatatctagtttttttctacaagggaagtgcaggttcttcagctttctttatcatcactagagcctcctttcaatgactgtgcttcaaacatgaaggtagaacactcagaaaccaccttgtacaagtacttcttccttagcttgatggccaagcgtacacatctttttaca

SEQ ID NO: 46964 - DNA, 380 bp, Zea mays
  Clone ID: LIB3066-024-Q1-K1-F10
gccctacatcgtgagggccgtcctttttttttttttttgaaacctatccctcatctatagtgcgcattaaaacacgtatagggccgactcattctagtaaacgaaccaattaaacacattcaggctcactcccaacccccctaggtacccattctctgcatcaataactgtagcttcttcaccagcccagctaccatgatcatgttctctaactgccacaagcttatgataaccaaccaacttcacgccaagctagctgcctcctttatcgacagaatcctgaactgaacctactcactcatggagccgcttgttgctgccaccaacactttactagctgttgcccaaatccagtcgcaaactatcaacctacaacatcc

SEQ ID NO: 46965 - DNA, 450 bp, Zea mays
  unsure at all n locations
  Clone ID: LIB3066-024-Q1-K1-F11
ggcgggcaaaaatggcaaaggctctcctaggtggcctatcggcgatcctcgtcgtggcgggggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaggactgcangaagctcctggaggacgccgtcgacgacctgaagggcatgctcgagatggccggcggcgacatcaangtgctgttca

SEQ ID NO: 46966 - DNA, 427 bp, Zea mays
  Clone ID: LIB3066-024-Q1-K1-D7
ctttcaccccagaccaccgctttcctctacgagtacgtcgctaaaggaagcatcctcgacatgctgtgtagccaggaggatttcccgctggatctacgcatgaggatcgcgatcaagaccgcggaagcgttgcagtacctgcattcgtcggaaactggcgtcaccggacacggcagcgtctcggcgtccaccatactcctcgacaacaacctcgtaccgaagctcaccgagttctcgaggtcatgtacgctgttcaagaagagcgagactacttctgttgttggtgctggagtgatgatcactggcagccttctagagaaagctctgaacgacgacccgtcccgctacggctcggtgttgatgaacctggagagcgacgtgtacaggttcggcggcgtcctgatggcgctggtcagcagggacggcg

SEQ ID NO: 46967 - DNA, 452 bp, Zea mays
  Clone ID: LIB3066-024-Q1-K1-C11
cggacgcgtgggcggacgcgacccaggcctcaacaccaaagccatggcgacagcgctgaggcgcgggctccgctccgggctccgcctcctcgccgccggcgccgaggcgtccaagccagctgctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttgttttgagcgacatttttttgaagttaaaagcttggacttcatcctatcttggttgttgcctgatactgcattttcttaccata

SEQ ID NO: 46968 - DNA, 438 bp, Zea mays
  Clone ID: LIB3066-024-Q1-K1-C12
aacgtacttcgatcctcaagtgatcttaattgttatgaagctaccagctagtggagatcaggggcaatgtcaaacatcgggcaatccttccaggtcgatcaggcgcaggtccagggcgagtgccaggcggagcgctcaatgtatagatatatggacgtgtctcggtccaccgcctgcgccatgaccgacaccgacggagccgaggtcgacagcgcgcagcatgaggagcaccgcgccgcacggcaccgttcagcatgctgatgagcaagtggcgcagacggcggctgacgcgatggcagccgtcaaggacacagtggcagtcgcggccgtggccgtcaaggacacggtggcggacgcggaggcaggcgccaatgacaccgtgaccgacggccactgaccgactcacgcgcgtgaacacgacagcgtaccaacaatgct

SEQ ID NO: 46969 - DNA, 441 bp, Zea mays
  Clone ID: LIB3066-024-Q1-K1-C4
gccaaaaggcactgaagaagccagtcaatagcgagttctactactagtagctagcctgctgatctgttctgttgtttagttcgcaaagccttctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggcgatcgatgagaacggcga

SEQ ID NO: 46970 - DNA, 431 bp, Zea mays
  Clone ID: LIB3066-024-Q1-K1-C5
cggacgcgtggggagaagatggccttgttcctccacgccgccgtcacgtcaccgggacacgggcagcagcacggcgcctcgtcgcacgaggcgcccgccgcgaacatcacgccgcggacaacagccaggaataagcagcagcacctgccggtgagccccggggcgtgcctctgctcgccgaccgttcacgagggctcgttccggtgcaggctccaccgcggcagcggcagcggctccggcctccacgagatgaagatgagcaagaaggccggcgtatgacgacgcgacgcagcgggcggcgacaagcgttcgtactacgccttaccgcaaatgcacaggtgcctttgcctgcatttcggcctctgcttttgtcccctcatttgttttcgctgcatacagtaatacagaaggggaagagtaccttgtttttt

SEQ ID NO: 46971 - DNA, 435 bp, Zea mays
  Clone ID: LIB3066-024-Q1-K1-C6
cccacgcgtccggagaaatgaatatcgatagctggcatatcatcatgaggatgcgaattccggaggaaggcccatgtgatcctattgctcccttagatcttccacattcgttgcatgctttccaccgcgtatcagcttgtgactctctcaatttggagggataccacacattccgtggaggattctggaattattttagcttgggaatggatgcacaagtatcctatgaattccactctgaaaggaagagaaatccagagaagttcagacaccagctaagaaatcagggtacatatgctaagcttggatttaagcattccctaaaccatctttcatcgaggaacatttctcaacttgcaaaggtgaagatcatgaaaagacctggttcccaatgggaagagctgaagattcctcgcagcattcaatcagttatct

SEQ ID NO: 46972 - DNA, 141 bp, Zea mays
  Clone ID: LIB3066-024-Q1-K1-C8
cacatacacagactgacaagaatttttcacaaccctagaagacacactgccagagagatctcttcacaaaggcgtcgagcctctccactcggccatactcaacgacaacctcaactccctcgacaatcacggcttcaactc

SEQ ID NO: 46973 - DNA, 366 bp, Zea mays
  Clone ID: LIB3066-024-Q1-K1-C9
cgaacgcttacgcttgctcggctgtgaacatttcacatggagattgacgcagcgagagctggggcgccttcatgggcatgcgagcgctaacatcggctacaaacgatgctagggcccataacgatcagatgtatgatgacatccgtctagactgagatcgatcagatcatgtactagagcgaccggcagcccacacgttagtatacgcgaaaggtggacacatagaacgattatgcatggcagctccttgctaaccggaccgctcgtactggagacagagactatctgtcatagagtactgcattgctgcctactactactagtccccaacgcttgtcggtagctactactacctcaccgtattac

SEQ ID NO: 46974 - DNA, 334 bp, Zea mays
  Clone ID: LIB3066-024-Q1-K1-D1
tcttccactcactgaatgctttttgtttcccatcaaaaaatgattcacgtatggttgaatcatttccttatctagggttgcaatatcaagtcaattccagttctaaccttaactcaactctacaacgtcatgtaaattctaccttgtaattattcgtgccttggttgtttccgttgtttttttttctcccattgctttcaaaaacatggtttacaccttttaatcaaagaagattgtaatatactaatcactacttccttgcccttcaaaaaaataatatatttataattttatttatttttattattttattatatatttaattatataaaaa

SEQ ID NO: 46975 - DNA, 447 bp, Zea mays
  Clone ID: LIB3066-024-Q1-K1-D10
cccacgcgtccgaaatcaaaccatagcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcggtcgcgacgggttaactgacaccacggacggcggcgcgtgcggctacaagggcgagctggggaaagactacggcaccctgacggcggccgtgggcccgtcgctgtacaccaacggcaccgggtgcggcgcgtgctatgagctcaagggccccaagggcaccgtggtggtgacggccaccaacgaggccccgccgccggtgagcgggcagaagggctagcacttcgacctcaccatacc

SEQ ID NO: 46976 - DNA, 449 bp, Zea mays
  Clone ID: LIB3066-024-Q1-K1-D11
gaaggcaatatggaactagaaaacttcaactgactctcgaataaggcagcatacttataaggggtgatgcagacaacaaaccggatcactaggaagccagtgtcaagttaatccacattggtgattcagtttgagtagtgaaaatataccgctaccaactctcaatatcctgaagttcaggaggtctcatcaatggatgcactgtattacatccatgtcgaactcattctgtgtcaactatgtttggtctttccttgggagatatcttgatgcaagcataagtgacattcatggaaatgctgacttaatagtaagtcatctgtaccactgtaccattagccatctcagtctgagttcagatttgtatcttggtgttactcatgaacacaaaaggcatgtattataagaaagattgttcattcattttagtcataggcatgattgatatg

SEQ ID NO: 46977 - DNA, 418 bp, Zea mays
  Clone ID: LIB3066-024-Q1-K1-D12
actagaccagcgcgacatagcaactgaatggtgcgctggcagctgtagtcctaaagcatggggagcatgatgacctgggttctgcatctggtcatgtgggctcttatcatatactgagtccaagtggtgaacggcacattggctataaaatttatgtccgacagctgacttatgcacgcatgatcaaaataagaggcctcacaatgatgcagactcaacaagtccaccataaatgacatctgtcacccttcaaatgctaatagatactgaatgtctaggctggcttcatttgtggcaggtactttttgcgaacccatatgattgtggcgacaaccgacgatccataccatgggcacatctaccctgatctcaagcacaacgacactcgcgagacaatattgcttcgtccagatgaccc

SEQ ID NO: 46978 - DNA, 448 bp, Zea mays
  Clone ID: LIB3066-024-Q1-K1-D2
gcgttcctcttgcacggacacgggaggagaagggttgatcacgaccggtgaggacgcgtggccagagatgggtctccacggaggcgtcgtcgtgctccgcgcgggcgtgctcgccgacgtcctcggcttcgtcgccgctgccgggttcatctcaaacgacgcgctgctggagcgcgggcgcgacaccaccggccgtagcctgctgcaggccaagaaagattgcccggtgagcttcgagggcgccatctacacggtgatcacgagccggtgtaagggccctgtgtaccagccgacgctgtgctgctgcgcgctcaaggacttcgcgtgccctgactccaactacgtcaacgacgtgagcaccaactgcgccgtcaccatgttcagctacgtcaacctctacggcaagtacgcgccgggcctcttcgtcatacctgccacgagggcgaca

SEQ ID NO: 46979 - DNA, 427 bp, Zea mays
  Clone ID: LIB3066-024-Q1-K1-D3
tctttcttccactcgttctcccactcgtccgctagatctcgatgtccgcccttttttttttttttttagtaggtttttttttttttttttattttttttttttttttttttttttttttttttttttttttttttttttttttttttttttttttttttttatttttttttttttttcacaattttaaaaaaaatttctttttaaaatttcctactttctaaaaaaaaattttacaaaatttttccgccacccactttaaaaaataaaaaaatgattaattttatacccccccttaaatttttaaaaaaaacaattttttacccccaaaaaaaaaggacctccaattttttttccattaaaaatttttccactttgacacccttttttcccccttcaaaaaaattaaaaaccttttttttttttttc

SEQ ID NO: 46980 - DNA, 451 bp, Zea mays
  Clone ID: LIB3066-024-Q1-K1-D4
agaacctactcgcctcctacattgaccaacaactaagcctccgtgaccgccacatctattaggtgcagccatgggtgcctgtgcaacgaagcctaagacgcttgaggggaaagccccagctgaggccaccatctccacacccaaggttgcacctgagaccactgccatccacattgaggttgcggcgaaacaggcagtagttgagaaggtggaggaggacaaggaggaggcactaacagtggcggcgaaacaagagccagcagccaccatcgagcctcaacagattgctggtgaggtgaccacttcggaagtggcggtcgtcgttgtcgagcctgagaacaaagaggaggaggaagttgtggagaagaccgtcatcgagaaggagaagccatcagcagtccatgaagaggaaaatatcgccaccgacaaggtggcagccgagcccacaaca

SEQ ID NO: 46981 - DNA, 270 bp, Zea mays
  Clone ID: LIB3066-024-Q1-K1-D5
cccacgcgtccggtgactgaaggcttcttgatgcccatgaaaaaatgatgcacgggtcttgaaacaaggccttagcgagtgttggagtagcaagtcagttccagttcgaacctcaacgcaactctacaacgtcatgtaagtgcgacctgtaattatgcgtgcctgggttgtttcggtggtttttttttctcccattgctttcagagacatggttgacgcctgttagtcaaagaagattgtaatatactaatcactactcccttgccctgc

SEQ ID NO: 46982 - DNA, 412 bp, Zea mays
  Clone ID: LIB3066-024-Q1-K1-D6
ggaggattatagaaatactattatgaatcttaagcaggaatttgaatcattaagatcgtcatatgaggagagatgtacgttgttagaatctaagaaggaagatgtagttaaacttgtcgcagacaaggaaatgaatgacaacatagttttgcaactcatgcaacaacttgaggcaacaaaaaagttccatgaggcagagacaaacgagaaggaggattatagaaatattaatatgaaacttaagcaggaattcgaatcattaagatcgtcatatgaggagagcagcacgctgttagaatctaagatggaagacgtagttaaacttgttacagactacgtaacgaatgacaacataattttgcaactcacgctagaacttgacgcaacacaatagttgcatgacgcagagact

SEQ ID NO: 46983 - DNA, 361 bp, Zea mays
  Clone ID: LIB3066-024-Q1-K1-C10
acgatcctaatccatggtcatagctcctaattctattctacatttaccaacaactaagcacacgcgaccgctgagtatatttcaagctctcaccggatcctgctcaatgaatcctaactcccttgacgtgaaagcctcagctgatgccactatatccacacccaagcatgcaccttataccacttccatccacattgacgttgcggccaaacagtctgacattgacaagacagaggaagacaagtatgatgcactaacatcgacggcaaatcaagacccagcatccaccactgatcctaaacatattgctggtcatttcaccacatatgaattcgcggacatcactgcatagcctaatatc

SEQ ID NO: 46984 - DNA, 395 bp, Zea mays
  Clone ID: LIB3066-024-Q1-K1-A7
tcgcttctgcatctgcgattgctaacgatatccgtctacctgatgactaccctcccgctaagccgcggctgtacacgcgtgagctgggatcgcggagccgcttgtctactcgcttccggtcccagatagccttcctctccaacaaatattggattctcttacttcattacgtgatggcttgaagttctctggcagatgccgctaatcgatgggaaaggagttgattagagagatcactgatctaggacacaggcatgacatttatgtgagcacaagtcatcgggcacagcatttgctgcgccgaggacccttttctttcaaacgatatgtagatgcatgcaaggccttaaggtttgacactactgagctgaatgctcggtctctcaacctccctg

SEQ ID NO: 46985 - DNA, 443 bp, Zea mays
  Clone ID: LIB3066-024-Q1-K1-A8
tttttgacaagcaggcaaaaaatgttaatgtgggtcaaaggatttacaaaagaggcggtgtcgagcatccttgttttccaaggacgatgatgcctgtcaattttgatgcgggcgatcctgtctgctcttcgctttcttcatctttgctttaaacctcagtttcagtaccagtgtctccatagtgtggacaaagttgccgactgccataaccaccagcaagatcccgcagactaagacctgccattcggaagcaagcccatgcaaagccgtctgaagaagcaaaactccaacatatgcttcgaaaccctgtaatatgaaaaggacaggatatagcagcaagagctgcccctccacaccagctgtttcgccagcaacgacatccattcttttagcctttcctagagctattcgagtacgcaatctttgccgctggtatctattct

SEQ ID NO: 46986 - DNA, 454 bp, Zea mays
  Clone ID: LIB3066-024-Q1-K1-A9
gcaaagcagaagagatgatctggaatctcttggttatgtgctcatgtatttcttaagaggaagtctcccttggcaaggcctgaaagctggcacaaagaagcagaagtatgataggatcagtgaaaagaaaatgctgacgccagttgaggtcctctgtaaatcatatccatcagagtttactgcatactttcattactgtagatcactacgattcgaagataaaccagattactcctatttgaagagactcttccgtgacttatttatccgcgaggggtaccaactagattatgtatttgactggaccattatgaaatatcctcagtttagagataaaagcaaaattcagtctagcggcaagatgagtgggttggcaggcccttctgcagaaaggactgatagaactgcagctgaagctttgtttagaaggactggatctggttctggtcacaat

SEQ ID NO: 46987 - DNA, 235 bp, Zea mays
  Clone ID: LIB3066-024-Q1-K1-B1
ggtggctctgtccctgcgaggctacggctatggcaacgaggaggacgaccggccggagaagccgcggcggtacggggtgacggagatgcggagccccttctactccttccgccccgcaaaccaggcgctccaggaaatattggattctcttagtccattcggtgatggtttgaaagttctctggcggatgccataggttggatggaaagggagtgggtagagagatcactggtct

SEQ ID NO: 46988 - DNA, 429 bp, Zea mays
  Clone ID: LIB3066-024-Q1-K1-B10
cccacgcgtccgcacaaaccatggctgcgattatcacaaccatgtcgacacccacgcgcgcgcgggttgtcatggctgacgtggctgacttactggtcaggccatcatcgtacgtacttccgaaacggcccgcacacaggaacatcactgtcacctatgggaaggactgactggacgctatagcgacatgatatggcaagccgacggttgccgctcctgaccacaacggtgctggctgcaggtacaaggacgtgaacaagcccgccttcaataacatgggcgcatgcagcaacatccgcatcttcaaggatggtctgggctgcgggtcctgcttcgagatcaagtgcgataagcctgtggagtgctccggcaagcccgtggtggtgcacattacggacatgaactatgagcctatcgcggcgtaccact

SEQ ID NO: 46989 - DNA, 362 bp, Zea mays
  Clone ID: LIB3066-024-Q1-K1-B11
agctcgcgtgacaagcatcctgaggaccatttcatgctgatcatcgacgccttcaaccactggtgcagatgcctagtgcacaggatgccaaggtgcctatggtgcttcttccacgtggtcaacatcgactacacgcactggctcatgtactctatcggcggcagaaaggcccacaccatcatcagccagggcaaccgctacattacgccgaccaaccttgcctcaaagcaggtcaccaagcatcatgacacgccggagtccgtgtcgaagaactgggtgtggcacttcgagaacgacctctttatggacggcacctacttcaccgtcaccggctgtcatatcaacagactttttaacatgaa

SEQ ID NO: 46990 - DNA, 441 bp, Zea mays
  Clone ID: LIB3066-024-Q1-K1-B12
catacgctttgctacgctccccttgccctgttccctcgccgcccgcgcccgtggagttctgcgatcgagtcctcggagcccggagcacctggtgcaacaatccggacccgcgcgaggaagggcggagagagagccgaatctgagcctcggcacaagttgggcacccgtcaagattctcggcccgatctgctgcggaacatggagctggacagcatcgagtgcatgtcctactccgacagcatgggggacgacgacaccgacgccgtcacctcgtcccagctccctcgccccttcctcaaatcctcctccaccgccggtactgccgccgtcaacgtggtcgtcgtctccgaccgcgtcggtgccgccgggccggtagcgggagcgggttcgctggtgatttcgccagccacgggcgtgcacgagctgctcgagtgccccgtc

SEQ ID NO: 46991 - DNA, 441 bp, Zea mays
  Clone ID: LIB3066-024-Q1-K1-B2
cctacgacgaagggaatctatcatggctggctgcaacagaggccgagcctgcaacaatgtcgatcgcaaagagggccatacctgaagctacatcaatcgaagaggccaaccaaatcgtccgcggcaactggctgaatgtaattgaggagcatcatctgaagtacttggggagctctcaggtaacctggacattggctgctctgttggagtaagcaccagatacctcgccgagaagttcccatcagctcaagctgttgggctcgacctatcaccgtactgtcttgctgtggcggcacaaaaggaagaaaaactgtcacggccaaagcctattcgctgggttcatgccaatggtgaagcgaccggcctgtcttcagattcatttgaccttgtctcccttgcttatgtgcacgagcgataaccggattggtgaaggaagcattc

SEQ ID NO: 46992 - DNA, 442 bp, Zea mays
  Clone ID: LIB3066-024-Q1-K1-B3
gaagcataaccctgtacatagtgcttttctctaacttcaattgatggtgtgtttgtcaggcgaggggctatcatcacaaccttcattgtgtgctatgctcttacatcgtttatttctggatatgttagtggtggtctttactcaaggagcggtggtatggttctgcacacttttctttaattttcatgtttgtttgcgcaattcagtttctttgcaatatctctttccatgacgtaccttcatgttcttctatttcaaaaatagtctgcagtttaacttgtcatgtatggaatcctcacctcacaaaatatggctcttatcgattgcttcttgaattcatggcaggcaaaaactggattaaagcgatggttcttacagcatccctctttccgttcttgtgtttttcaattggtttcatgctgaatacaattgccattttcta

SEQ ID NO: 46993 - DNA, 450 bp, Zea mays
  Clone ID: LIB3066-024-Q1-K1-B4
cccacgcgtgcgaagctaggctgttgagcttgcactgcagctagttaagtctgccaaaatgggagcagctgtagctagaaaggacggagtggatgcacatgcttgtgagaaaactcatatatgacgcgcgatcttgggcagaagtggtgtctacggaggagatactgaccacattcaacgagtacggtctgctgctgacgctgagagaccacgatcttctgatgcactgagtgtttgacgcacacccttgttgatcaggcaccaatcgtgctgaagccttcagaacaccagtctgagcaggaggcgcttgatatagcgatcacatagttgctattgaagtcatattacaaaattgtcacgaataatgtggaggacttaatagcaatagctgctatgcatctgtcgagatgtgattcatattcgattgtactttcaggtaatcatacaaaa

SEQ ID NO: 46994 - DNA, 434 bp, Zea mays
  Clone ID: LIB3066-024-Q1-K1-B5
cccacgcgtccgcggacgcgtgggcggactcttgggacggcgacaacgcacagccaggccgggacttgcaacaacagtccctgaagttaccggcggctagcccatatgacaatttcctcagagctgctggctgttagaggtccagcttgcagcatccaaaacatcatttacatggactatggcaatttcaagatagccacgaactttccattccgcaggaaatcaaggaagaggtatgtccgtgtatgatgtcttagctagagactcaaccggattcgacacccattctttatgtatagctgtatatatgtataggttggctctttgctgctgctgatgctgctgctcttgccaatgcaacgagtagaaggactgggggggagcattgccttctatcacagactgtacatgtaaacatgttgcagaaatatatg

SEQ ID NO: 46995 - DNA, 442 bp, Zea mays
  Clone ID: LIB3066-024-Q1-K1-B6
ggaagaatggcaccagaaattgcacaacaatacaagcccagatgatgtagtgatatgccaggccttaattgattatatcaagagtgactttgatataagcgtttactgggacaccttgaacaaaaatggcataaccaaagagcgtctcttgagctatgatcgtgctattcattcagaaccaaatttcagaagtgaacagaaggcgggtttactccgtgacctgggaaattacatgagaagcctaaaggctgtgcattctggtgctgatcttgaatctgctatagcaagttgtatgggatacaaatcagagggtgaaggtttcatggttggtgttcagatcaatccagtgaagggtttaccatctggatttccggagttgcttgaatttgtgcttgaacatgttgaggataaatcagcggaaccacttcttgaggggctattg

SEQ ID NO: 46996 - DNA, 445 bp, Zea mays
  Clone ID: LIB3066-024-Q1-K1-B8
cccacgcgtccgcggacgcgtgggcggacgcgtgggcgcggaagcaagaggaggcgagcgagtactcgaccagccctctccgctcttgtctccgatggcggctcgcgtcctcgcggccctcgccctcgccctcgccctcgtcgccctacccgcgcccacgcgggcgtccaacgacgagggggacgcgctctacgcgctgcggcagcggctgtcggaccccaacggcgtgctgcagagctgggatcccacgctcgtcaccccctgcacttggttccacatctcctgcgaccaggtcggccgcgtcgtccgcctggacttgggcaactccaacgtctccggctccatcggccctgagctcggccgccttgtcaacctcaaatacctggagctgtacaggaacaaccttgacggcgagatccccaaggaattgggcaacctcaagaac

SEQ ID NO: 46997 - DNA, 307 bp, Zea mays
  Clone ID: LIB3066-024-Q1-K1-B9
tcgcgcacgcgtccgctaatgccttggcggcgtctaatgctctacattccacagacgcgcacgagatcgtccgcaactcgtacctggctacacatactatgtcgagctcacggcactactctcctatagcgcggcgctggacacgctgacattaaatggcagccagaggcaaacatctgtggctgactgctggcggccagagtgtgacgtcgcgacgctgaagacacctgtgcacatagttaaggcagcgtaggagtcaccgcaggctaagagcgtcgtagcatctaattcagttgatacgaacaac

SEQ ID NO: 46998 - DNA, 289 bp, Zea mays
  Clone ID: LIB3066-024-Q1-K1-C1
cccacgcgtccgcccacttgtgaagaaagtgcaaactgactaaaaaggcgagcctatttggtgcatcattttacgtttcgctagtttatacgtgaatctctgaataaaaaagagaaaaagaaaagaaaagagagagagtagccacttgctagtagctggttcagtgccccggcaaattaatggccatctccctggtaaaggtagtcgaatgttcttgtaatcttgtcaattggaagctacactgcactggatgcatgcccaccagtcgaactgagcatgcgattttttc

SEQ ID NO: 46999 - DNA, 404 bp, Zea mays
  Clone ID: LIB3066-024-Q1-K1-A6
gctgcagaaccatggaacttgataatttgctaagtactgggcacaaagctgcatctttcccaagatggaagaacaaaaagcatggcagtgtcgtaagctgcctaaaagagtaacaaaccaagcaaatcttaacattttaacatcccaggtcgctatgttttgccaaaaactccagaaaaattattcatgtcgtctagtattatattaataataaaaagaacagtagagcaggtcctgtttcgtccgagactccaggtcagttcttagcattgaggtcattccttatcttgatcctggatcggttgtccaacttgacaaaacgcttcaggtcttcataagagagtgtcttgagatctttccttcgcagctcacttagtacaggacgcttgtcgagcaagtgccac

SEQ ID NO: 47000 - DNA, 423 bp, Zea mays
  Clone ID: LIB3066-003-Q1-K1-C1
gggcgcgctggtcgacctgcagcggtccaaggtggcggtgcagaaggccaaggacgaggccggcgtcgacacgtggctcacggcggctaggctcgacggcgactcgtgcctgagcgactgccagaaggtggagggcgcgtcgtgagatgctgcatagtcaacaagatcggctatcgcttcatgatgtgctacggtgatacgtggttccgccaatcgcctatatgagccacattcgttcatgtcagctacactgagctgttaccacaggattatagatggtgcaatctctgctgaatttgtgaaagcattcattggctacatcgagaacccgacttcgatgctgctgtgaagttaggatcgatgacctaacacaattcttgtcaagttgtttaaataaccattccacccaaaagcggtgttttc

SEQ ID NO: 47001 - DNA, 395 bp, Zea mays
  Clone ID: LIB3066-003-Q1-K1-C12
cccacaccccccgctggcggatccccccgccgcctgcccgcccgcgcgccaagaattggattcacctccccccacgctgccaggagctctgcccggcccccgggtgccgaacgaccaccaggttcacccgtgtctgccgccggcggatgcccccctcccccggtggctaggagctccattcgtgctgccgtcgtgtgctgctgggcgtctcccccaatggtgttacagcatgggcattagagcactcaatgactgacggggagctactctggcgcgcatcgttcaccccggcagtacctattctgacgcgtatggtaggtggccatcatgttcctcacgcatggtcaagtgcaactcgtgaggtgcctcactactgcatctacgtccacacgcta

SEQ ID NO: 47002 - DNA, 414 bp, Zea mays
  Clone ID: LIB3066-003-Q1-K1-C2
cgacgcgctggcggagctgccgttcatgacgctcatcgggcacatcccaggtgccgtgaagccacgggacctcttcatcacgaggacgcgcaggatgatggggatcaagagcaaaccctacggcacgatgccgcacgtcatgtgagggagatcccatcgacgatgacgtccccggccccggtccggcgatccttcaattccgatgaccaaacggagactagctagataggctctctgtctctggattttgccacgttctagttctagctgatcatttgatctggtcgtctgagatgtacgcttggtgttatgagtgaacccggaatatggaagcacgatcacttgctatatgtattatacaggtatactagccggttgcgacggtttacaataatatccatgtaaactatgcat

SEQ ID NO: 47003 - DNA, 261 bp, Zea mays
  Clone ID: LIB3066-003-Q1-K1-C3
cctcgatcttaattacaggtcatagctaagcaggtctgacaggatgtcgtggcagacgtacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacat

SEQ ID NO: 47004 - DNA, 382 bp, Zea mays
  Clone ID: LIB3066-003-Q1-K1-C4
cccacgcgtccgcgcaaactcagttggggttaggcctgcccctgttgaaccaatagttgaccgaaaagcaaagctgtcatgtgaagtgatgaagatgataaattcaaccatagctggactggagaaagggcacctgcctgtgatgtcagctgaaggttcaggaggtgtttatttcatgcgagatgcaacaggccagaagaatgttgctgtgtttaagcctattgatgaggaacccatggccaaaaacaacccaaggggcgttcctgtgtccacagacggcgaggggatgaagaggggaacaattgtaagggaaggtgcattcagggaggttgcagcttatattctcgaccatccagttagtgatagtaaatatggtcacagt

SEQ ID NO: 47005 - DNA, 396 bp, Zea mays
  Clone ID: LIB3066-003-Q1-K1-C5
gagaccgccaagtgcaagaagatcgtctgcgatccttcgtatttgccagacaaggtggagaatgttggaagggtggcccgcgcgatatgcatcatgaagcatcctatcccggacaccaaggactcgcactccgtgcagatcatcctccccaagatgcagctaaagcgcaaatccgacatgtacgtgttctgctgctactactcccacaacgtcgcgcccaaaggcaagttcatcgtcttcgtctccaccgaggccgagaccgacaagcctgagatcgagctcaagcccgggatcgaccagctagtctcctggagtggagaccttgttcgacatctacgacagatatgaacccgtcaacaaccatgactacgactgctgtttactcacatattgcta

SEQ ID NO: 47006 - DNA, 434 bp, Zea mays
  unsure at all n locations
  Clone ID: LIB3066-003-Q1-K1-C6
gattattacaagcataaagctatagaacacattttgattttgtcaggagatcaactcgatcgtatggattacatggagcttgtgcagaaacatgtcgatgacaatgcagacataactttatcatgcgctcctgttggagagagtcgagcatctgactatggattagttaagttcgatagttcaggccgtgtaattcagttctctgagaaaccaaagggtgctgccttggaagaaatgaaagtggataccagctttctcaatttcgccattgattccccagctgaatatccctatattgcttcaatgggagtttacgtttttaagagagatgttttgttagaccttctaaagtcacggtatgctgaactgcatgactntggttctgaaattctgcccaaggctttgcatgagcacaatgtacagggcatatgttt

SEQ ID NO: 47007 - DNA, 439 bp, Zea mays
  Clone ID: LIB3066-003-Q1-K1-C7
gccgccagctgctgacctatggacgaagaattcctaccccagagctttttgcaagaatagatgctgttgatgcaagcactgtgaagcgtgttgcaaaccgcttcatctttgatcaggatgttgctattgctgcgatgggaccgatccaaggacttccagactacaactggttcagacgccggacctacatgctccgttactaagatcaatctgccggtgtaccatgtttacggtgtgcaaggacaaagataaaatttgcctctttcggcgtctgtatatcaaggcctcagcactgcacatcgcttgctgcgacagaggtttttttcttcttcagaatttgttttatttcttttcttgctcagaatccacaaatctgccaataatgataggcaggttcgactgacgtggcttacttgggtggtcagcctatggtattttt

SEQ ID NO: 47008 - DNA, 362 bp, Zea mays
  Clone ID: LIB3066-003-Q1-K1-C8
cggacgcgtggggcagcagcccatgcagaggaaaaggtcgccaccgccgccgagaccgcgacgacggtggaggcgaagaagaacgccgaggaggccgggaaggagaagctggcgcagcaaagctgatcgactgtccgtgcatgcgtgccaattaatataattgggctgatgatgcctgatgttcaatgtgtgatactgggaatcaagcaggagaccacacttgaattctctacagtttggcataggtcgggagagacactctcgaccggccacaccatgtaacaaactaaccttcttcgttgtctcccattattttcctccacggagttcttctgatgaaacaacatgttctaattgggctt

SEQ ID NO: 47009 - DNA, 279 bp, Zea mays
  Clone ID: LIB3066-003-Q1-K1-C9
acggctcctggagaagcttgaggacagatgccacatgatcgaaacctccattcaaggtcgggttcaggaggctctcaagaggcaatgcagctaagagccaaacctttccggggaggactcctactcgtaataatggtctgtagtatccaaatcaaactagcactgaagctggactggaggtcatactcgctcagtctgtgtaacagtgtcagattgattatcatgcttttgtacgacatcaggaatcataccacgagatcatgcgatgttaacaacaat

SEQ ID NO: 47010 - DNA, 404 bp, Zea mays
  Clone ID: LIB3066-003-Q1-K1-D1
cggacgcgtgggtttcaagagtgggaaatcaatagaagccgataattctttggactatgcggcaaatttctcacacatgcttggttttgacgaccaaaaaatgctggagctgatgcggctctatgtaacaattcacactgatcatgaaggcgggaatgtcagtgctcatactggtcatctggttgggagtgctctgtcagatccttatctttctttcgcagcggctctaaatgggctagctgggccactgcatggccttgcaaatcaggaagtgcttttatggatcaaatctgtaattgaggaaactgggagtggtgttaccacagatcaactcaaagactatgtctggaagacactaaagagtggaaaggttgttcctgggtttggtcatggagttctgcgta

SEQ ID NO: 47011 - DNA, 293 bp, Zea mays
  Clone ID: LIB3066-003-Q1-K1-D11
gagcttcgcacgctatcgctcacaactgtgggcagatgcagtctttgaaccataggctggtgtgatgatgttacagataagggagtgaccagcttagcgtcaggatgccctgatctcagagccgtagacttgtgcggttgtgttcttataacagatgagagtgtggttgctcttgccaacggatgtccgcacctgcgctcgctgggcctctacttctgccagaacatcacggaccgcgccatgtactccctcgcaaacagccgcgtgaagagcaagcgttggaagtgggatgc

SEQ ID NO: 47012 - DNA, 399 bp, Zea mays
  Clone ID: LIB3066-003-Q1-K1-D2
ccctcacggccgcctccacaatgccgcgccatctcgcgctgctcctgcccctgctactgctggcctcgccggcgggcacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggcgggcggatgggtggcgtggggcctgaacccgacgggcgagggcatggccggcgcgcaggcgctggtggcgctggcgggggccggggccgcggcgcccgccgtgcggacgtacaacatcacggggtacgtcccgctgggcaaggcctacacgccgctggact

SEQ ID NO: 47013 - DNA, 421 bp, Zea mays
  Clone ID: LIB3066-003-Q1-K1-D3
catacgatgttactagtaaactggcaagatttactaggctacaagcagatacaaatatggtgctaccaaaacatttgtttgccactgtgctttcctgaatacagtcttactccaaaaatgtggaaataatatgcatggtgcagctatttacttatgatctgatatgcaatcagatgtacttgacgattccagtttattgtcattctgaccaactctagtgtttctgtcgcaacatttcaacttatttgcaagtggttattttgtttttactatcttatcttgagctcaattcttttttgaatgaaattcttgagttcatttcttgtcacatgggctttatacagctctgccttatgttttgcaccttcgcttatcaccatattctattcaacaagcaagcccacaatgcaatactttgtgt

SEQ ID NO: 47014 - DNA, 257 bp, Zea mays
  Clone ID: LIB3066-003-Q1-K1-D4
catcagtcgagcctccgtgcacgacgcattcgccttgatctccgatccctaccttcagtaggagagagagaggagaggagaggagaggaggggcacggagatggagagagcggccctcgtgaggagctaccacacctcgacggctgacctgctcacgtggcctaaccccgatgcgcccggtcgctgacagcacgccggcctaaccagccgacggaagaattcaggaatgtcgtgtctggggggcagctcacagaagg

SEQ ID NO: 47015 - DNA, 387 bp, Zea mays
  Clone ID: LIB3066-003-Q1-K1-D5
gtggcgctcactgtcgacctccccgccattggcgcctttactatcccgctcaccgccgagggcgagatcaagctccgcacctttcgggacctattagtctaagcaattcagatgtttggtgtgtgaatctgatcagctttcataccatagtcagtgctgatgtggatatgcaatatttgcggatttctttatgtgttcatggatttcaaattgaggacgggcgcacgcttgctgactacaacatccaagaaggagagcaccctacaacttgggctgcggctctagagaagcctgcctaacttacgcaagactgctgacctggtagactttcaatactggaagcggagtccaatgacatgatcgacgtcttccaaggccagaactggg

SEQ ID NO: 47016 - DNA, 308 bp, Zea mays
  Clone ID: LIB3066-003-Q1-K1-B9
ggagcaagcttgcaatgaagctctaatcctcctgctgtgcgacatgcctgccctgcaggaggagcaagcttgcagtgaagcatataagacttcaaacacacgataccaggcatgcatgccatacagtacatgggaatgaaaaccacacaacgctcgactactgataattgcatgacacagtcacttacgattgctataatcaatactgacagcatgacctacatggttccaatgcaggcattcgccttattaatcatccactacacactcaccctacctaatagaaacaacctggacagcctaatcaa

SEQ ID NO: 47017 - DNA, 359 bp, Zea mays
  Clone ID: LIB3066-003-Q1-K1-A12
gaaaattgccatcacctaggttccaggttgaggttgtcctggtagattacgatggctcgcaaccaccaaaaccagccgctggagcagttgataataaatctgatgccgattcctcggctagcacggctgtgaaagaaaatagtgttgcgcctgcagaatccaacaaggggactggaagcaatgataaagatgaagtattctcggacagtgacgacggggaggatggatcatctaaggaaagaaaggagaggactgctggcgcggtggtcaaggcagtgtaaatgctgctaaaccatctcaaacaagcaacgtggagaaggaggcatcggccgctgctagcagacttgataaagtatagc

SEQ ID NO: 47018 - DNA, 407 bp, Zea mays
  Clone ID: LIB3066-003-Q1-K1-A2
cccacgcgtccgcccacgcgtccgggcagccagcaggggaggaggacacgaatcgtagtcggcctcccgcccgccccggcaattgttgttgctgctgcgcgcagggcggttctggattgcggtctgccccacccacgaacaatccatggctccatctccgcctcggcgtgctgcgctcctcctcaccactgtgcttctgctggcggcggccgggtccacccccggcgccacggctgctggcatcttccaggtgcgccgcaagttcaccgccggggtgggagggggtgctggcgccaacatcagcgcccttcgcgcccacgacggcacccgtcacggccgccttctcgcagccgccgacctccctcttggcggcctcggccttcccactgacactggcctctattaca

SEQ ID NO: 47019 - DNA, 255 bp, Zea mays
  Clone ID: LIB3066-003-Q1-K1-A3
cccactcgtgcgcccacgcgtcttcccacacgtgcgcggggcggcaatgacctgctgggacctttaggtggtcaccgcgctcgacacctccaatacgcaatggtaccacttcaccgccatcgtggtcgccagcatcgggttcttcaccgacgcctacgacctcttctgcatctccctcgtgactaatctcctctgccgcatctactacaccgtggaggggtccgccacgcccggcacccttccgccgtacgtgtc

SEQ ID NO: 47020 - DNA, 407 bp, Zea mays
  Clone ID: LIB3066-003-Q1-K1-A5
agcaccatttcgaataacacaggtgagcaccacgatgggatccctcactaataggaggatcgtcgagggcgccgtccttgccgaactcgtcaacacccagtcgtgccaccccaccaacgtgccacccggccccaacatcaccaccaactacaactacaagcggctcaccgttagggccacctgtaaccgtcagcccaacagcgactacactcctgacaactgcggtacgtgcgggatcaagaacgtgaacctgtcaccctacagcaacatgacggcatgcggcaacactctcatcttcaaggactgcaagggctgcgtctcatgctacgaagtgagacgcaaagaaaaacctgagtactctcacaatacaggcactgtgtacatcactgacatgaactacgaaccta

SEQ ID NO: 47021 - DNA, 412 bp, Zea mays
  Clone ID: LIB3066-003-Q1-K1-A6
cccacgcgtccgcaggcgccctaaactcgaggctcgaagactgcctgtctgactcgctgggaagagggctggcttccaaagagccccggagcggcccctcgacttcggctgtcgattctgagaaccgcgctaacttgtccagtcagtgagcccttttgaaagtggtgaagcagacaaaaggccacgtgtcagagtgaccggaagaacgagaaaggggtgtgtttcagtggtgtgtagtaggtaggtaattttgtgtgtatgcctccgggtaaaagccccgcggtacccagtttgtagatggtgcttctcctggtgctagtttcccgtcgtaagctggatttttttggggggtgtgtgccctgctctgtgtgctgacccgcctgggggtaagttgtagcagagcaagagaaag

SEQ ID NO: 47022 - DNA, 403 bp, Zea mays
  Clone ID: LIB3066-003-Q1-K1-A7
cccacgcgtccgcccacgcgtccgcccacgcgtccgcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgctccgtcgcgtcggggctctcgttc

SEQ ID NO: 47023 - DNA, 425 bp, Zea mays
  unsure at all n locations
  Clone ID: LIB3066-003-Q1-K1-A8
acgcgtccggaaatgttaacgcattaaaaggtatacggtatcagtaaaccttacaagtgtgatgccaagggaaaacggcatcagctgacacattgctatattcctgtttatttcgtccgaataaagtatataacttaagaaaggggctcttgccccacagcagctcaagcaaaaatgtacaaagaaaagcagctcgagtagagagaatttgccactctctcgacagattgagctgctgccatggcgctaattcacgacacatttgatgtctcggcaagacggggaggagctcagtaagtgagatgataaaaaaatagaatcaggttggagggtaagtatacacgggtagaaaaattgcctccttggccttaattntgggtcttctccaccttggccttgatcttctgctcgatgattgccttctc

SEQ ID NO: 47024 - DNA, 413 bp, Zea mays
  Clone ID: LIB3066-003-Q1-K1-B1
cggacgcgtgggcggacgcgtgggcggacgcgtgggctgacgctgccttttgctctggccttccaccccgtctgcccgcgcgcgctgtctcgtggcgacaactgggcgaccgccgccgccgtcgctgccgccgctacgccaagaagctaggtcttcatcggtcccttcgtcgagattttctccggcgacaagcacccagcaggggactacaagattgattttgatggattatgacaagtctagaagaagtaactccaaaaagaggacacattccaattctgatgacggaaagaggaaacggttgagctctaggcatgatgacacatctatgtcctctgagccaattgaaaccatctacaggatattgtgcccggcaaaaaagataggcagtgtcttgggaagaggtggtgaca

SEQ ID NO: 47025 - DNA, 250 bp, Zea mays
  Clone ID: LIB3066-003-Q1-K1-B10
acaggacctggcgaagaatgtatggactcctcagcgtcgaccggctactggtccggccgatactgatgtcctgcctgtgcaacgcatacagcgacgagcaatacctcatcttcttgagactatggtgtgagcgctactgccatgtccatgttcactatgatctagaggaagcgcacggagcctgccaacttcaatgctttataccctctgcacaaaccaagtgcgacactaggaatgctccagaagaaag

SEQ ID NO: 47026 - DNA, 416 bp, Zea mays
  Clone ID: LIB3066-003-Q1-K1-B11
ccggcgtcagagcgtcccgtcacgcgtccggtcacgcgtacgctcaaatggcagctgatcaacaggtctatgcactggtggttcctggcttttggatggatggtggtcagcccagagactacattactggattgcgtctgtatctagactcgcttacgaagaaatcggctgccaggctagctgctggagcacatgttgctggcaacgtgctggtgcatgagagcgccaagattggagaaggttgcctgatcggtcctgatgtctcaattggacctcgatgtgtcgtgcaagatggcatgaggctatcccgctgcactgtcatgcgtcgagtgcgtatcaagaagcatgcctgcatctcgaacagcattatcgaggggcactcaactgttggacaatgggcacggatagagaatatg

SEQ ID NO: 47027 - DNA, 151 bp, Zea mays
  Clone ID: LIB3066-003-Q1-K1-B12
cccacgcgtccgcccacgcgtccgatcgcgagcggccgtccttcttttctccggggtggggtttatgagtggcgggctgttctcatcaacgttatgtatactcactggcaaagtacatggcataagtgccgtcaacccgctgattaccggc

SEQ ID NO: 47028 - DNA, 382 bp, Zea mays
  unsure at all n locations
  Clone ID: LIB3066-003-Q1-K1-B2
cgagacgccgctgcaggtcaagctcaacggcgtggccaccatcatcggcaagatcgggctcgccttcgccgtggtcacgttcgcggtgctcacgcagggcctgttctggcgcaagctcgccgacggctcctacttcagctggaccggcgacgacgcgctggagctgctggaggtcttcgccatcgccgtcacgatcgtcgtcgtggccgtccccgagggcctgccactggccgtgacgctcagcctggcgttcgcaatgaagaagatgatgaacgacaaggcgctcgtgcggcacctcgcggcctgcgagaccatgggctccgncaccaccatctgcagcgacaagaccggcacgctgaccaccaaccacatgaccgtcgtg

SEQ ID NO: 47029 - DNA, 194 bp, Zea mays
  Clone ID: LIB3066-003-Q1-K1-B4
gcctttgcctacacatcgacgcacatgtacttttggggataggcttgccaccgtgtggtgctagatgagtcgtggaataagcttttacttcctcgctgctgtgggcgaagtgactggaattcggacatctggaactaacaaaaccctacgtggatgcgtatgacatgtcttgctcgacaatgacaacccaaaca

SEQ ID NO: 47030 - DNA, 414 bp, Zea mays
  Clone ID: LIB3066-003-Q1-K1-B5
cccacgcgtccggtggggataagttcccactctttgctggcatcatagcacttgtgatgagcatcgcaacgatggtccgtctgacccgcagcatgatgcctgggaaggttctcggtgctgccataggtggagctaccctctcagaaggtaaatcaaaagtacaagagcgccagcggtccaagctatcagaagaggctgtggaggaagctgaagacgccgtctctgcaaagcgcctctcggagcttgaggagaaggtcattgcactcctgacaaaacccgcatcaatgcctgctgataaggaggaggttctgcaggctgctgtctcccgcgttagtgcactggaagaggagcttgcagctacaaagaagaccttgcaggagactcttgagcgtcagttggagatcgttgcataca

SEQ ID NO: 47031 - DNA, 398 bp, Zea mays
  Clone ID: LIB3066-003-Q1-K1-B6
gtctttgcctcgacagcgattcaatcatccgaagtacttctcaaatgatgttgtggcgaacagcttgcccatccatcaaagtgacccggtttcaacaatgaatgattcttttagcaactatttggcctccgctcctcccgcggaacaaaagaacttgcttgggaacaggctctatcctcttgttgagaggcatcagcccgaactcgcgagcaaaatcactgggatgctcttggagctcgacaactctgaagtggtcacgttgctttgctcgtcggagatgttgtcggtcaaggtcgacgagtgtgtccagctgttgcaggcaaccaagcctaaggctgaagatcatgaggcgctgcacccaggattcatgctggagcctcggcctcctactgtaaatg

SEQ ID NO: 47032 - DNA, 406 bp, Zea mays
  Clone ID: LIB3066-003-Q1-K1-B7
gtacaattgctgaggaggtgaagcagttggctcaaaaagcaagagacaatagcttaaaaccagcagattatgagggtggcaccttcacggtatcaaacttgggaggtcccttcggaatcaaacaattctgtgccatcataaatcctcctcagtcagcaattttggctattggttctgccgagaagagggtgatacctggttccgccgatggcctgtatgagtttggttcgttcatgtcagctacactgagctgtgaccacagggttatagatggtgcaatcggtgcggaatttctgaaagcattcaagggctacatcgagaacccgacttcgatgctgctgtgaagttaggatcgatgacctaacacaattcttgtcaagttgtttaaataaccaggccacccaaa

SEQ ID NO: 47033 - DNA, 387 bp, Zea mays
  unsure at all n locations
  Clone ID: LIB3066-003-Q1-K1-B8
ccctccctccctcacacaaataataaggaaaggtcccgcccttttcctccgacatccgcaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgngccgggttcgtgaccaacgtcaccgagtacatcgcgggcgccaaggtgagggctgagtgcaagcacttcggcaccggcaagctcgagcgcgccatcgacggggtcaccgacgcgaccggcacctacacgatcgagctcaaggaca

SEQ ID NO: 47034 - DNA, 360 bp, Zea mays
  Clone ID: LIB3066-003-Q1-K1-A11
acgcgtacgcgtggcacaatatcatcatcactacatcacccgcttttctcaaaagggacaggcataacaaaacaaaccctgaagataatagatacttcattaaaaggaatcactggatgaaaaagttcgcatatggagcattcaaaaccgtgaaattgttgattggaaagatttgcatgaaatggtcactgctgcttgctataccccagatggacagagtgcactaattggttcccataaaggcagctgccatatttatgatacatctgataataagcttctccaaaagaaacaaattgacctgcaaattaagaaaaagaagtccagtcagaagaaaataactggatttcaggtccttga

SEQ ID NO: 47035 - DNA, 259 bp, Zea mays
  Clone ID: LIB3066-002-Q1-K1-G3
cccacgcgtccggaggacacgaatcgtagtcggcctcccgcccgccccggcaattgtggttgctgctgcgcgcagggcggttctggattgcggtctgccccacccacgaacaatccatggctccatcttcgactcggcgtgctgcgctcctcctcaccactgtgcttctgctggcggcagacgggtccacccccggcgccacggctgctggcatcttacaggtgcgccgcaagttcaccgccggtgtgggacgaggtgc

SEQ ID NO: 47036 - DNA, 390 bp, Zea mays
  Clone ID: LIB3066-002-Q1-K1-G4
cccacgcgtccgtgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactactacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatg

SEQ ID NO: 47037 - DNA, 85 bp, Zea mays
  Clone ID: LIB3066-002-Q1-K1-G5
cccacgcgtccgcccacgcgtccgcccacgcgtccgcctggggagtaaaggatgcttgggatgggaaagtagtggcattctcaaa

SEQ ID NO: 47038 - DNA, 426 bp, Zea mays
  Clone ID: LIB3066-002-Q1-K1-G6
cccacgcgtccggatattttcaaactggctattaatgtatctttcagatgaggaggtccaaaagcttgtggggaaaatggttaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacaagtgggatattacgttatgagcgtgtctttggtga

SEQ ID NO: 47039 - DNA, 414 bp, Zea mays
  unsure at all n locations
  Clone ID: LIB3066-002-Q1-K1-G7
tccaccgcgacgtcaagaccaccaacatcctcgtcgacggggactgggtcgccaaggtctccgacttcggcctctccaagtccggcccgacgacggtgaaccagacacacgtgagcaccatggtcaagggcagcttcgggtacctcgacccggagtacttccggcggcagcagctcacggacaagtccgacgtgtactccttcggcgtcgttctcttcgaggtgctcctggcgcggccagctctcgacccggcgctgccacgggagcaggtcagcctcgccgactacgcgctcagctgccagcggaacggcaccctgctggacgtcctcgacccaacgatcaaggaccagatcgcgccggagtgtttcaagaaggtcgcggacacggncgagaagtgcctcgccgagcagagca

SEQ ID NO: 47040 - DNA, 145 bp, Zea mays
  Clone ID: LIB3066-002-Q1-K1-G8
cccacgcgtccgcccactcgttcgaaaaataaaaaaaaaaaacacaaaaaagaaaaaaaaaaaaaataaaaaataaaaaataaaaaaaaataaaaaaaaaattataaaaaaaaaaaaaaaaaaaaaaaactggccacctttttaa

SEQ ID NO: 47041 - DNA, 402 bp, Zea mays
  Clone ID: LIB3066-002-Q1-K1-H1
gaaagaacgagggacatctggtgctggctgaagaaccatcgaccctgatggtactccaggcggcagtaaaagaccgaaggattcagctcatgttcaccaagtttgtgagggagttgagagaggagcccgtcttgatgattagggtgagctggaacgtgttcctcatctcggtctcatctgccgctgtaggcctgcaccgtttcttggtgttcttcttgaaggaggatggtgccaggttcttggatgacaaggtcaagaaaatgaagatttggctgatggagttctcgaagcggacggctaatctggagattcaaggaattctgtgaatgtggtggcttttggttgaaggatttaatagctgcttcgcactctggtttttggagttactttctgcatcgagtg

SEQ ID NO: 47042 - DNA, 300 bp, Zea mays
  Clone ID: LIB3066-002-Q1-K1-H10
gttgatcggcattgaacacgcacacgctatagtttttacccggtgaatggaccatttgcattggaacgatacgtgtgagttctctagtgttatttccagtggcctaagctagcaacagtgtatagttgggttggcactgcaaacttctaccgttcgagttgggtattagagctagttattggttcatgttgaacttatattattttctatcttgctgcagttatgtttgctatgtgtaccaaacatgtattggaatttttgtaagctataatatggccagcacagcagtagcctcacatg

SEQ ID NO: 47043 - DNA, 419 bp, Zea mays
  Clone ID: LIB3066-002-Q1-K1-H11
cgcggttcatgacccagaaaccggcgtcggcgatagtgtcaaagctggagcagatcggggagacagagcgcttcgtggtgaagaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcacaattggagccatcctcttagaccgtctccgacagtttactcacccctcttagtcgattgttatttaagtgcagtctcttcggagatgcaattaca

SEQ ID NO: 47044 - DNA, 383 bp, Zea mays
  unsure at all n locations
  Clone ID: LIB3066-002-Q1-K1-H12
gtcggcagccaccatgccaccgcacgcaaccaaggatcccgtcgccgcgcctgcaggggccacggcggcggcgctgtcgcgggccctggcggcggcgcgccctttcctgcgcggggaggaggcggaggtggacccggcgctgcctggcctcgccgacgtgctgcgcggcgcgggcgccggcgagtgctggcacaagcacggcacgttcctggcgcacctgctggacgtgcaccggatcctccgnctgtggggcgcgcccgacgccgtggcgcgctggcgcctctaccactccgcctactccaactcctacgtcaacctggccatcttccagcctgacaccgggcgcgcccacgtcgctgccgtggtcggcggacccgcggagc

SEQ ID NO: 47045 - DNA, 287 bp, Zea mays
  Clone ID: LIB3066-002-Q1-K1-H2
gcaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacaggtgccggtcccgacgataacggtggcggctgcgggtacaaggacgtgaacaagccccccttcaatagcatgggcgcatgcggcaacatcccca

SEQ ID NO: 47046 - DNA, 392 bp, Zea mays
  Clone ID: LIB3066-002-Q1-K1-H3
acgcgtaccgaacaagccgtgcacgcctcccctacgtcaccccaccacatccggccagccgaacgagaatgtcgcgcgccacagctgcggtcctcttctacatcctcgccgtcgctgacctcagcgcggccgacgcaccggcagagtcaccgaaggcaggcagtcctgccaaggcaccggccgagtcaccgagagcaggcagtcctgcagctcctgccaaggcacccgagtctgctgccacgagaactgccccggctaaggcacctcaggccgcctccacccccgccgctgccgctgccccatcgtcggcgtcgtctaggaagtctggtccagctgccgcgccgaccaccgccgcctgtacaccgtcttcttccacggacgaggagttgagc

SEQ ID NO: 47047 - DNA, 400 bp, Zea mays
  unsure at all n locations
  Clone ID: LIB3066-002-Q1-K1-H4
cccacgcgtccgcttccacttgcacaccacgccccgacaaagcgagcgagagcagccacggcaaaaccctcgcgggcgtctctctcgagatcggcgggcagcagcgacgcgcgcgcacaacacagcaggtgaaggcaagtgagtcagtggttggggtcctcgtcctggctatgagaggtttaagtcggtatctgccgttctgcggcggcgggtgctgctgcggtgacggcgccggcagggcagggggcgtggcggatgggctggtgtgggacgtggccctcaaggcgcacgcgtccggtgactactccatcgccgtggcgcaggcgaacgaggcgctcgaggaccaggcgcaggtggtcgcggctccggccgncacgctcgtcggcgtcttcgacgggca

SEQ ID NO: 47048 - DNA, 237 bp, Zea mays
  Clone ID: LIB3066-002-Q1-K1-H5
ctacgcggacgcatgagtcaatccggtcctttttgatgaaccatcgaccctgattgtactggggacggttgaataagaccgaaggattcatctcatgttcaccatgtttgtgaatcatttcatagacgatcccgtcttgatgaattactgtgaactgtaacatgttgcttatatcagtttcatctgtacttctaggcctgttcctgatcttggcgttcttcttgaaggattatactg

SEQ ID NO: 47049 - DNA, 427 bp, Zea mays
  Clone ID: LIB3066-002-Q1-K1-H6
gtctgatcggatatggtgccagtgctgtgtgtccttatctggcactagaaacatgccggcaatggaggctgagcaacaaaactcttaatttgatgcggaatgggaagatgcccacagtgaccatcgagcaggcacaaaggaactttatcaaagcagtaaaatcaggtctgctcaaaattctttcaaaaatgggtatctcactgctctcaagctattgtggagctcagatctttgaaatttatggtcttggtcaagaagttgttgatcttgccttctgtggaagtgtatcgaaaattggaggtctcacacttgatgagctgggtagggagaccttatcattctgggtgaaggcgttctctgaagatactgcaaagaggctagaaaactttggatttatccaatccagacctggaggtgaataccatgc

SEQ ID NO: 47050 - DNA, 190 bp, Zea mays
  Clone ID: LIB3066-002-Q1-K1-H7
aacaatccttgcacccctccccttcgtcaccccaccacatccggccagtccaacgaagatgtcgcgcgccacagctgcggtcctctcttaattcttggtcgtgcttgacttaagcgcggccgagcaacgggcagagtaaccgaaggcaggcagtcctgccaaggcaccggcgagtcaccgaaggcaggca

SEQ ID NO: 47051 - DNA, 141 bp, Zea mays
  Clone ID: LIB3066-002-Q1-K1-H8
cccacgcgtccgcttccacttgcacaccacgccccgacaaagcgagcgagagcagccacggcaaaaccctcgcgggcgtctctctcgagatcggcgggcagcagcgacgcgcgcgcacaacacagcaggtgaaggcaagtg

SEQ ID NO: 47052 - DNA, 417 bp, Zea mays
  Clone ID: LIB3066-002-Q1-K1-H9
gttggcaagagaggagggccggcgtcggcgtgcctagctcgatcttgaaccatagctagccagcatggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatcttcgtcgtcgtcgtcgtcggaggaggaggaggccggcgagaaggagaaggagaaggagcaggagatggagaaggcggtcgcggcggagaaggctgcccagcaggagctgctcaagtacgccaaggagaagggcatcgtgtcaccgaccaacggcacggtgtggtacaagggcatcgcccgggagttcgt

SEQ ID NO: 47053 - DNA, 395 bp, Zea mays
  Clone ID: LIB3066-002-Q1-K1-G2
cccacgcgtccgaacaaagaaaaggaaaaggagaccaaggaaaaatgtgactaaagggtggtttccaaaagatgtcgaagcttcgtcgcagctcgtcctgcaagagaacgaagtgcatccactagctacttaactacctgcaagagaacgaaggcgagggtgagggtggcaagggtgtcaaagagaagcgggaggtagcgtggcgtcgccatggaagcatcggaggcttgggattaggtcggaactcagtagcgaagaggacccataacaggtgtgtgagatataggagaatgtgattgtgtttggccttttgttttgtgaaatttgtacgcgatgaaggcaacatgaaactaaaattaggggatgaattttgggagagaatacagaccacatag

SEQ ID NO: 47054 - DNA, 141 bp, Zea mays
  Clone ID: LIB3066-003-Q1-K1-A1
caccgttctcgacactctttaatactcaatggtaccactttcaccgacatccttatcgccctcatcatgttcttcacactacacctactacctcttctgcatcttcctcatgactaacctcctttgccacatctactacac

SEQ ID NO: 47055 - DNA, 301 bp, Zea mays
  Clone ID: LIB3066-003-Q1-K1-A10
cccacgcgtccgcccacgcgtccgcggacgcgtgggcaaaggccttcctcccggggtagttgctttggctcttctgctccacgccataagatatctagcaattggtcactcgccttaattagttcgctttgcttttgaggttgattcgaccattttgctgtagcgtgaattgcatgcatggacatgcaacgctccaatggcctttggaatgtggaatttttttccccattttctgtatttttcctataaaaaatgaactgggtcttaaaaaaaaaaaaaaaaggcggcccgtctaaaagat

SEQ ID NO: 47056 - DNA, 423 bp, Zea mays
  unsure at all n locations
  Clone ID: LIB3066-019-Q1-K1-F5
cttcggcctccacctatcaccacccgggacgtcttccatggcctcctcgtagtagagtagggctatctcaccgcaacagctgctcattacatcctttatgagaggctgatcgattggtagatacgtactcgggtggagcagagcaacgagagacatggcgacgacgacgcgtgttgccgccgccgccaccggcgtgctgctggtcctgtcggcgttggcgaccctggcgcgggccgaggacccgtacctgttcttcgagtggaaggtgacgtacgggaccaagtccctgctgggcgtgccccagaaggtcatcctcatcaacggcgagttctccggtccaagatcaactgctccttcacgaacacatcgtcgtcaacgtcttcaccagctcgaccatncgctccttttacctggaacgggatg

SEQ ID NO: 47057 - DNA, 398 bp, Zea mays
  unsure at all n locations
  Clone ID: LIB3066-019-Q1-K1-F6
cacatcgtcactcactgcatcgttcgttcatccatcaactactggaaattagagagccggatctcttggtcggagaacctgcgaggaaggactaaggagtcgaagatgactgcggcggtgctgtccgtgcgcacgacgacgacgtcgctgctagcagcagtcatcctgtgcctctgcatcgtctccctctccccccgcggcgccgctgccgcgcgggtctcccccggcgccagcccgatcgtggccacctgcatgacgggcccgtacccggagctgtgcgtgggggagctgggacagcggctgctggacgtgcagacgtcgatcgcgtccgcggcgcccgaccagcgcgcggccaggatcgcgggcgccccggngcaggtggacgtcaagggcgctgt

SEQ ID NO: 47058 - DNA, 485 bp, Zea mays
  Clone ID: LIB3066-019-Q1-K1-F8
cccacgcgtccggtccatccagctccaggcgttccagaggccctgatacaggagatgttcgagcacaacccaggggtgtccagggagggcctcggcctgtacataagccagaagctggtgaaaacgatgagcggcacggtacagtaccttcgagaagccaacacctcgtcgttcatcatcctgatggagttcccagtcgcccagctcagcagcaagcggtccaagccttcgacgagtaaattctgaccctcatgctcctggaactgcagcgagtgttcggccgtgtcgaagtctcggttgtagctagccaagtggctgctactgaaacatcggttggtcggttctggtatctagcacggcctgtgtagtgcggatagaattggttgtttggctttggagagatataagctagctggctaggtgtaacgtaacgtcgaccgataactgtatgtgaatgatgatgagctgtgaggacgaataaaggc

SEQ ID NO: 47059 - DNA, 401 bp, Zea mays
  Clone ID: LIB3066-019-Q1-K1-F9
cggacgcgtgggcactaatccaagacaaaacatggctgtgaatgtgagaaccatgtggtcggcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacaggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaaatgcgataagccttgtgagtgctccggcaagcccgtggtggtgcaca

SEQ ID NO: 47060 - DNA, 350 bp, Zea mays
  unsure at all n locations
  Clone ID: LIB3066-019-Q1-K1-G1
ggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcaccagctgggaccgtgtcgtcgagggtgggcacgtagttggctgtgcggtaattgctcgtctggtcgggagggaccaataacgcaagtgttgctttgctttgctcacttcgtttgctcttgtaactntatggggtcaaccgttatataactgaaacgatttgattaattgatactaatgctctctatctgtcatgtat

SEQ ID NO: 47061 - DNA, 197 bp, Zea mays
  Clone ID: LIB3066-019-Q1-K1-G10
cggacgcgtgggcggacgcgtgggcggacgcgtgggctaaatagaaacaatactgatggcgcgaaacatgatcattgcggtggctctactccatgccacctttcttgcggtggctagatctgattgggttccaaaataaccatcaaattcagatgacatacgaggtgcttgcatcacggagtgcaccatatataata

SEQ ID NO: 47062 - DNA, 163 bp, Zea mays
  Clone ID: LIB3066-019-Q1-K1-G11
tcgtcacgtcccacagccgtccgctcactgcagccaccacgcacgcaagcgtcaacgaacagaccagcgtcgcgtaaaatagagtgaagagcgcgcagcatgaggatcatacagctcgagcatcttgggtgctacgccgctcggcgctagtcggcagggcact

SEQ ID NO: 47063 - DNA, 320 bp, Zea mays
  Clone ID: LIB3066-019-Q1-K1-G12
cccacgcgtccgaaaagtttcatcagtgtagcaatggacattgatcctgaatggaagatgatgaaacgtgacctcggtcgaattgagaaatgggttatccgtaatgcatttgatgatgaggagaggccctatttacctaagcacattctctacaggcaaaaggaacagttcagtgatggtgttgggtatagttggatcgatggattgaaggaccatgccagccaacatgtctccgattccatgatgatgaatgctggctttgtttacccagagaacacacccacaacaaaagaaaggtactactacagaatgatattcga

SEQ ID NO: 47064 - DNA, 334 bp, Zea mays
  Clone ID: LIB3066-019-Q1-K1-G2
cccacgcgtccgcgtcactcactgcatcgttcgttcatccatcaactactggaaattagagagccggatctcttggtctgataacctgcgaagaaggactaacgagtctaagatcactgctgctgtgctgaccgtgcgcacgacgacaacgtagctgctagcagcaggcatcctgtgcctgtgcatcgtctgcctctgcccccgcggcgccgatgccgcgcgggtctaccccggcgccagcccgatcgtggtcacctgcatgacggtgctgtacccagagctgtgcgtaacgcgagctggtacagcggctgctggacgtgcagacttctatcgc

SEQ ID NO: 47065 - DNA, 397 bp, Zea mays
  Clone ID: LIB3066-019-Q1-K1-G3
cccacgcgtccgcggacgcgtggggagacaagcggctgcagcgagcagcaagccccgccggaagacgagaacaaggagaaagagcggcagctggccaaggagaaggcgtacgcggcggagaaggtcgtccagcatgagatgctcaagtacgccaaggagaagggtctggtgtccccgaccaacggcacggggtggtacaggggcatcgctcgggagttcgtggacgcccacaacgagctccgcgcgcgctacggcgttgcctccatgaagtgggacaaccagctggcgcggcacgcgctgcactggtccaacgccatgcgcaaggactgccagatccttcacagcggtcactagtacggctagagcgtgttcaggagctactacgactggaacgcct

SEQ ID NO: 47066 - DNA, 245 bp, Zea mays
  Clone ID: LIB3066-019-Q1-K1-G5
ttcaccttcgaggccggcaagacgtaccgtctgcgcgtctgcaacaccggtatcaaggcggggctcaacttccgcatgcagggccactacatgaagctggtcgagctggagggctaccacaccctgcagaacacgtacgactcgctcgacgtccacgtcggccactgcctatacgcgctcgtcgacgcctaccagagacccggccactactacatggtggcctatacgcggttcatccacgacgc

SEQ ID NO: 47067 - DNA, 481 bp, Zea mays
  Clone ID: LIB3066-019-Q1-K1-G6
ctgccatcctctccatcacgaagatggcgttcatcagcaatggcccaatggaaggcgccggccttgcccggcctgttggggtcccaatggtgtcggcttgccggccccccggcgccggtgccggtgccggaggggcgcccgtcggttccggcgggtccgctggacatcgcgcagctgggcgccaagggcgacggcaagtcggacagcaccccgatgatcctcaaggcgtggaagaacgcgtgcgaggcgacgggggtacagaagatcgtcatcccgccgggcaactacctgacgggcgggctggagctgaagggcccctgcaagtcctccatcatcatccgtctcgacggcaacctgctcggcaccggcgacctcagcgcgtaccaaaggaactggatcgagatcgagaacgtcgagaacctgtccatcaacggccacggcaccatcgacgggcagggagccctggtgtggagcaagaacc

SEQ ID NO: 47068 - DNA, 291 bp, Zea mays
  Clone ID: LIB3066-019-Q1-K1-G7
ctcacacgttctccatcactaaaatctcatttatcagcaatatcttcatagaaagacgttgcgcgttatcacactacttgtgagggcacttataataactgtaccacccaactaatcattacctttgacaatagaaacactctcactttacaactttataatgaacatcacacagaatttatctacagcttacctttccttcttaagactattgaaaaagctatacacgttcattaacatttatcaggtgtcgcgaaccctgcacagttattataatgccactttacacgg

SEQ ID NO: 47069 - DNA, 412 bp, Zea mays
  unsure at all n locations
  Clone ID: LIB3066-019-Q1-K1-G8
aaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcantaatcataagtat

SEQ ID NO: 47070 - DNA, 330 bp, Zea mays
  unsure at all n locations
  Clone ID: LIB3066-019-Q1-K1-G9
cccacgcgtccgcggacgcgtgggcagccgaactagttcacagattgagtgttctttggaatgtcctgtagtctgttcgatatcactgtacgactcttgtatggaagcaacagacagtgatcataaacctgtcaaatgcgtgttcaatttagatattgctcatgtggacaaacaaacaatgaggcagaagtatggagaaataatgagttcaaataaggaagtgcttgactcacttcagggcttggaggctttgcctgaagtagatatcagcacgaatgacatcatgctgcaagatcaaaacccttntgttgtgaaactgcattacagaag

SEQ ID NO: 47071 - DNA, 395 bp, Zea mays
  Clone ID: LIB3066-019-Q1-K1-H1
cccacgcgtccgcccacgcgtccgtctagatctctctcgatcagattatcttgataatgaactttccagcttggcaaactggttggagggatcttatcagaagtctaccggcaaactagtcattcccttggagaatggaaacagtcttactttgcaacttgataaggaagcagacaaggaattcatgtccagcttggcttcccttcttaagactattgaaagggcgatccaggttcatgaagatttctcaggtgtcgtgaaccctgcagagttattagaatgccacttcacagggttgaaggctctggagaatgaatatggttctggtgaaactgttaagcagggaacagaaatagttcagagagctgtcaccaaatcattccagtccctacatg

SEQ ID NO: 47072 - DNA, 384 bp, Zea mays
  Clone ID: LIB3066-019-Q1-K1-F4
cccacgcgtccgatcccgagggacgtgtgggagaagatctacacctggctcgccaagcccggggccggggtcatgatcatggacccctacggcgccaggatcagctccatcccgcaggatgcgacgccgtttccgcaccggcagggcgtgctgttcaacatccagtacgtcagctactggttcggcgagggcgacggggcgccgccgacgcagtggagcagggacatgtacgcgttcatggagccgtacgtcagcaagaaccctaggcaggcgtacgccaactacagggacctcgaccttggcgtcaacgaggtggtcggcgacgtctccacctacgacagcggcagggtctggggcgagaagtactacaatggcaacttcgag

SEQ ID NO: 47073 - DNA, 232 bp, Zea mays
  Clone ID: LIB3066-019-Q1-K1-D7
gaggagggccggcgtcggcgtgcctagctcgatcttgaaccatagctagccagcatggctgccagcatcagcatagcagtactgctgctcctcgtcgtcgccgtcgtcctctccaacgtccccttctcgggcgccctggcctcctcgtcgtcgtctctgctgcaccagtcgtctccgtctgagagtgagactgagaccgacagtagcagcggagaatcttcgtcgtcgtcgt

SEQ ID NO: 47074 - DNA, 482 bp, Zea mays
  Clone ID: LIB3066-019-Q1-K1-D8
gtaaaggaagaccaaatttccccaaagaaatccgacgaggaaacggaatcagtgttggtggagctgagcgcccgtcagatcacacttttgctatcatccatttgggctcaagcaacatcccctgaaaatactcctgtgaactatgaagccattgctcatacttacagtttgcttctactgttctctggatccaaggcatcaacttttgaggctcttacccagagttttcaggttgcattttctttgaggagctatgcgctcactgaagcagattcattacaaccgtctcggcgtcggtcattgtttactctgtcgacagccatgattattttctcgtcaagagcttacaatgtgttgccactcattccaatctgtaaacaaatgatcaatgatcgcgcggccgatccattcctttcgttggtggatgagagcaaacttacagctgtcaaagattgttcaaatgatccttcaaaatatatgga

SEQ ID NO: 47075 - DNA, 457 bp, Zea mays
  Clone ID: LIB3066-019-Q1-K1-E1
cccacgcgtccgctcgatcatcgacatggacgcggacgtgatcaccattgagaactcgcgggccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcacctttttttgcccttttcgttccgaggaggcgtcgtcgatgccaaattgttccaataacagggctgtgcccggccgtctgttgtacttcggctgtgggtagggtaagaggtttcctt

SEQ ID NO: 47076 - DNA, 363 bp, Zea mays
  unsure at all n locations
  Clone ID: LIB3066-019-Q1-K1-E10
cccacgcgtccggaaactatcgccagcaaagggagagcgccgaggtgagagagataatgcggtggtggtgctcatggtcgaatgaatgggggtgtcgggctatgcgcggttgacgtcctcatcgaagcaaaccccttcaccgttggttgcctcgtgccgtggcctgngaagtcgatgactgctcatcatggtaggaggccccgaccgaccgtgcaatcgtgtgccgacgctgtggctgtgcgccaatgaaatcacgaccggagaggaaaagatcaacattaacaaggaaggatgtaacagtcaaagcgaatctcgagatgaatcaagacttagatttttcagatgaagtttttcctatctttc

SEQ ID NO: 47077 - DNA, 359 bp, Zea mays
  Clone ID: LIB3066-019-Q1-K1-E11
ataagatggcgtgtatagacaatgcaatgagagccttgttccttttagcgctcttctgtgtggtgcatggtgagaaggcaaagtcaaaggacaacgatgcaaaagcgtccgggcccggtgggtccttcgacatcaccaagttgggcgcctccggcaatggcaagacggatagcacgaaggctgtgcaagaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccactgacctaagccagtacaaggatcat

SEQ ID NO: 47078 - DNA, 144 bp, Zea mays
  Clone ID: LIB3066-019-Q1-K1-E12
ccggccaatatttttgccgtgaaatttgtgttctgcaactatggacgtctcctttgttgctgtataaggcatgatttgccatcattctgttgcttcggtgatgcttgcaatgcaatgagaatgtgttggaacgagatgtttttg

SEQ ID NO: 47079 - DNA, 339 bp, Zea mays
  Clone ID: LIB3066-019-Q1-K1-E2
cctttctcttagcaggaggtgaggaaaggggacggaagcacgcagaccgggtcggatccagcggcccgcggaacggatcgaggccaccggcatcctcggctcgcgtcgcgtcgcggcgccgagctcgaaatccccggatcggtgcagctgccccctgccgccgcccgataacgcggcgggagggtggtggcctgtcgatctcgcggcgggagctggttaactacctgccaatttgtggatttgtgtgcgtgcttgattttggtgcgtgtgtggtggtgttgagtcgccggcgtggggtgtcggagctagggtttgggcgttcaggatgacggcgccggt

SEQ ID NO: 47080 - DNA, 284 bp, Zea mays
  Clone ID: LIB3066-019-Q1-K1-E3
acgaacccaccttgttttgccccacccttcctttttttttgtatataatcagcttcagctgcctgcatggcataagccttgcctgttcagggtgattccatgtccctaaatactcaatcagctcttgttacaaaaaaaaaaaaaaaaaaaaaaaaaaataaaaaataaaaaaaaaaaaaaaaaaaaaaaaaaaaaaaataaatataataaaaaaaaaataaaaaaaataaaaaacaaaaaaatgaataataaaaaaaaacaaagttaaaaaaaaggggggcccc

SEQ ID NO: 47081 - DNA, 332 bp, Zea mays
  Clone ID: LIB3066-019-Q1-K1-E5
cggacgcgtgggcgatcgccaataatggagtttccgcaccaccaccaccaccacgggcatggccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttacta

SEQ ID NO: 47082 - DNA, 240 bp, Zea mays
  Clone ID: LIB3066-019-Q1-K1-E6
cccacgcgtccgcccacgcgtccgcccacgcgtccgttcacgcgtccgggaaaaatgggagaaagctatatccaacctctcaacatatgccacatgtgcacctggtccagtttcatacgtcaatgagaaagatgtggagactacgttgaccatatttggatcttttgagttcagcttagaagcaatgccagaaaattcaagaatttttttcatggctcttgcagctatctcttgggaaga

SEQ ID NO: 47083 - DNA, 317 bp, Zea mays
  Clone ID: LIB3066-019-Q1-K1-E8
cggacgcgtgggcggacgcgtggggcgaggtcgacgacgccgctacccttcttcggctccgttggcaacggtttgaggcacgactcggacagccagccctccgacgaagccttatggatcaccgatttcagaaggcacctcgcgttcggcacgtcgagcgccagatcgtctagagagtcgatcaaacggtcgaaccctttagtgatctggctctcgttgataacgccttccttcgacgccgaagaagggtagcgaggtcgacgactccgtggtgcggcagttcaaggataaggacgttttgatcataaaggagtact

SEQ ID NO: 47084 - DNA, 345 bp, Zea mays
  Clone ID: LIB3066-019-Q1-K1-F1
gccacgcgaccgatggatcctgcgtaagcatatgcggtctcagacagaatggtagatatagctatggctatgcaagctatcatggcaaaagggcatacatggaatacttttatgagacaaagattgattgagctgattgtcagataggtgtatctcactggagtgctgtgatagtacatggcggtgctaatgtatcatagtatgtcaaagaaaacctgttcaacaatcttgttagacatacaaagttcatcagagatactaaagtcgctatagatgatgcttatgaaagcaccaacagataattcatacaatctgactgtactgaaatcaatgctgttctactgc

SEQ ID NO: 47085 - DNA, 437 bp, Zea mays
  Clone ID: LIB3066-019-Q1-K1-F10
aaacagccgagcgatctcctctccctctccctctccgatccattctccagcgcagcgaagggaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaagcgagcctggtgccgtcatccgtggcaagaaaggatcaggaagcatcaccgtgaagagacagggcaggcactcgtcgtggcatctacgacgagccgatgacgcctgggcagttgcacatgggtgt

SEQ ID NO: 47086 - DNA, 194 bp, Zea mays
  Clone ID: LIB3066-019-Q1-K1-F11
cggacgcgtgggctctatatgcatatctctctgctctgccttgttggctggctcttctcatgattccctagcagatcgcgtagtattagttgcatgcattatattgatgatgcaggtatttcgtcgagcaacaaggcgtactatcaattgtttttgtaatacccaaaattagtgaataaagggaaactggttat

SEQ ID NO: 47087 - DNA, 396 bp, Zea mays
  Clone ID: LIB3066-019-Q1-K1-F12
ttcccgggctctgtaatcagcagtatagatgctacagttgagcgccttgcagcatcaaatgtgttctttatagccaagcggaaaaatgcaaacatggatgttctgtatctgtccgcgaagatgccccgcggaatcccctttcttatagaggttacagctgcggttggtgttcctggtgtgaaatgtgcagtcaaaactccaaatagagagatggttcctctcttctttgaagctatggaggctctcaccaagtgacgccaaagttaatggatatgtggttctacaaaaaattatcagtcgatgagctgctataggtgtttggatgcggcatttttttttcacggaaagcttgtgtgaatggtaatttttggattagattacagtatttaaactgat

SEQ ID NO: 47088 - DNA, 460 bp, Zea mays
  unsure at all n locations
  Clone ID: LIB3066-019-Q1-K1-F2
cccacgcgtccgaccgtcaccgcgcctcgccgccggggcgtcacaatggcctaccgccggaggcctgagccccatccgcagccccagcccacgccctcgttggagcaccactacccgtcgtccgtgggccccgcctcacccgactcccttgccgcgcaggccatgcgcgccttcgccgcacaccgcgatgcctnctccctcacctccgcctactccgcctcagcctcgctggcggcctctcgccggagccaccacgagccctccgtgtccacaccgtccctggatagttcaggctatgaatacacgtccatgaagaacctcaacgaggccaagtatggattctggggcacacttgcgcggaaggcaaagtcatttcttgacgaggactgctcccccgagcaatacaaatcgccaagagatgatgtgcatgtnggtgtccagcttccacattcaaaacaat

SEQ ID NO: 47089 - DNA, 372 bp, Zea mays
  unsure at all n locations
  Clone ID: LIB3066-019-Q1-K1-D6
acaggatggacctcctggagacgtccgccgctgtccgcaagagcttctcagatcggcactggacggcgcggatcgagaacctgaccctcaactgcctggattcttccgggagacccaacgtcgatacccgggaataccgggtgtttgtaggcacatggaatgtgggagggaagcctnctgacagcagcgttaacctcgaagagtttctgcagattgagggattgcccgatatatacgtcttggggtttcaggagatcgtgcctctgaacgcgggcaacgtgctggtcgtggaggacaacgaagccgcnggcaagtggatggagctcatctaccaggccctgaacaggccgccggcccaccaggacggggagt

SEQ ID NO: 47090 - DNA, 465 bp, Zea mays
  unsure at all n locations
  Clone ID: LIB3066-019-Q1-K1-F3
aaagcagcaagagcagctccttcagcaatataaattgggcagttcaccgcagcgacagcatgatggacagcatctctacatcaaagggccagctctgtttgagaatgatgacccgccaccggtcaagccgctgggaacaaggtgccagctctgcaagcttgatgttgctttccggacacaaggggatgctggccgtgatgccaatgctccaccagtcattgcagttttggcatgccaccatgtgttccacagcaggtgcattgaatctgtttacgggctcgctgagcctgctgagtgccttgcctgcctggagtccggtgcagcgcactgattgctaaccagatacaccaggtcaagagtctgaagtgctccatntctgtgggcctttagatggtgtaagtaggctaccattggagttcaatagggagcttgaattatgggacatgtcacatgtctgatatatat

SEQ ID NO: 47091 - DNA, 450 bp, Zea mays
  unsure at all n locations
  Clone ID: LIB3066-019-Q1-K1-C10
cggacgcgtgggctacattgcaaaacatggtaatttagtcaaaagattctagagcttctgaggttgtgcgatatatgttaggagataagacatgcacaaggtgctcatcaacccaccttcagaagctctagaatcttttgactacattgcaaaacatggtaatttcagttttacagagaggtttgccgtgaagtatgctggtgctgcggccatgtacatggtatctaagaaactaaagaagaaatacaacataactgacgagcgtgcttcattgtatgatgctgccaatacatggatcgacgcactgaacggaagagatttcctgggtggctccaagcctaacttggcagatcttgccgtcttcggtgttctgagacctatccggtacttgagagcangaaaagatatggttgagaacactgaaatcggcgattggtaccgacgcatgga

SEQ ID NO: 47092 - DNA, 257 bp, Zea mays
  Clone ID: LIB3066-019-Q1-K1-C11
actcctactcattcactacattgccaaacatgtttcttcattcatatgattctttacctcaaaagctcctgttataaatcacgtgagacttgacatgcacactagtactaatcaacccatcatctcaaaccatcgcatctttttactacatttcaaaactttcacacatctgttataccaacatcttatccccgaacaattcttctacatcatacatctccatctcatctaataaactaaaaaaaatatacaacata

SEQ ID NO: 47093 - DNA, 244 bp, Zea mays
  Clone ID: LIB3066-019-Q1-K1-C2
gctgtttttatcaaaaaaaaaaaataaaaaaataaaaaaaaaaaaaaaaaaataaaaaaaaagaaaaagaaaaaaaaataagaaaataaaaataaaaacaaaaaaaaataaaaaaaaaaaataaaaaaaaaaaaaaaaataaaaaataaaaaaaatacaaaaaaaaaaatataaaaaaaaaagggccaacttttaatagtttcaaaaattactatacgctaaaatgaacttcattttctttatt

SEQ ID NO: 47094 - DNA, 361 bp, Zea mays
  unsure at all n locations
  Clone ID: LIB3066-019-Q1-K1-C3
acgctccgccttcctcttccagtccccgcgcgcgagatcgccgccccgtgtgggccctagatcgcgatggcgctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccagganaggtttcagagtctcggcgttgcattctaccggggagcacattgttgtgtcctagtctatgatgttaattctatgaaatcatttgacaac

SEQ ID NO: 47095 - DNA, 448 bp, Zea mays
  Clone ID: LIB3066-019-Q1-K1-C4
cccacgcgtccgcccacgcgtccgcggacgcgtgggtgcgaggctgccatcgcaatgtacctgaacgtctcctgcatccccgaggcgcaggcgatcatcggctcgagcgtcgctatccctttcctcgtcaatggcctaggggaaggtggctcccggagcgacacgtgccgcctggacgcgctgctcaccctgtacaacctctccctgcacgcgcccaacatcccgtccctcatggcgtccggcatcatcgagggcctccggggagtgctgacgccgtcgtccccgtggacggacaaggccctcgcggtgctgctgaacctggcgatgacccggaggggcaaggaagagatcgcggccagcgcggccatggtgggcgccatcgtgctcatcctggacaacggtgagccccggggagaagagaaggccgtgtcgtgtctgtacgtgatct

SEQ ID NO: 47096 - DNA, 449 bp, Zea mays
  Clone ID: LIB3066-019-Q1-K1-C6
gaggaagctgttttccttgggagatcggaggacacgccagagtctgcagctaggaaattggcagagattgcttactctcgcggcagcgctgacaatatcacatgcatcgtggtccaatttcaccatgacaaaaccggatgagccgtatggctgccaatttcagttgtaccctgcttcagtctattattatcctgcaagctgggtggtggcctggtgggcttctcccagatttaccctgcttcatgctattattatcctgcaagccgggcggtggggtttctcagatctatcgctcatgtagcaactttcaagcactcgtccattgattcttttgttgtcttgtaggaaacatttgttccgacaggtgtagtagacacttttaaactgataattcaataaacgtatgtttacggttactggttagtggaaattggttttcattttgcctt

SEQ ID NO: 47097 - DNA, 440 bp, Zea mays
  unsure at all n locations
  Clone ID: LIB3066-019-Q1-K1-C7
atcagagcaagcttctcgaggtgattgatgctagtgagttgccagaaatttttggtggaagctgccgatgtgaaggtggttgcatgaaggctgacaaaggcccttggaaggaccccgaaatcatgaagatggttcaaagtggtgatgggaggtgtggatcactcggtacggcctctttcgaggctccggagaaaatgatttgtgaagacgacacgtatcctaagaaacaagctttgtttgatggggaaacacaattagctggagacgagcattctcagtcacagaaaatttcccgtggccggattgaacatcctcacgtgtcacctcttcacgaggaacttatccncacttcaattcatacccctggatcaccctattcttgtgatgtcccgatggttgaagaggccatagacgccatctgcaagagccacggaacacca

SEQ ID NO: 47098 - DNA, 226 bp, Zea mays
  Clone ID: LIB3066-019-Q1-K1-C8
accacgcgtccgtccacgcgtccgaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaataaaacaaaaagaacaaataaataaaaaatgcaaaaacttaaaaagataaatatgacaataaa

SEQ ID NO: 47099 - DNA, 317 bp, Zea mays
  Clone ID: LIB3066-019-Q1-K1-C9
gttgatcagtggttgagaagccaagaaggtgactgcaaggctataataaatttgtacaaggagcagttgcttcaagcactgcaggctgataatgagttgaggaggattgcacaggacatctcaattcaagggaggtataaaagccgtttcagtactatgaagaagctagtaaaagatggacggaagccagaagaagttaaagacattctaggtttgagggtaatcttggagcctcggtgtggtggcaattcatctgattggggccctagggcttgccacaggacacattgaaatattcaagctatgtggaaggaaat

SEQ ID NO: 47100 - DNA, 432 bp, Zea mays
  unsure at all n locations
  Clone ID: LIB3066-019-Q1-K1-D10
ccgggcaaagatgtcgtggcaggcgtacgtggacgagcacctgatgtgcgagatcgagggcggccagctcgcggcggcggccatcgtcggccacgacggtgccgcctgggcgcagagcacggcgttccccgagttcatgaccgangacatggtcaacatcatgaaggacttcgacgagccagggcacctcgcgccgacaggcctgttcctcggacctaccaagtacatggtcattcaaggcgagcctggtgccgtcatccgtggcaagaacggatcaggaggcatcaccgtgcagaagacagggcatgcactcgtcgttggcatctacgacgagccgattacgcctgggcagtgcaacatggtggtggaaaggctgggcgactacctgcttgaacagggcatgtaactactacgtaccaactggcatgcatg

SEQ ID NO: 47101 - DNA, 457 bp, Zea mays
  Clone ID: LIB3066-019-Q1-K1-D11
gtatgtatctgcactcactccatggagattaaaatgaagtcttactttcttatgtgctaatgagagcttggacatgttatatgtctctttccgtgcacaattactggtgatataaatctcaaaatgttatgaccaatttcaatatatttcagaaattaatattactaggtaactcatgtataatggttgctttttaagcaaatgccaaacaaatatagagaagggggattcaaacagatatgatcttgcactatttacaatcttgttaaccatcttgtctatttctcttaaaatgttactcagatgatgatttgtattcaatacattcaccaatggccgacaaagatgacaatgatgaggacgaggccaaacacctgctgccagctccatccaacgaccagctttctgtagatgtaccgccaaagctagcgaaagatcttctctgaaccactccatg

SEQ ID NO: 47102 - DNA, 453 bp, Zea mays
  Clone ID: LIB3066-019-Q1-K1-D12
gaggaggaagggttaaggatttacccggtgtgagatatcgcattattcgaggaaccctaggtgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaagttaatatggaaattctttcagaggttttcccttactttgtccgtgtcaacaaacaattcgaaatacctcgactttttcagaacaggtccgagtcaaatagcaatgattcgaaacacttctttttccattacactatttcggaaacctaaggactcgatcgtatggatatg

SEQ ID NO: 47103 - DNA, 421 bp, Zea mays
  unsure at all n locations
  Clone ID: LIB3066-019-Q1-K1-D2
actagccagagatctgaagtgtatgtggatacagatcaatgtgagctgcaattttgtgaacgtgtagagctggcaacaggaacagccgaacaggaccacgtcaatggaagtgggagcagccgccgccggcaagctgaatgcggagctgtttcagtggttggcgttcggccgcgtgatcccgttcatggagtttgccaagcgcctggcggcgaggtggccgcgccgtcaccttcctctccatgcagaggaacgtagccagactcccgcccgtcatggagggcctgcctgcccgagggcgccaagttcacggccgacgtgccgtcngagaagcactgttagcaacaatacaagaaagacgtcagaagctcaccagcactgaagatggagcactgaagatggaaaagctgaccaacaatactga

SEQ ID NO: 47104 - DNA, 394 bp, Zea mays
  unsure at all n locations
  Clone ID: LIB3066-019-Q1-K1-D3
aaagtatttcctgcaattcgaagtttccaagaatatggtgtagagtttacaaatggtaggggtgaatcatttgatgttgtgattcttgccacaggttataagagtaatgttccttattggttgaaggagaatgaatttttttcacagcaaagtggatttccaaacaaaccaaatgaatggaaaggaaaggatggactctatgctgctgggttctcaaggcgtggtctacttggtgtgtctatggatgccaccaaaattgcggaggatattgcgcagtcttataataatatatataagctacaaagatcataagaacaaatgatatttaactatttatcaataatttagctatcaccatttgagagttntgtaaatatatgtactagtctatttg

SEQ ID NO: 47105 - DNA, 477 bp, Zea mays
  Clone ID: LIB3066-019-Q1-K1-D4
gagtttatctagctgtctggttccctttgcccaatctctctcctccgtccctccgccggtgcgcccggttcgcccttcgggacgcgccgcccgaaaccctagctccaccgatctatctctctccagcccaggcagggggaggagatggcggcggcgccagcggcgggagggcagggaggcgggggtatggacgccgcgctcctcgacgacatcatacgccgtctgctcgaggtgcggaccgcgcgccccgggaagcatgtgcagctctccgagtcggagatccgccagctctgcaccgtctcccgcgagatcttcctcaaccaacccaaccttctcgagctcgaggcgcccatcaagatctgcggtgacatccatggtcaatacagggatcttctaaaggccttttgatatggaggctttccctctgagcccaatatccattctagggtgatatggtgatcgaggcaaacaaagttg

SEQ ID NO: 47106 - DNA, 378 bp, Zea mays
  Clone ID: LIB3066-019-Q1-K1-C1
atttggttgggcgacggggtccagtacaggcagcttgcacagcaaaggagctgcgtgaaagtttaggtttgaaaaatgtccgtatttgcatcaaggcagctgatctcgtgaccacacctgcggacgaggaggagatgaggaatagtagaatacaaagaagagtttatgaattgttgtcaaaaactgcgcatgggggcaacaattacaatggccaaaaggagcttcattttgtgtttttcaggaaacctatcaggttcatccctgcagaaaatggttccacggttggtgctgttcaacttgagaagacagtattaaaaggtgatgaagtaactgggaagcaggtcgctgctggaactggtgaggttgaagacctaaaat

SEQ ID NO: 47107 - DNA, 397 bp, Zea mays
  Clone ID: LIB3066-035-Q1-K1-A10
cttttgttttctgatgatgaatgcaacatctgtttccaccattttcctctttacagaatacgactgctccatgtatacggagaaactacatttcacggagtagtaaataaacagggattaattagcgccatgtgcatgcatgcatacggcgttaggctgaccgacatgatcataacagttaattaattaattaaggctaagacacgaagcgtggaggatcgatgcgtccccgccggcgcagtatgttttaagctgacttgcggtagatgtgctagggcctgccggcggaggcgtccttatgggtgtctatgacagtctcgaaagcgccgacgagcgccttgaccctgctgcactggcgcttctgcatcagctaggtgcgtgccgactagatcacgta

SEQ ID NO: 47108 - DNA, 254 bp, Zea mays
  Clone ID: LIB3066-035-Q1-K1-A12
ggttgcggcaaacgcgcggaaataatgtgcttgcgtgattgtttttctctctctttttttggttaataatgtaaaacaggcatacggcgatgttttaacatgtaaactgagatgttgttactctttctcaaagcgagtatgtagccccagtttccatcatggcactcttctcgttctgaagctttgggatagtctcgccgctctcagctgactggtgtcgtattcttgaaaccttttatccgtgtcttggtctc

SEQ ID NO: 47109 - DNA, 436 bp, Zea mays
  Clone ID: LIB3066-035-Q1-K1-A2
cccacgcgtccgggccactctatgtcagatccaggaagcacttaccgcaccagggatgagattgcaggtgtcaggcaggaacgggatccaattgaaagggttagaaagttgcttttgactcatgacctggcaaatgctgctgagctcaagaatatggagaaagatatcaggaaacaagtagatgacgctattgctaaagcaaaggaaagttctatgcctgatacttctgaactcttcacaaatgtttataagaagggcttcggcgtggagtcatttgggccagacaggaaagagatgagagcttctcttccgtacgttggcagcatgatgaggcagtcctcattacatggtatgatagccaggaaaaataattattgatgaacgcctcaggcattattggaatattctatcgggaaaatgaacctgtatagagatg

SEQ ID NO: 47110 - DNA, 432 bp, Zea mays
  Clone ID: LIB3066-035-Q1-K1-A3
cccacgcgtccggcctttgtgagctcgcgagtggagagaaaaaaaggagcagcgaagagcgaacgaccgagatgctggagaagctgtgggacgacgtggtggccgggcctcgcccggagacaggcctcgagaagctccgcaaggccaccaccgcccgcccgctcgtcgtcgtcgacaaaggtgcgttttgttgcagtcgatgccgtcgaccccgacgacgccggtgacgccttctacgacgacgacgccgcgcggcgccagcaacgtgtggcgcagcgtgttccacccggggagcaacctggccaccaagggcatgggcgccaacctcttcgaccgtccacagtccaactcctccaccgtctacgactggctctacagcgacgagaccaggagcaaccaccgttagatcggaacggacgaatcgggtggtag

SEQ ID NO: 47111 - DNA, 436 bp, Zea mays
  Clone ID: LIB3066-035-Q1-K1-A4
cccacgcgtccgcggacgcgtggggcatttcgagtaacacagttgagcacgacgatgggatccctcgctaataacatcatggtcgtgggcgccgtccttgcggcgcttgtcgtctgcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtcctcgggcaatcctgtcacggtgttcatcacagacatgaactacgagcctatcgctccct

SEQ ID NO: 47112 - DNA, 250 bp, Zea mays
  Clone ID: LIB3066-035-Q1-K1-A5
ggactacttcaagaggttgttcatctttttgaaggataaggatggctattggagggggtttgctgtcaacctggcctctggtggtgctgctggtgctttctctttattatttgtgtactacctatactacgcgagaacatggttatctaatgactcgatatgctgtcaagggaggaggtgaaactcattactatgtgcacggttatctatgccttatgacactgaagttttatagtatcgttggtctata

SEQ ID NO: 47113 - DNA, 355 bp, Zea mays
  Clone ID: LIB3066-035-Q1-K1-A6
attatataggatgattacgaaggtaacatgtttgggacagtaacatttgcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaataaaaaaaaaaatagaaaaaaaaaaaaaaaaaaaaaataaaataaaaaaaaaaaaaaaatatagtataaaaaaaaataataaaataataaaaaaaaaacattaaaaaaaattataattaaaaaaaagtgatttaaaaaaaaaggagaatgtataaataatatat

SEQ ID NO: 47114 - DNA, 433 bp, Zea mays
  Clone ID: LIB3066-035-Q1-K1-A7
cccacgcgtccggagaaggtactagatcgtggtgaaaaaatcgaacttcttgtggataaaacggaggatctccgagcacaggcacaagatttcaggcaacagggaacgaagatacgaagaaagatgtggtgggagaatatgaagatgaagctcatcgttttcggcatcgtggttgcactgatcctcctcattgtcttgacagtttgcaaggacttcgattgctgataagatgcaggaacatgaaaggaaagaacatgagaaaaaatgtagggggagtgtagtgccatgacaccgcgggaccaaaatccatcatttgtgtgatgttgttggcattggccacaatgttcttagctacgcctagaacgatgggctcaaattaagttataacagggctctctaatattttaaataattgtaatagtagcaaatatcg

SEQ ID NO: 47115 - DNA, 394 bp, Zea mays
  Clone ID: LIB3066-035-Q1-K1-A8
cccacgcgtccggaaaaggagctagatagttgtgaagaacgaattctgctcgtggatagaacgacgcttcttctatatcaggcacatgaagctaagaggcacatttcaatgattcatggacagatgggtaggcagaatagaaagatcaagctgagaggggcatgaatcttggctacagtgacgcaagaggtagcgatgacagtgtgcaacgactactagtgatgatgagactcaagaccatcatgaggaagagctctatgaaccatgtatggcacgaggagctaactgtgaccgtgacagataccatcataactctgaagatggaggtgttatacaaggacacgttcataactgacgatacgacgatggactcagatatcgacatgacaccgct

SEQ ID NO: 47116 - DNA, 411 bp, Zea mays
  Clone ID: LIB3066-035-Q1-K1-B1
cggacgcgtgggtttctagcaatgtggagtatctggcgtcaagggatgcaacaatcatgggaagcaggaatggccatgcccctatcttcctctggtacaccctcaacaggaagggctacagaggctttcagaaagaagtccaaaagtgcttgagaaacgcacactacctaaaagatcgcctcaaggaagcaggaatcggagcgatgcttaacgagctcagtagcacagtcgtgtttgaaaggccaaaggatgaagaatttgtccgaaggtggcagctggcttgtgaagggaatatagctcacgttgtggtgatgcccagtgtcaacattgacaagctagactatttcctgaatgagttagtggacaaacgggcgacttggtaccaggacgggataagccagccaccctgca

SEQ ID NO: 47117 - DNA, 403 bp, Zea mays
  Clone ID: LIB3066-035-Q1-K1-B10
cccacgcgtccgcggacgcgtgggtcctcatctactcccgctccagctgcagctcggctctgtcctcgcctcgcgtagggtttcgcttcccgtctggccgtcgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggagcagggtcctcctgcaagccacgaaagcgccttctcaagacgggcggcggcggaggcatgcccggcgatgacgggctggatgactttgggttggaggacgaggacgcagacccttcggctgaggcgagga

SEQ ID NO: 47118 - DNA, 345 bp, Zea mays
  Clone ID: LIB3066-035-Q1-K1-B11
cgggctcccacttccttcccagcagctacctgttcagccccaaggacaagagcgacgtcatggtgtcaaccacctgctggtgcatcatgctcgcctccctcctcgccatggcgtgcgcgttcggcccactccaggtgctcaagatgtacggcatcccatacctggcgttcgtgatgtggctagacctggagacgtacctgcaccaccatgggcaccatcagctatctctgccctggtaccacggtcaggaatggagctacctgcgcagcggccttaccacggcggacagggactacagctggatcaacaacgtccaccacgacatcaggacccacgtgattcatc

SEQ ID NO: 47119 - DNA, 437 bp, Zea mays
  Clone ID: LIB3066-035-Q1-K1-B12
cggacgcgtgggtgggcgactcatccgggatcacgatcaccaacaccgtcattggcgtcggggacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaagatgtcaccttcaagaacatcaccggcacctgctccaccccg

SEQ ID NO: 47120 - DNA, 433 bp, Zea mays
  Clone ID: LIB3066-035-Q1-K1-B2
cttatacttgatagcttggaagatctgtcagagtcagaattgtctactattagaaaacagctgattgaggaattttcagcagatgacatttgtctgggatctcattttactgaaacaccttcgaaatctgcagcacaaaatggaaaactgcaccacaaatctatggaggttattccattcggatttgtttttgaagatgatactctccttgaagcatctgacagctcagtagaacctcacttgcgacatctgccatgtaacagcgttcttgatgttgaccggcttcttaattcggttttggaaacatctcagcatgttggaaggatgtcagtttcaacagaccaggatttgcctttcaaggaggtagccaaccaatgtgaagcacttctgattgggaagcagcaaaagctatctgtctgcatgagtgttcgtg

SEQ ID NO: 47121 - DNA, 414 bp, Zea mays
  Clone ID: LIB3066-035-Q1-K1-B3
cccacgcgtccgcggacgcgtgggaccggaaggggggaagagagatggattcctccacgtcggcggcggcggcaggggaggcggccgtgccgtcggaggacgacgtctgctccgtctgccacgaccgcttccggatcccgtgccaggcgaactgctcccattggttctgtggagagtgcatcatccgcgtttggaattatggacctcctgtacaggcttgcaagtgtcccatttgtcgccgccttataaatctactggtgcctgctgcattatcagggcacgaggatggtccacaagctcaacgtattctaggagagattcagcactataactgtatatttggtggagcaccacgcagcctaactcagaggttgcaagacctacccttcttcatccgaagactgttcagagaac

SEQ ID NO: 47122 - DNA, 355 bp, Zea mays
  Clone ID: LIB3066-035-Q1-K1-B4
cggacgcgtgggttttttttttttgaattcaaaagcccccgtctggataaccggtatttgaagaacaaggcagacaacgagtttcaatctgacgatttgctcaattacacagctcgacgacaacatgtacgctcacagaatgttttcttggacaagattttatttgaagtctatcagcagcttaagatgtaaaagacgaactaccacagttccaggctacttcattcaactcaatggaagggtcagatcacctctccaatccaggaacagcagcacgagaagcaaggcagcagcgccgctactccgccttgacggtcttcttgggctcgtggagttcaggcgggcgggcatcctt

SEQ ID NO: 47123 - DNA, 411 bp, Zea mays
  Clone ID: LIB3066-035-Q1-K1-A1
cggacgcgtgcgttcctagcaatgtggattatatggcgtaaagggatgcaacaatcatgggaagcaggaatggccatgcccctatcttcctctggtacaccctcaacaggaagggctacagaggctctcagaaagaattccaaaagtgcttgagaaacgcacactacctaaaagatcgcctcaaggaagcaggaatcggagcgatgcttaacgagctcagtagcacaggcgcgtttgaaaggccaaaggatgaagaatttgtccgaaggtggcagctggcttgagaagggaatatagctcacgttgtggtgatgcccagtgtcaacattgacaagctagactatttcctgaatgagttagtggacaaactggcgacttggtaccacgacgggataagccagccaccctgca

SEQ ID NO: 47124 - DNA, 375 bp, Zea mays
  Clone ID: LIB3066-034-Q1-K1-G3
gacacatgtacagtcacacaccatgagcgggacctctcaaatctagaggagagcatgagcagctggccgactgctgcgtgatggcctcaccttttccagcacgtgcgacggccgcgccgtgcagtccggcatgaaggcgcagaggaacaccacggcggagaccttgtccgggaacgtctcggcggccagcgcgacgttcacgccgtcgaggctgtggccgacgagcacgacgcggtccccgttcggcagcgacgcgaggaggtccagcagcggcctggtgtagtcctggaacgtgggcacctcccgcagcgcccgcgggtcggcgcccgatgccgccaatgtcggcgcgtcgacgcgggaccccgtcgcgcggag

SEQ ID NO: 47125 - DNA, 411 bp, Zea mays
  unsure at all n locations
  Clone ID: LIB3066-034-Q1-K1-G4
gcacaaacagatcgatcgattacagcattggcggccaaggtgttcctcctcctccgactcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgncgnctacgagaaagccgcgggcgccgtcatcgcggcgacgccggacaacaaagctcgcgctatggcgttcgcg

SEQ ID NO: 47126 - DNA, 385 bp, Zea mays
  Clone ID: LIB3066-034-Q1-K1-G7
cggacgcgtgggcggacgcgtgggaggaaacggcagtgaagtcgccggcgccgccgcgacaggaggaaggagggagtagcagcggcaggggaggtccggcgatctcggctgctgtggcgcggtaagggaggaagcggagccgcgacaggatgcactcgtttgggcaccgcgccaacgcggtggcaacgtttgcggtcaccatactggccgcgatgtgcttcgccgtctccttctccgacaatgttaacaccctgacacccaccgcatccgtcaagatcttgaatataaactggttccagaaggaggccaacggcaatgacgaggtcagcatgaccgctgaacatttcgggtgacctttcatctcttttcacgtggaacacaaaac

SEQ ID NO: 47127 - DNA, 285 bp, Zea mays
  Clone ID: LIB3066-034-Q1-K1-G8
cggacgcgtgggctaacagccttttggataaaagcatcatcggaatgcagaggctgtcctgttgaaggttttcctgtgtctgcaattttaatctgtccttttgaataaaatgtttcctctaacaagtgaagggcactgtttttattgtctcgtgggccacagatgcctgctgaacaatttatgttcatttcttcttttcttaaaaagaagcatgcactaagaacatgaaggatgcatgccatggaaagtttttgaaagtcattgaaacgtatgagctcctcatgc

SEQ ID NO: 47128 - DNA, 263 bp, Zea mays
  Clone ID: LIB3066-034-Q1-K1-G9
cccacgcgtccggatggttcaaggcaagttcaggcacctgccggtggtggataacggcgaggtggtggccatgctggacatcgccaagtgcctctacgacgccatctcccggatggagagggcgtccgagaaggggaaggcggcgatcgccaacgtcgcggctggcgacgacaagtactccatcgtcgaagctctcaaggagcaaatgttcaggccctgcttgtctgccattattggcgaagactcaacagtcgtcatggtgt

SEQ ID NO: 47129 - DNA, 265 bp, Zea mays
  Clone ID: LIB3066-034-Q1-K1-H1
tcggactagttctagagcgcgcgggtccgcctggccgaggccgtgccgtcgtcgctcacgctcgcggggcgcggcggggccggggccggcgcgcgtttccgcgtgcagtgcgcgatcctgtcgttggccgcgcctgtggcgcccaccgagtcgaggccggcgcgccggatctcgccgtccgggccggacggcgcgctgcggcccaagccggctgtgctggtcgccgagaagctgaacgaggtctggcttgccgtgctgcagcagt

SEQ ID NO: 47130 - DNA, 424 bp, Zea mays
  Clone ID: LIB3066-034-Q1-K1-H10
cccacgcgtccgcccacgcgtccgcggacgcgtgggattgctggagctggtgagcttcatcttgagatttgcctgaaggatctgcaggaggacttcatgggtggtgctgaaattattgtttccccacccgtcgtctccttccgtgaaacggttcttgagaagtcctgccgtactgtcatgagcaagtctcccaacaagcacaaccgtctgtacatggaagcgcgccccttggaggagggtctcgctgaggccatcgatgacggccgtattggcccacgtgatgatccgaaggtgcgctcccagatcctctctcaggagtttgggtgggacaaggacctggccaagaagatttggtgttttggacctgagaccactggcccgaacatggttgtagatatgtgcaagggaatgcagtatctcaatg

SEQ ID NO: 47131 - DNA, 418 bp, Zea mays
  unsure at all n locations
  Clone ID: LIB3066-034-Q1-K1-H11
cccacgcgtccggtcctgtacaagtgcctcgacacctgctccgaggacatcgaggaggccgtggcgcacctcagcgccctctcccgcgacttctccgacgccaagttcctcgaggtcaagtcctggctctcctccacgctcggcggcacctccacctgcgacgacgcatgcaaagacgcgcccgtcagcgacatcaagaacgcctgcatcaccaagagcttcgagtttgagaagctgctgcgcgtcacgctcgacctcatcaccgatgcctcagggtccatgtcggccgaggtcgcactgcctccgtcggcggcatcgggcgccagcgggccggcaccggcgccgttcggaggttacggctcgtccgctggcgccccggcctacggcgcgccgtctnctgctggtgacccagcttatg

SEQ ID NO: 47132 - DNA, 437 bp, Zea mays
  Clone ID: LIB3066-034-Q1-K1-H12
cccacgcgtccggttcaagatgacggcggtgacattgaataccgaggattcgacccagaaacaggaacagttaagcttaaaatgcaaggtgcctgcagcggctgtccaagttcgtcagtcacattgaagtctgggatagaaaacatgcttatgcactatgtgcctgaggtgaaaggagtagaacaggagttcgatggtgatgaggaagctgaagtggctggatagatcgagagagtttttacaggttttgagggtcaacacagcctgatgttatagcaacttcgcacgtacggtattgccgatcctgatgtatgcaagaagcaggcttagatagcagaggcgtcaatagtctgaaataacatccgttgcactagtatccgaataaagtgacagtgaattgattttttattttcattaaatttctgtgtatatgtgag

SEQ ID NO: 47133 - DNA, 412 bp, Zea mays
  Clone ID: LIB3066-034-Q1-K1-H2
atcgaggagactacctacggccatggctaggagaaggcttctcgcgctcgcctcccggctctacgggaggcctcaggcgacgcagccgtggcggcgacccccgccccggtttctctcctcagctgcgtccggcaccctcgatcacctgaagtcgccgcctttcgcgcgtccggctgcccggaaccccgcctcctatccatgggatcgattcggaggagggcagaagaggaccatgttcatccagacacagtcgaccccgaacccgcagtcactcatgttctatcctggaaagccagttatggagattgggagctctgatttccctaatgctcggactgcgatgacatcccctttggctaagtcgctttttgctattgatggagtaaccagtgtattctttggatctgatttt

SEQ ID NO: 47134 - DNA, 373 bp, Zea mays
  unsure at all n locations
  Clone ID: LIB3066-034-Q1-K1-H4
cccacgcgtncgccgaggcctccacgtctctggaaccgttttacccgccattttcctgtcctgtcctctccctccatctaaggagaggagagatatgcagctcacgagctccaccaaatcctgacctcccaaagctgtggtcgcgatccaaacagaagggaaatgatcaggcgacaacccggcatggatcggttcctgcagctgctggccgccggcgtggccgtgctactgctagtggcaccgncggccatggctgacgacgacattgtagaagtcggcgtcaactggggttcgcagctctcgcacccgcttctccccggctccgtggtgaagatgctcaaggcgaaccgcatcgccaggggcaagatgttcg

SEQ ID NO: 47135 - DNA, 397 bp, Zea mays
  Clone ID: LIB3066-034-Q1-K1-H6
cccacgcgtccgcccacgcgtccgcggacgcgtgggcgacgagcagatcgcggagttgaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgaccaaccttggcgagaagctgaccgacgaggaggtcgacgagatgatc

SEQ ID NO: 47136 - DNA, 280 bp, Zea mays
  Clone ID: LIB3066-034-Q1-K1-H7
tcgaagagaccccagccagtctgatcgttcaagaaaaataccagcttaccaacaacagcgagcagcaagcccacccgttcgacgacatggcccgtctcggcgccggcgccgtgttggcgcttctagtggcggtcgcggcggtggccgcgttcctcgcggtgccggactcggcgaagtccggggagctgagcgcgatggggttgctggcggcgaaaggcggcagcggcgcgggcccgcagaagtgcttgggcgcggtgggcgagtgcgacgtggacgaagc

SEQ ID NO: 47137 - DNA, 393 bp, Zea mays
  Clone ID: LIB3066-034-Q1-K1-H8
agacaaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaac

SEQ ID NO: 47138 - DNA, 277 bp, Zea mays
  unsure at all n locations
  Clone ID: LIB3066-034-Q1-K1-H9
gcggtcgtctctacagtcttccggcacaccatctttagaaagcttggccttcacagctcggctccggaacatggtgacactaattgtctgcaatggcgataaagagtttcacctattgtactgaggaaaggattggactctctcattatcctggcagcattgatgatctggaagcatacgaacgaagtgatgctcaaaggagtttctcctaatctcactcttctnctggagtctgctaatgaacgaaagggacaaatggcatgttgcacgacccaac

SEQ ID NO: 47139 - DNA, 382 bp, Zea mays
  Clone ID: LIB3066-034-Q1-K1-G2
cggacgcgtgggcaggaggggcgcacttgactttcccctcctcctcctgcgaccacctgcctggcctcgctctaatgggcctcatcagagcctataaagtgccaggttgtggcgctgacggtgtcgattcactgccaaggatgcaagaagaaggtgaagaatgtgctccagaacatcagcgccgtgtaccgatgcgaaatcgatgcccggagcaacaaggtcgtggcgacggtctcgacggagctcgacccctacatgctggtcgccaagctgcgcaagtccggcaagcaagcggagctgtggccagagcagccggtgcaacagcatgagcagccggcaccaccaactgagaaccaaaggcaagatgaagcccaaaacaacc

SEQ ID NO: 47140 - DNA, 226 bp, Zea mays
  Clone ID: LIB3066-034-Q1-K1-E7
cccacgcgtccgcccacgcgtgctgcactgagtacggcgacttcttcctgtcgtggtagtcgcagatgctgctggagcacggcgaccgcatcctgtcgggcgccacgttcgagttcggtgcggcgcccgtggaggtctccgtgaaagtgggcggcattcactgggactacggcagtcggtcccacgcccgcgagcttaccgcgggctactacaacacgcggtgcca

SEQ ID NO: 47141 - DNA, 323 bp, Zea mays
  Clone ID: LIB3066-034-Q1-K1-E8
aggtcgcgagggcagacacaacatggctgcgaacgtgagaaccaagagggcgccgacgcgggcacatgttgcgtaagctgtgaccaccggcgtcgcgatgagctgtccacggcaccgtcactgagaagcgtctcgaaccacataacataacccgcacttcaggcaaggaccgcgtgcacgctgcagcactgtctcaagcatggcatacaggcgcctggtcagacgaccactgacaagaccattggtacaggggctgaagctagcaacactttattaacttggactcatgctggaacacacgtatcctgagcgagtgtctggga

SEQ ID NO: 47142 - DNA, 371 bp, Zea mays
  Clone ID: LIB3066-034-Q1-K1-E9
ctgacgcgtggccccgactccgggtccatcgctgcgtcacctactagcgagagcgccgggtcagagaaggcccccgacggtgcccccaacgactcgtcggccagcccttacgcgtacccgtacgaagatgaagccactgtatcgcacgatagcagcagcggccgtggcagtgcccgctaggaagagccctcgacggccgaggccggccgcgaatacgacgatagtccacccgagccagcccatgcttcggagtcaccagcagagtctcctggcccggacgctgaccacgagagccgacggccgagcatgggcaccggtggcggactggccatgctggccgacgatgtcaccgtgacgcttcctttctagat

SEQ ID NO: 47143 - DNA, 419 bp, Zea mays
  unsure at all n locations
  Clone ID: LIB3066-034-Q1-K1-F1
cccacgcgtncggataaggcgaacgatgtccacctagaaaccctagttcgaacgcgccgncgtcaccgtcgtcgctcgcgctctccgcccggatcggagcgagagtaggggcgtgtcggcggtgaaagcgactgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagagg

SEQ ID NO: 47144 - DNA, 384 bp, Zea mays
  Clone ID: LIB3066-034-Q1-K1-F10
cgagatttgaagtcatctaatctgctagtcgacaagaactggactgtgaaggtggcggactttggcctttcacgtctcaagcgcgaaactttcttgacaacaaaaacgggaaaaggaacaccgcaatggatggcgccagaggtgctgcgcaacgaaccttccgatgaaaagtctgatgtgtatagctacggggtgatcctgtgggaactcgttactcagaagataccctgggaaaacctgaactcaatgcaggtcattggcgcagtaggttttatgaaccaaaggttggatatcccaagcgaagtagatcctcagtggagatcaattatcctgaactgttgggaaagcgacccgcagcaacggccgtcgttccaagagcttctg

SEQ ID NO: 47145 - DNA, 313 bp, Zea mays
  Clone ID: LIB3066-034-Q1-K1-F11
cccacgcgtccgcaggatttggcgctgatcggagctctgctcttctttctgggcatgaagaactccatcccgaagcggcagggcggcaagaagaaggcccccaaggcgaagacgaactacggctgcttagatagctgcacgcctcaggtggggtgtatcaggagacaggtctatttcgaagcaggctcagcgcgatgcagcgaatgccatcgagctgcgcttttacatgtttatcatcagattccattttgcggcccgaacaaaggtgtgaccggggtgggttaggcgactagattgcacgattatgtacttg

SEQ ID NO: 47146 - DNA, 404 bp, Zea mays
  Clone ID: LIB3066-034-Q1-K1-F12
cccacgcgtccggccggagctcgacgaggacgaccgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcgagcagaaggaggaaggccgaagcaatgaggaccgagtaacactcatcaaagattatcgtggcaagattgagactgagctgaccaagatctgtgatggc

SEQ ID NO: 47147 - DNA, 351 bp, Zea mays
  Clone ID: LIB3066-034-Q1-K1-F3
cggacgcgtgggcgctggggcagacgccgacggaggaggagctgcagggcatggtggacgaggtggacgcggacggcagcggcgccatcgacttccaggagttcctcaccctgatggcgcgccagatgcgggaggccagcggcgccgacgaggaggagctgcgcgaggccttccgcgtcttcgaccaggaccagaacggcttcatctcccgcgacgagctccgccacgtgctccagaacctcggcgagcgcctctccgacgacgagctcgccgagatgcttcgcgagggcgacgccgacggcgatggccagatcaactacaccgagttcaccaaagtcatgctcgccaaac

SEQ ID NO: 47148 - DNA, 373 bp, Zea mays
  unsure at all n locations
  Clone ID: LIB3066-034-Q1-K1-F4
cccacgcgtccggtggcatcaacggggtggtcatgccggngcagtgggagttccagggcggaccgtccgtcggcatctcttcgggcgatcaggtgtgggttgctcgctacattcttgagaggatcaccgagatcgccggcgtggtggtgacgttcgacccgaagccgatcccgggcgactggaacggcgcgggcgcccacaccaactacagcaccgagtccatgaggaaggagggcgggtacgaggtgatcaaggcggccatcgagaagctgaagctgcggcacaaggagcacatcgcggcctacggcgagggcaacgagcgccggctcaccggcaggcacgagaccgncgacatcaacaacttcagctgggg

SEQ ID NO: 47149 - DNA, 422 bp, Zea mays
  Clone ID: LIB3066-034-Q1-K1-F5
aggagttcgagaagaactttgctgttaagttcccagcttgctcaatcgccgcgaagcaccatattgaccagagcacaacaattcttgacgtgcaaggagtggggatgaagcaattcagtaaagctgcaagggagctcattggcatgcttcagaagattgatggtgacaattatccagagaccctgtgccgcatgttcatcatcaatgcaggccagggattccggcttctatggggcaccgtcaagagctttcttgacccaaagaccactgcaaagattcatgttctgggtaacaagtatcagagcaagcttctcgaggtgattgatgctagtgagttgccagaaatttttggtggaacctgccgatgtgaaggtggttgcatgaaagctgacaaaggcccttggaaggaccccgaaatcatg

SEQ ID NO: 47150 - DNA, 409 bp, Zea mays
  Clone ID: LIB3066-034-Q1-K1-F6
ctcgtttgtcactttggttgtcaagcacttcgatgatacgaggatagtgaaccctgacttgaaagatcttcttcttcaatcaatatcagttctcgtacagtataaagaattcatgcttgttttcgagaacaatcgggaggctataaataaaatgcctagatcacttttatcagcttttgacaacagatcatggattcctgttacaaacatactttcccggttctgcaaaggctcaggatttgcttcctataagaatggtgaatccccatcatctgcaacttttcaggttctactgaaggagacatgtattcatgaacaagagctgttcttttcctttcttaatcgactgttcaatacactcagctggacaatgaccgagttctctatgtccatccgggagatgcaagat

SEQ ID NO: 47151 - DNA, 433 bp, Zea mays
  unsure at all n locations
  Clone ID: LIB3066-034-Q1-K1-F7
ggaccgggggtcgcagcagctgagctgggcngctgtgggcgtgcccatcgcgctcgcctcctcatccgctggatctcctccgcgactccttcgagggctacctgggcttctacccgagggagagccgctggaagggccgctacgagcggggccccgccgagggcagctcgccctggggcgtcgccttgctcgtcctcctcctcctcgtgctcgccagcttccactccaccatccacgacatgtgggggccgtgaacggccggatgtgggtcctgctcctgttcgattccacgcgcgcacgtatgcgattgtactgctggttgctgcttgatcgatcgatggatcgatgattccatgtacatatttgttagggggatgctgctgctaggctattagctgcaggctatagaatttgagggtgatatatacttact

SEQ ID NO: 47152 - DNA, 348 bp, Zea mays
  Clone ID: LIB3066-034-Q1-K1-F9
gtgccgccgccatggctgctctgggccgtggcctgcccctcctcctcctgctgctcctgctcgccgtatcgggggccgccaacgccgcggcggcgcccggcggcatgtccatcatcacctacaacgaggagcacggcgcgcgggggctggagcggacggagccggaggtgcgggccatgtacgacctctggctcgcggagcacggccgcgcctacaacgcgctgggcgagggcgagggcgagcgcgaccgccgcttcctcgtcttctgggacaacctccgcttcgtcgacgcgcacaacgagcgcgccggcgcccgcggcttccgcctcgggatgaaccagttcggcg

SEQ ID NO: 47153 - DNA, 293 bp, Zea mays
  Clone ID: LIB3066-034-Q1-K1-G10
ctcacgcgtccggatggtccatggcattttcaagcacctgcctgtggtggggaacggggaggcgttggccatgctcgacatcgccaagtgcctctacgacgacatgtccctgatggagagggcgtccgataaggcgaaggcggcgatcgccaacgtcgcggctggcgacgacaagtactacagcgtcgaagctctaaaggagcaaatgttcaggccctgcttgcctgacattatagcctaacactcggcacccaaaatggagtcactctgcgatttctaccatgcagctacca

SEQ ID NO: 47154 - DNA, 285 bp, Zea mays
  Clone ID: LIB3066-034-Q1-K1-G11
cccacgcgttcgaggatgaggatggcagttcttacgttttatgagatgagatggtgctgtcaacttacgtaaaggcaatacgatgcatagaatagtgcccaagttgtgttatgtatttcgttcattccttgatcttgcatcaaagattcaaggctaagtcagcctgctgcaaaggttttggttgaatccttgtatactgccagataaagtgttacgatggtgcaatcttggattagcctttggcctacgaatacatcacgaacgggcaggcgatgctgaagatcc

SEQ ID NO: 47155 - DNA, 268 bp, Zea mays
  Clone ID: LIB3066-034-Q1-K1-E6
caaggaaatcaccgccctggctcctagtagcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacaggaaatgcttctaattctttgggcccaagagatgcaaagccgagaggagccattatcgccagtctgccgccccgtttctttctccttttggtgct

SEQ ID NO: 47156 - DNA, 433 bp, Zea mays
  Clone ID: LIB3066-026-Q1-K1-H9
cccacgcgtccgctctctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgcccttggaagtggagctgccatcgccggcg

SEQ ID NO: 47157 - DNA, 194 bp, Zea mays
  Clone ID: LIB3066-027-Q1-K1-A1
tcggcgaggtgtcccggggtcactgctgatcaactccaagtttttccacatgaccttgtaccgtggcaaggccttgctgatcaaggacgtaaccgtaactgctcccgggtcaagccccaacacggatggcatccacatgggcgactcatccgtgatcacgatcaccatcaccgtcattgacgtctgtgactact

SEQ ID NO: 47158 - DNA, 303 bp, Zea mays
  Clone ID: LIB3066-027-Q1-K1-A11
tcctcctctctctactcttcaagttctcttctccgtctaccgctctacacgtatgttgtggacctggacaccgaggtggaagaaggaagcagtcagcagatggatccatggatcatccaccaaccttctctgagccttgacctgcgcgtcagcctgtcgacaatcagcctgcaccaccaggcgcctgttgccgtcgccttgcccagtcccaagctgctcgtcgaggagaacttcctactgccgcctccaaagaaagaaccagaggtcgcggctctcgagacggagctgcaacggatggtccag

SEQ ID NO: 47159 - DNA, 492 bp, Zea mays
  unsure at all n locations
  Clone ID: LIB3066-027-Q1-K1-A4
gaatcacctgtcaatattagaagtgaacctctcacgacacgtcgccgcgcccttcaatcatggatggatggcagcagcatcagtactgtcgagttccctgatgggctacctccagctccttcgagaagcaagaaggacaagctttctgaagaggaaatgcttgcgaagaaggccgaagctgctcagaggcgcatgatgcaagtggaaaaggccactaaagaaagtgaggcggaagctataaggaaaatattgggcatcgactctgagaagaagaaagaagagaggaagcagaaggagcgaggagagaaggagcgagctagcagagcacaaaacatggcggcaaactcgatccgctgggtcatggggcccaccggaacagttatttcgtttccacacgcagtagtgcctcccagcatcttcgactccaagccacacagctatcctnctncacgggagaaatgcgctgggccatcgtgcacgaacgattacaag

SEQ ID NO: 47160 - DNA, 87 bp, Zea mays
  Clone ID: LIB3066-027-Q1-K1-A5
acgcgtccgcccacgcgttcgcgccaagtgtgcggtgaaattgtaattatttgcaatgaatagaatgttatatctatacctaataat

SEQ ID NO: 47161 - DNA, 366 bp, Zea mays
  unsure at all n locations
  Clone ID: LIB3066-027-Q1-K1-A7
cggacgcgtgggtcaaaagttgagggagaagaacatcgattttgctgctcacagcaaccaggaggactctggttctcttctgttcaaccttattggaaatttggcattcccgcttatccttatcggtggtctgtttttactttcaagaagggcacagggtggcctcggtggacccaatggtcctggctttccccttggttttggtcaatctagggccaagtttcagatggaacccaacactggtgttacatttgatgatgttgctggtgtcgatgaagcgaagcangacttcatggaagtggttgagttcttgaagaaacccgaaaggttcactgctgttggtgctcgcattcctaagggtgtcct

SEQ ID NO: 47162 - DNA, 94 bp, Zea mays
  Clone ID: LIB3066-027-Q1-K1-A9
actaggcgcaccggtgctgggaggacatgttttacgccatcagcggcgctaagcacgtcatgtgcatcacaggttggtcggtgtgcaccgagat

SEQ ID NO: 47163 - DNA, 245 bp, Zea mays
  Clone ID: LIB3066-027-Q1-K1-B1
tcggacgagactggagtggcctgaagacggaggtctactatgaatgcatactgatcctgtgtcgggggcggttcgagttgttcacggcggtctaacttggtagatgcgtcagagacatggtgacaacggctagtatatctgtcggtctgaaagcgtggcgtaagacacgcatgccagtgttgttggctcgatactgtggaccacatggggctcaggcatccgttggcaaagttggcagagtgcga

SEQ ID NO: 47164 - DNA, 391 bp, Zea mays
  Clone ID: LIB3066-027-Q1-K1-B10
tccacgcgtccggtccactgctacattctcatccgtcgccaatcccttcccgtgctcctatcgggctgaatgagaagaagagatggccggcagggccaatggccgggctatctgcatcgatctgggcacgacgtactcttgcgtcggcgtgtggcagcacgaccgggtccagatcattgtcaacgaccagggtaaccgtaccacgccctagtacgtcgccttcaccgactccgagcgcctcatcggagatgcggccaagaaccaggtcgccatgaaccccatcaacaccgtctttgatgccaagcgtctcatcggcaggaggttcagtgatgcgtctgtacagagtgatatcaagcttgggcccttcaggtcatttctgggcctggtgaga

SEQ ID NO: 47165 - DNA, 299 bp, Zea mays
  Clone ID: LIB3066-027-Q1-K1-B11
caacgaaacaagcgcacaagaaaaaatacctcgccgccaacaatggcctgcatgtcctccatcctgctcgcaacggcgatgctggctgcgctgtttgcggttggtttgtgcaccaccccgctcaccttgcacgttggcaagggatccaagcctggccacctgatcctgacccgcaatgttgcaaccatatccgatgtggaaatcacagagcacggtggcgatgacttctgctttacgctcaaggagggaccgaccggcacctggacgctcgacaccaaggcctcgctcaagtaccccct

SEQ ID NO: 47166 - DNA, 437 bp, Zea mays
  Clone ID: LIB3066-027-Q1-K1-B12
cggacgcgtgggccacgagaccacaagccacaccaaacccgcgttcatcgacggacgagctcgccggcgagagagcgactgagatggaggcggcggcagcggcggccggcgtggagctgggctcttcgaagccccagatcgcgacgcaggcggagatggcggaggcccgggtgccgctcgcctaccgcgaccagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggagaccaaggtcaagggcggcgccttcattggcctcatcccggccaccgtcaagctcgcctgatacgggtcccagcccgatccgcttgat

SEQ ID NO: 47167 - DNA, 245 bp, Zea mays
  Clone ID: LIB3066-027-Q1-K1-B2
ataagaagccccaaagaggagcaaaatcatcctccgattatgttgattggatgtgatctgatcccgagacacaaagaggatgccagattcagccgaaggcagttcggtagatttatgctggtttgcctattctccttgtccttggtcagttgcccgatagtttataaaatggaatacgtttacgtggacagactgctttgtttgtggtatacggttatgatttctataatatttctttctgccag

SEQ ID NO: 47168 - DNA, 411 bp, Zea mays
  Clone ID: LIB3066-027-Q1-K1-B3
gcgcgctccccgtccttcggtaggtgcattgcttcggtggtccaccatggcgcagcgagcggtggccacgatgacgactaataagccccttctcctcctcgccctggcgtccgcgctccttggtgcggcgccggccgtcgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatccccgtgagcaacaccaagcgcgtgatcctggacctcaagcccggcgctcagttccgcgagaagct

SEQ ID NO: 47169 - DNA, 469 bp, Zea mays
  Clone ID: LIB3066-027-Q1-K1-B4
cccacgcgtccgtgaaacatcaattcctaggaagcatggccctgcaattgctggctacgagacggccctcaagaagttctttgagtatgttttgcaagcatttctgaaacacattgattttgaagttgtccagtgtactgtaattgcaagcccaggttttacgaaggaccagttccgcgattatttgtttcttgaagctgcacggcgagatttaagagtaataattgagaacaagcaacgccttgttctggcgcatgcaacatcaggttacaagcatagtttaaaggaagttttggatacaccaggtgtgatggcactgataaaagatacaaaagcagcacatgaggtccgagctctgcaggatttcttcaatatgcttactaatgagtcagctcgtgcttgttatggaccgaagcatgttgagtttgcactgcaacagtttgctatccagactcttttaataactgat

SEQ ID NO: 47170 - DNA, 449 bp, Zea mays
  unsure at all n locations
  Clone ID: LIB3066-027-Q1-K1-B6
ccactcgtccgtcgactcttggtcggacgcgtgggcaactagaagatggacaggaatgggtactggaagtggaatgctagcgacatgtactttgttgatgctactggtgcttgctattacgaccaacgtgtactccctgcattatgatatgacatggtcatcaaatgatgcctaagctgccaaatgaagaagcgatctacaattcaatagaagcggggatttataacgaacgacactcagatcagatggcattgctaccctataaagcgcatcgaacatatctggaactacaattattgcacaatcgnggactgaatgtaagactgtacgatcctatcagagcaccacgctctcactgagagtcctacatagacaactgctttgcgagttatgatctggaacgactcatcactaaccaagctcgtctcgaatgtcagccaatcgatact

SEQ ID NO: 47171 - DNA, 367 bp, Zea mays
  Clone ID: LIB3066-027-Q1-K1-B7
gtagtgccgacagaggcacgagcgcctccctcgtcttcgttccgtctctccccacagggaaccgccgcccgtcgcctccagatacgtgcctccggcggaaaatcggtatcgagctcgctttgttcgaatcttctgtatagccagcaaggaggcctctccatctcctccgggaagctattgtgcaggctgtgcagcaatggagaagtataacagcaagactcagttagcacccttgagagataccccatttgctctccgtggtgctcttggtagttcaagctcataccttgagcaagccaggggctacacgtcttcccctctagcagctctgcgaccaaagatgtcttctactactggaaatcgactc

SEQ ID NO: 47172 - DNA, 382 bp, Zea mays
  Clone ID: LIB3066-026-Q1-K1-H8
tccacgcgtgcgcccacgcgtcgaccactttgcgcccacgcgtacgcccacgcgtgcgcgggccgagaaggacttgcagccttggattgctagagatgacgaacaaggtcagaagatgtggagagtcaaccagcgtatagtgaagcttatagctgagcttatgaggaaccatgacagccctgaagcgttggtgatactcgctagtgcctccgaccttctacttcgtgctaccgatggaatgctcgtcgatggtgaagcttgtactttgccacagcttgaacttctggaagtgaccgattcggctggtcatcttatcatcgaatgtggagaattacggttatcacttgcagatgggctttcaaatctggttaaaggcatgccc

SEQ ID NO: 47173 - DNA, 445 bp, Zea mays
  Clone ID: LIB3066-026-Q1-K1-G4
cccacgcgtccgagacagttcaacaagaaggacctcatcaagcccaggaacgggtcctacgtcaccaggctcacgcgctacgccggctccctcgcctgcacgcccggcaagccctgctagatcaagccaccagcgaggacggccgacgaccagaggcagacctgcatgcattcgccggctcgccatgtaagaaacaggggagttgaaagtgcgacacaccagagaacgtgtctgtgtatactgtgtaaaggtcctaaaggaaagagaagatgcacatattcaaagcctcggaactaattgctctgttgtccactatgttatccaagtatatatttgttcttcacttgtgttgagcaccgtttgtgtcactggacatggacaaacagtttagcctgcggacagtccgtctttagacacagactgtccacgattagatcataccata

SEQ ID NO: 47174 - DNA, 446 bp, Zea mays
  Clone ID: LIB3066-026-Q1-K1-G5
gcaaagggcaccacatttgaggatgtcatctccatggtaaagggggtgatacctgatctgtgctgccctgtagcgcttttcacatattacaacccgatcctgaagcgtggtgtccccaacttcatgagtattgttaaagaagctggggtacacggtcttgtggtaccagatgttcctttggaagagacagatgtcttgaggagtgaggctgccaaaaacaacctagagctggtgctattgacaacaccgactacaccaaatgaaagaatggagaaaattgcacaggcttcagaaggatttatttatcttgtaagcactgttggagttactggtacacgtgcaaatgtaagcggcaaggtgcaatctcttcttcaggatatcaagaaggtgacagaaaaacccgtggctgttggctttggtgtgtcgactccagagcatgtccggca

SEQ ID NO: 47175 - DNA, 351 bp, Zea mays
  unsure at all n locations
  Clone ID: LIB3066-026-Q1-K1-G6
accacgcgtccgatgctttgtctnctgtctcgggcttctccgcgtgtctacggcctttctgtacgccgccctatacactcatcgacatagccatcgagagggccgtcaacagaaaccagagcggcaaacaccatggcgagctcgaggaccatcgtggcgctcctcgtgctcctactcgtgcttctcctggtgactttcgcggccaccgtcgacgcccacgttgttcgcgagctgctatgccaggaccaattccagcagacatgctaccaggtgcacttcaagaagatgtgccagatcttgacgaggctaacgagggtgacaacgccgctcgaactgatgctagcgtcgatg

SEQ ID NO: 47176 - DNA, 434 bp, Zea mays
  unsure at all n locations
  Clone ID: LIB3066-026-Q1-K1-G7
cggacgcgtgggcgcttccgctccacaggatcctctgcgccacccacaaccgtgtgaccgtgcgtgctgccggcgacccctatccgccgacccgtccgtcccaccacaccccaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctncatcgagcagaaggaggagggccgcgggaacgaggcgcacgccgnctncatccgcgcctaccggttcagatcgagaccgagc

SEQ ID NO: 47177 - DNA, 383 bp, Zea mays
  unsure at all n locations
  Clone ID: LIB3066-026-Q1-K1-G8
cccacgcgtccgctcaatagcgccatgagacaatactgagagcagggngaaatcgagtgattcctggtaagaaagagaaacccgttgtccccattgacggtcgctgctccactgtgttccttccatttctcgccggaattagagcttaaccgtggaacaacatgccgccgtttgggcgaggcctctgcgcactccaagctctactccggggatgacagcctcgtcatgctcgtcatcgacacaaaccacttcttctgggctgccacggcgctccccttcaccgactccttcgcgcgctcgaactcccttctgctgttggaccacgtcaaccgtgtggttatctcgtggcgggagtcaactccggtggtgtggccatcttggac

SEQ ID NO: 47178 - DNA, 396 bp, Zea mays
  Clone ID: LIB3066-026-Q1-K1-G9
cccacgcgtccgaaagggcatcaccagatgcggcggtcagcggcgttcccaccgcgtcgcccggggccagggcgtcgccctcctcagcgttgtgacagcgacctcaacatccggcagcaccgcacctgcagcgaggtggccggcggcaccgcggcgggctgtgcggccgtgtgctgctgcttcccctgtgtcatggtggaggtcgtggtgctcgccacggtgcgcgcgcccgcggcgctgtgccgcaaggcggcccgcgtgagcaagggcgggcggcggcgctccgcctccgtggggcaggccacggagatctacgagctcccggtggacaacgccggcgtcgtcgtcaaggtggacgccagcgccgtcgaggcggtggcgctggcggtgaagccc

SEQ ID NO: 47179 - DNA, 402 bp, Zea mays
  Clone ID: LIB3066-026-Q1-K1-H1
gatgcaccttgatgcccaacattggttatggttctgacaagtcgaccaggcactacctccccaacaagttcaagaagtttgtggtccacaacgtttctgagctggagttgctcatgatgcacaacaggacctactgcgctgaaattgctcacaacgtgtccactaagaagcgcaaggagatcgtggagcgtgctgcgcagctcgacattgtggtcacgaacaagcttgctaggctccgcagccaggaggacgagtagtctggtttcttgtcttaacgacgaactggatgttgccattcctttctgtaggaaactactttgcttgtgtcttgttagtactgaaaaccagagtcactcctacctttttgcaatcagtagctactaaaatgtggcagattccact

SEQ ID NO: 47180 - DNA, 444 bp, Zea mays
  unsure at all n locations
  Clone ID: LIB3066-026-Q1-K1-H10
gtctgatcctggtgtgttcactgagctgattcagcaaatgcaagtgaaaggtgtacaggtggaagagctttactctctcgatgtgggctctcttagtcaactgcggccagtatatgggctaatttttctcttcaagtggatacccggggagaaggatgaacggcctgttgtcagagatcctaacccaaaccttttctttgcgcaccaagtcatcactaatgcatgtgctactcaagctattctctcagttctcatgaatcgccctgaaattgacattggcccagaattatctcaattgaaggaattcacaggagcttttacacctgatctgaagggcttggctattagcaacagcgaatctatccggacatctcataacagctttgcaaggccagagccatttatttctgatgagcanagggccgcgactaaggatgatgatgt

SEQ ID NO: 47181 - DNA, 305 bp, Zea mays
  Clone ID: LIB3066-026-Q1-K1-H11
accacgcgtacgccttctcatggatttgccttagaactctgacctagacctcgcctgtcacggggcgatctcatcagggatcgctctagtcctgacggcgattgtgctcttcctgtggttgacggctccagtgctgacaaggtacatctgttacgctgctaatcgtaatccgctacctatggcactgtgccatcatgccagccccaggctaagtgctgtgctgagagatcatcttcgtgcagctactcatctcccttacactatctagcgcagcacgctagaatctactacagtacgtcatcgct

SEQ ID NO: 47182 - DNA, 448 bp, Zea mays
  Clone ID: LIB3066-026-Q1-K1-H12
gtcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgttt

SEQ ID NO: 47183 - DNA, 506 bp, Zea mays
  Clone ID: LIB3066-026-Q1-K1-H2
cccacgccgtccgcggacgccgtgggcggacgtgtgggttcagagtcaacacagtctgagcacggacgactgggagtccctcgactaataagcatcataggatcgtgggcgcacgttccttgcggctgcttgtcgtacagcgggtcgctgcgggcgccccgaaggtgccagaccggcgcccaactatcaccaccaactacaactggcaaagtcggctcatccgcacagggccactctggtaccggtcaggcccaactggttgccggctgctcactgacgaacggccggtgtcgtgccgggatcaatgagacgtgacacctgccacgcctacagtcggcatgacgtgcgtgcggcaaccgtccccatcttcaaggacggcaagggctgtggctcatgctacgaggtgagatgcaaggaaaaacctgagtgctcgggcaatcctgtcacggtgttcatcacagacatgaactacgagcctatcggtgcctaccacttcgacttgagcg

SEQ ID NO: 47184 - DNA, 104 bp, Zea mays
  Clone ID: LIB3066-026-Q1-K1-H3
ctcacagtgccaactgaagcttggcctgtgggcttactagctaggcctttaaagtctacacttgagtccttgcattaatccactcgggttacgccaatggaagc

SEQ ID NO: 47185 - DNA, 462 bp, Zea mays
  unsure at all n locations
  Clone ID: LIB3066-026-Q1-K1-H4
cccacgcgtccgcccacgcgtccgcccacgcgtccgcccacgcgtccgcccacgcgtccgcaggccgagaaggacttgcagccttggattgctagagatgacgaacaaggtcagaagatgtggagagtcaaccagcgtatagtgaagcttatagctgagcttatgaggaaccatgacagccctgaagcgttggtgatactcgctagtgcctccgaccttctacttcgtgctaccgatggaatgctcgtcgatggtgaagcttgtactttgccacagcttgagcttctggaagtgaccgctcgggctgtccatcttatcatcgaatggggagattcaggtttatcagttgcagatggtctttcaaatctgctgaaggcatgccccgtcttcatctgccttcgttctcactcattcaaacgccacccatgcatncttcgtaactcaacaggttaactgaatatt

SEQ ID NO: 47186 - DNA, 408 bp, Zea mays
  Clone ID: LIB3066-026-Q1-K1-H5
gagcagcatttcgagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatcctgtcacggtgttcatcacagacatgaactacgagccta

SEQ ID NO: 47187 - DNA, 279 bp, Zea mays
  Clone ID: LIB3066-026-Q1-K1-H6
cccacgcgtgcgccaacgcatacacccacgtactggcccactcgctgatagcactctgtcacgcacgtggcactctagcagcacttgatagcggcgcaacacgagctccgggcagtgtacgtcgccgccaccagagcgcgcgccgatccggagggcgaggtgtgatcgctggccgaacaggctgcgcatattgaagctgaggcgcggctcatgaccgctgcgctcgctgcgatctgccaagtgcacacctaccaccatgtactcgcctgagggcgcacc

SEQ ID NO: 47188 - DNA, 351 bp, Zea mays
  Clone ID: LIB3066-026-Q1-K1-H7
gctgcggagaaggagactgccgccgtcgccgcaacctcgaaggaggaggaggaggtggagtcgcccaagaaaggagcggctctgtcgccggtgccggaggctatcgtcatcgccaccgacgcaacctcgaaggaggaggaggaggaggaggtggtggagtcgcccaagaaagaagcggctctgtcgccggcgccggagcctatcgtcatcgccgccgcaacctcgaaggaggaggaggtggtggaatcgcccaagaaagaagcggctctgtcgtcgccgacggcgccggaggccatcgttgccgtaacagcagtggaagacgtggtggcggacaagttcgtgacggttgtg

SEQ ID NO: 47189 - DNA, 392 bp, Zea mays
  Clone ID: LIB3066-026-Q1-K1-G3
gccacgcgtccgcccacgcgtccgcccacgcgttcgctccagcgagttgtatccattgcacccctcgccgcgccccggcaccgagccggacggcggacgccctggacctcatgtgcttctcctgctcacgtaattggagcaacggccattatctgcttcgtcgcgcacgcatgttctcatattccacgcgcccccgccggtcgtaaccaccgggcaaccaccggccggctcactcagtacgccgccgcccaccaccagctcagcttcagccgtgcgacgcttgtaccccgccccgctttcagccgagcccctttccccttatatcaaccaaccccaccactctctactctctgtacccaatcgccactacgcgactgctagctactcgatcg

SEQ ID NO: 47190 - DNA, 381 bp, Zea mays
  Clone ID: LIB3066-026-Q1-K1-E9
cccacgcgtccgcccacgcgtccggccagccagccatcgtcacactggtgagctctgcagtctgcactctgcttagctccgagcttcagtgccttcgttgttagctgttagctccacagtccacagttccacacacacgtccagctgcactgcaccaatggccgccgtcgaggtccaggtcccgactgccgctcccgtcgaggaggctgctgctgctgctgcagcgggagtggaggctgcccagctggccgccgtcgagaccccgaacgaggagaccgctgctccggcggcggagaccgaggtcgtcgccgctaaggagccggtgtcggccgaggccgagactgagtccaaggaagtcgaggtcgaggccgatgccgtagc

SEQ ID NO: 47191 - DNA, 354 bp, Zea mays
  Clone ID: LIB3066-026-Q1-K1-F1
cgcagaccgcgtcgagaagatgctcgccgtgctcgacaccaacatgctctgagtgaaccctgactgtggtctcaagacacgcaagtacacagacgtcaagccctgcctgaccaacatggtctctgtcaccaagctcatgcgcacccaacttgacagctcgaaatgaggtacctagatagctccatggtctgatagctcagaatgaaccagatgttttgacataatttgggtgatacccgctaggccatggaggaagtgatacgttagcctctcattggtgggatacaccattacaaagatgcgttctaagaacggagtgagagcttttctttgcgctatgaatctgggggtatg

SEQ ID NO: 47192 - DNA, 431 bp, Zea mays
  unsure at all n locations
  Clone ID: LIB3066-026-Q1-K1-F11
cccacgcgtccgggccacctgcatgacgggcccgtacccggagctgtgcgtgggggagctgggacagcggctgctggacgtgcagacgtcgatcgcgtccgcggcgcccgaccagcgcgcggccaggatcgcgggcgccccggggcaggtggacgtcagggcgctggtggccgtggcgctggaggcggcctcggaagccggcgccgtcgcggtgtccatcttcgagggcaagctccccgggttcaacaccggcgtgcccgacttgcgccgctgcctcggcaactgcaccgtcaccatgcgcagcgccatgcagaagctccacggcgccaccgtcgcgctgcactcgggcgacacgcaggtggccaggacgctcgcgatgcgctctgccgncgacgtctcgtnctgcaccgtcagctgcagggagctcaacg

SEQ ID NO: 47193 - DNA, 147 bp, Zea mays
  Clone ID: LIB3066-026-Q1-K1-F2
cccacgcgtccgcccacgcgtccggctgtaacacgagtgtatagttcaacgtttctcccttcaaaacactgtccatagccagctgcatagtacatttgtaagttttagaatacagatcaaatgattcaattcgcttcttatttgctc

SEQ ID NO: 47194 - DNA, 151 bp, Zea mays
  Clone ID: LIB3066-026-Q1-K1-F3
cgcacgcgtgggcggacgcatggtcggactcgtgtgctgacgcgtgggctgaatttgagggtattacaccgtcaacatccgcaggtgctcatagctgattctacacttatctccattctgtcttcgtccaccacactaatgctcaccccca

SEQ ID NO: 47195 - DNA, 469 bp, Zea mays
  Clone ID: LIB3066-026-Q1-K1-F4
cccacgcgtccgaccacgcgtccgcttgcgcgtccgttgagagatagcaagcaactgcgtgcctttaggagacgcgacgtcgttcgtcatcaagatcagcgagtccttgctgagcgtgacccttgtgagcctgctgctatgtcgcctatgcagcaccgccgttgcccactataaagacatgcacgttctcggcattgtagactgctgcagcgacgcgtgcaaccccgagtccgattgccgcgtcgactagcggacatcatgctggctgatacggaatctgatgcgccggcgccgtcgccggcgccggtgacgtaatcctgttgaacgtgcaagctttcgtacagactatcacggtggtcaagaccgctaaccagttaacgtctcgaaagtgactgcgcctactactgctcttgccatattgatatatagatgctcatagtgagcttaagcctatgacgttcatgctatt

SEQ ID NO: 47196 - DNA, 367 bp, Zea mays
  Clone ID: LIB3066-026-Q1-K1-F5
gccacgcgttcacccactcgttcatttactttttcctacatcaatacagaaatatgaggtggctctgctgatgctgacatgtgggtaccttggaattatcctactctgattgaagatgggcatcttctcatactgcctattatgcaaattactgactgatacttccctttattctgggaaacaagctatagctgatgatgcttctgatcctttggtctacctctgccctgaccttcatgcatatgctaccgagatcgattaacacatcataacaatactccctgataacaaggctgatctggtgccgctgaatatcaagcagagatcgactgattattctaaggcccatgacattctctatttgttc

SEQ ID NO: 47197 - DNA, 445 bp, Zea mays
  unsure at all n locations
  Clone ID: LIB3066-026-Q1-K1-F6
tgtcgtccgcccacgcccgtccgcgcccgatcaggctgcgctctcagtgtcgagcantcgacagggcgtcgggagcaggcggctggcgagtgaccgaggaggttcgtgagcgaggatcccaggagcctcgcgagcgggtcagcagcccgggcgtgcggcggctgcgggtgggccggcgaggcgtggagctggagctgcgaggcagcgtcgggctggccgctgtctctgcnggatggctcaaacggaggaagcagcacgcagcagcagcttggagcatggggcggtggaacgaggcggctgatcgactgcgccggcgagtccgcgcgcgccgcggtgggccgtgccttctcctcgatggtgctcatcatccgggagctccagagcttcacgctgcanatgcgggaggcggtcgtctacgaggacctgcagagcgttctggcgcgcg

SEQ ID NO: 47198 - DNA, 464 bp, Zea mays
  Clone ID: LIB3066-026-Q1-K1-F8
cggacgcgtgggcgatcacgacaagatggcgtgcacaaacaatgcgatgagagccttgttgctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcatgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccgcaagggaaaccttgacgggcagggcccagccgtgtggag

SEQ ID NO: 47199 - DNA, 415 bp, Zea mays
  unsure at all n locations
  Clone ID: LIB3066-026-Q1-K1-F9
ggcagcaacacaagccaattaattaacatgtcatcatgtggatgaatgtatcttcttgtgcagtggtaactagtacaactggactccattcaacgacaaacaaataaataaataaataactcagtcctaatttaccaccaaacggcaattgcgaagaaaccaaaagaaaggtggccaaaactaggacaatctctgttcgatgatttaagtatgatacaaaatctaatgcgacatcagaacatttgaagtccgtaatcatttgggcgcccatatacaagactgccacggacttgtctgagcacacattgggggcattagcttactggtggccgactgaatatcatcagttttcaaacagagacagaaatcattccctcttctctggtttctggaccttgacatacngcaagaatcc

SEQ ID NO: 47200 - DNA, 385 bp, Zea mays
  Clone ID: LIB3066-026-Q1-K1-G1
gtagctcctcaccaagaagcatgacaaagagtccatcagtcacatgcaggaagcctctccagtctgacaatacttctcacagtcaagaagaggactcatattctgtcacttcttcaactgtaacttcagcgagagctggaaaaactaagaagacaactgttgctgttgcacctacatttgtctgtgataatcgtgctgagaagagaggagagttttacacaaaattagaagaaaagcgcaaggctttggaagaggagaaactccaagcagaggccagaaagcaggaagaggaagaagaagctctaagacaactgaggaagaacttggtcgtccgagcgaaacccgtgccgagcttctaccaagaacccccaccaaaggttgaact

SEQ ID NO: 47201 - DNA, 261 bp, Zea mays
  Clone ID: LIB3066-026-Q1-K1-G10
ccacgcgttcgcccacgcgtccgcccactcgtccgtcttgatgacgatgatgactccaggggaagcgaaagatcgacaaaggtggcatctgaggcagcagatataggaagatcagccttgtttccagcttctgctttatcaaacactttcgggttcaagattcaggacaggctactgaacaatgcacagatttaactgtgaaatgagcatcttgacagacctgataactagcattctatagagggtcggcgacgacattga

SEQ ID NO: 47202 - DNA, 387 bp, Zea mays
  Clone ID: LIB3066-026-Q1-K1-G11
ccacgcgttcttcgacgctggcgcgggctcgaggaccttcccgaattagcgtccgctctgacttcagttgaccctgccttagccacatggctgcagccccatcgaattctgtttctggcgtgatggctgttcatgttcaccgacaccgtatcaaggtccgctatgtccaaactatcatgtgtgcaatgtcaactggaagagagcactgtgcaatctcgactggcattagcggtgatcaatccaagggcgtttcgcgtggatcatcatacaaagttatttgagcttacaacgccggttcggatacatccgttatcgttccatggctcagggagatctattgctgtaaagtcttctgtttcactgctgaagctggcagaggtgccattg

SEQ ID NO: 47203 - DNA, 458 bp, Zea mays
  unsure at all n locations
  Clone ID: LIB3066-026-Q1-K1-G12
cggcgangcgtncgcggacgcgtgggcaggcctcaagttcaccatcactgtctggaaaactggagtcaaagtggagacccagaagatgatgctggggacgttcagcccccagctagagccctatgtctacgagggcgaagaatagaccacccctgctggcatttgtgcgagaggatcttattctgccaaactaaagtgtgctgatgatgatggcaagtgcttcctggagatgagttactactttgagattagataggagtggccaggatctcaatgatgtgtggaccagcatggctgactcgtcagagtatgttagagctcatagctgagccaagcacaagatgtggactcatcttcgagaatgatttccattcgatacttcgtcttggatcgcattacaatttgctttgaatcgtcattgtacagtcgtcatgacataaaactggttattcatcaca

SEQ ID NO: 47204 - DNA, 391 bp, Zea mays
  unsure at all n locations
  Clone ID: LIB3066-026-Q1-K1-G2
gctctgcgtctgcgtctgcgtctgcgtctgcactgcttcgcgtctacctccccccgcctccgcctccgccccggcaaaaagcaaaacacggccatggaaggctacgaccgcgagttctaccagttcagcgaccagctgcgcctgcagacggccgccttctcgggcctctacctcggcgactccatctggtcccccgccggccggcgcaacaacagcaacgacgtactcttcgccgnctacgcgtcgcccgccgacgccgncgacaagagcaacgccgtcgtcgggctcaagctcaacgacggagggcccggcctcatcggctccgggaagctggccttcggcggcgccggaggcggaggcaccaacaaggccgaccgctacaacaacaaca

SEQ ID NO: 47205 - DNA, 421 bp, Zea mays
  unsure at all n locations
  Clone ID: LIB3066-026-Q1-K1-E7
gtgatccttgaacaaaattgttcccttgacatgtcccagatgatgagatgagtgtagccatagtttatctctaacttcctgctaagaaactgacagaaagtactttttttttccttctttcgatcttcgtaagggattgaagctgcactgctgcaggacagcagaaggcttctggtgcaaaatttgcaacctcctcctcgttggagtgcctgttcgcctcgctttaatctgtttctacaatgtttttgttttcatgtattgtagctgtaacagtctaagtagccgcgatggcaatcgtgggaagcaattgaacgaattggtgttgttactgtcgtttcggacactgaaagaccatctntctttgcttgctttgccccgaaaggaggaattttgcattaataattaaatacattcttgagtg

SEQ ID NO: 47206 - DNA, 231 bp, Zea mays
  Clone ID: LIB3066-023-Q1-K1-H12
cccacgcgtccggagaagttcaagaatcagctgacaaatcagggtacatacgctaagcttgggcttaaacaaggatggttttgtgcttctcttagtcagccatcatcaaggaaccttgctcaaattgcaaaagtaacaatcatgaaaggagctgttaccctctggaagaaacttagaatcatcacagcattcggtccatcgtgtgtctgaatttgcctagtttttctggaa

SEQ ID NO: 47207 - DNA, 469 bp, Zea mays
  unsure at all n locations
  Clone ID: LIB3066-023-Q1-K1-H2
gcactacaagacgttgtgctccacgatgacgacactgcctggggtgactacgccagagcaactcttagatgcatccctgcggattacagcggtgaaggcagcgatggcggagatgaagctagacaatgcaataaaagcaggcagtgctcagggtaacccgatgatgtcgtcgctaaagacatgcaaggagagctacgcgtcgctggtagactccatcaataccacgcggaacacgctcaaaagcggcggcagcaatgcagacctcatgtcggagctatccgcggcggacaccttcgccaccgactgcggggacaccttcgacgagcgaccagacctcaactcacccatacccggtgcgcagcgccacgtcaaccgnctcatcagcaactgccttgacctagcagccaccattaaggaacaaccctagatgcctatgatgtggacactgaanaaatttatctacaactgg

SEQ ID NO: 47208 - DNA, 461 bp, Zea mays
  Clone ID: LIB3066-023-Q1-K1-H3
tcgctgcaatcaaacgcaggccgcagtcgcgtgcggaactagagctccttcagagaagtgccgtgccagtgccaccgtcggccgcatcatcgttccgccccctgagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatctatctcctttgtggtcttctcttacctggtcctcgttctgctgttctactgcctgcgccgattcgagacaacttcaccagagtcgcctagccgggagcacataaaaatggccgtgtgggtactcaccacgatgctcactgctgcgttctcatac

SEQ ID NO: 47209 - DNA, 465 bp, Zea mays
  Clone ID: LIB3066-023-Q1-K1-H4
tcgctaccctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcccgcgcaaggactgcgaccaggtgcatgcggacagggaccg

SEQ ID NO: 47210 - DNA, 458 bp, Zea mays
  Clone ID: LIB3066-023-Q1-K1-H5
cgccatcgcgcaccgcctccccgtgtcccctccttctcgcccggcaccgtcgagctcggctgtggaaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcaggagcaagatgctgtacgcgagctccaaggaccggttcaagagggagctggagggcatccagctggagctgcaggccac

SEQ ID NO: 47211 - DNA, 445 bp, Zea mays
  Clone ID: LIB3066-023-Q1-K1-H7
ctaataatgatcagtaaatggagcacgcccccctctgcgcctttttcttcttcttcgccttaggcggctgcagcacaacctttatcgccgcatcgaagacacccttcacgtttagttgggtctttgagctgcactcgatgtagtatggcgcgcctatttgctttcttagctcctctccctgagcagtagtgataggaacagcaccaggatgatccacaaagaactgcttgtcatctcgaagatcaagctttgtccctacgagaattattggcacaccaggtgcataatgcttcagttcaggtatccacttcttcgaaacattctcatagctggctttactgatcagcgagaaagccagaagaaaaacatcagctccacgatagctcagtggtctcaggctgttgtaatcctcaagacctgcatgctcatttcctacaccttctac

SEQ ID NO: 47212 - DNA, 273 bp, Zea mays
  Clone ID: LIB3066-023-Q1-K1-H8
gcagcgagagactggcaggggagaggaaaattaaaatctaaccctagcattcgcagcgctggggttacgtggttgcgatggcggcggcggcgagacacctggggacggtgaagtggttcaacgacaccaagggcttcgggttcatctcccgcgacgacggtagcgaagatctcttcttgcaccattcgtcgatcaagtcggagggcttccgctcgctcgccgagggccatgacgtggtgttttccgattcggacggtgacatcggtcgcacta

SEQ ID NO: 47213 - DNA, 437 bp, Zea mays
  Clone ID: LIB3066-024-Q1-K1-A1
ggagatggatcagactgaggtcctccacctgcttgagtcccctgatgccctcaagtcaaaggttgctgaggcgatggatgttctccacaatgtggcccatcagcaaaacgcaaacaccccgaccagtcagcttgctgcattatcactaaccgaaggcattatctcctaacttgaaagccataacaaactatcttcagtttgcaattgagtgatgtttccagaggttatctggcacatgacagtattgctccttttttttcttctatggttggacttgagtgctgttttcgtatttgcactctgcggtgtactgccgttaaggcaaatcagttgtttgcaagtttgagtgctattgggggccgttgattacatacctgtcttttgcaccttgtcggaagttttgctacttaattgaatgagtgagggaacttgtttgc

SEQ ID NO: 47214 - DNA, 376 bp, Zea mays
  Clone ID: LIB3066-024-Q1-K1-A10
acgacgcgtgcgcggacgcgcggccatgacttttctagacccgacatccaacggcatctgatcgaaacaagctacagcaacaccggaccacctgacctggacatgcatgcacacgtatactataatctaacaacgtagctgacctgggcaaattgccagcctgacaggggccagcgtgctcgaatgtctcactctcaccgacgactaactttccatcaaaattgattctcgttcatactccatagcatgcacagattgattgaactgctacttgagattcttgtcattgttattagagagagagacagagacagaacgattggcatagcatgcaaaattgtttggaagaagctagcaaagcagttccttgattgta

SEQ ID NO: 47215 - DNA, 447 bp, Zea mays
  Clone ID: LIB3066-024-Q1-K1-A11
gaccgacgccggcgaatcaatcaagaacgccatctctaggttagggtgtgttgcacctgggtgggggacaggccggcgccgatcgagaaggtcgcggtgccggagaagatggccttgttcctacacgccgccgtcacgtcaccgggacaccagcagcagcacggcgcctcgtcgcacgaggcgcccgccgtgaacatcacgccgcggacaacagccaggaataagcagcagcacctgccggtgagccccggggcgtgcctctgctcgccgaccgttcacgagggctcgttccggtgcaggctccaccgcggcagcggcagcggctccggcctccacgagatgaagatgagcaagacggccggcgtatgacgacgcgacgcagcgggcggcgacaagcgttcgtactacgccttaccgcaaatgcacaggtgcctttgcctgcatttc

SEQ ID NO: 47216 - DNA, 374 bp, Zea mays
  Clone ID: LIB3066-024-Q1-K1-A12
acttcagtcgacgcatcggctaactcttcgtcccatatttctggtcatgaacgcacacacaaccatgcgagacttttcacacgtgcactggttcaactaatctctccatctattcatacctatactacatatttaacaccataacttaccacatcaaattgcaaacctgacacaaatcactcgtcacgaatgtctcacagtgaccgtcgacacactcacgcttaatattcacccttaaccataatccataccatgcacacattgatcgaaatcctactagacattattagcattgatattacatagacatacaaacacagaacgattgccataccatgcataatactacgacagaagctactacatcaactcct

SEQ ID NO: 47217 - DNA, 450 bp, Zea mays
  Clone ID: LIB3066-024-Q1-K1-A2
gcggcaccaccggcgcgtcctcggctcctcgcgtgcgtgcttaccccggcgaatattcgaccacggaagccgcataacctccgtccatcccatccccgctcgcctctcctctcctcgccccgctctagacgatcgatggccgcgacggcggcggaggagatggagaggatggtggaggcggagtgggaggaggggaagcaggggatgaggaagaggaagcggtacgggctggtggagtaccgggcgctgccggcttacctgcgggacaacgagtacatccaccgccactaccgctgcgagtggccgctcccgcaggtgctgctctccgccttctccatccacaacgagaccctcaacgtctggacgcatcttataggatttttcatctttctcgctctgaccatatacacagcatcacaagttccaaatgcagtagatatccggagcttg

SEQ ID NO: 47218 - DNA, 444 bp, Zea mays
  Clone ID: LIB3066-024-Q1-K1-A3
tcgcccacgcgtccgcccacgcgtccgcccacgcgtccgtgcgtttccaagtccgatacaaaccagcgccgcgccgcgcgagcacgtcgggcgacgttgcggcaggcgagatccgagaacactcctccctcgcgcccccgcacccgcatggccgccgctggccgcagatagggaggcgcaggcgggggcgtgcagatccagatccggtgggcggcgaggacgagatcgccccctaccaccatggcgggcgccgtgtcggcgctcttcctgctggacattaagggccgcgtcctcgtctggcgcgactatcgtggtgatgtctccgcgctccaggccgagcgcttcttcaccaagctcctcgacaaggagggcgactcggaagtccactcgcctgtggtctacgacgacgccggcgtcacgtacatgttcatccagcacaacaat

SEQ ID NO: 47219 - DNA, 425 bp, Zea mays
  Clone ID: LIB3066-024-Q1-K1-A4
cccacgcgtccgcagcaaggctgttgagcaagcacagcagcaagttaggtctgccaaaatgtgagcagcggtggtaagaaaggacggagtggatgcacaggcttctgagaaaactcaaaaatcacgcgcgatcttgggtagaagtggtgtaaatggagtagttactgaccacatccagggggtacggcctgctgctgaggcagagagaccaggatcttctgatgcagtgagtgtttgacgcacacccttgttgatcagccaccagtcgtcctgaagccttcagaacaccagtctgagcaggaggcgcttgaaatagcgatcacaaagttgctattgaagtcatattacaatattgtcaggaaaaatgtggaggacttaataccaaaagcagttatgcatttcttggtatgtgattcatatccgat

SEQ ID NO: 47220 - DNA, 306 bp, Zea mays
  Clone ID: LIB3066-023-Q1-K1-H11
cccacgcgtccgcccacgcgtccgcccacgcgtccgcgcgggcctccgcggtgacgcctgcggcttcccttccctcgccaaatgctgcgccgcgctgcgcctgccggggctcggccgcgccgtccacgccctcgcatttctcgcgggcgctgccgtctctcgcgacgccttcgtgcgcacctatctcgtcgacatgtacgccaagtgcggcaggcttcccgacgcgcaccgtctgctcgacgaaacgccgtgctcgagccggacgctggtcggcctggaactgcatgatcctggcgtacggacgga

SEQ ID NO: 47221 - DNA, 447 bp, Zea mays
  Clone ID: LIB3066-023-Q1-K1-F7
gaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgtcagctcttccaccctgagcagctcatcagtggcaaggaggatgccgctaacaatttcgcccgtggccactacacaattggcaaggagattgttgatctgtgccttgaccgtattcgcaagcttgctgacaactgcaccggcctacagggcttcctggtcttcaatgccgttggtggtggcaccggctctggccttggttctctccttcttgagcgcctgtctgtggagtacggcaagaaatccaagctgggcttgact

SEQ ID NO: 47222 - DNA, 462 bp, Zea mays
  Clone ID: LIB3066-023-Q1-K1-F8
cccactcgtccgcccactcgtccgaataaatggcgcctcaaataacttataagaaaaaaaaaagatgaagagctacatgaattccattatacaaagaatttatttactctatataacctccatctctttgttttaaatgacatatgtgcttacgtatagccatgcaaagctcaacccttatcttctcagtgaagtttgtttgaaagtgtacctgtatttatgccttctccaggcgaaaaatggagttcaggttataagcatgcatttaagttcaaattagtggacatttaattgaaatgtattgttctaattttatcctctactgtacttgtgttccaatttatcctgtagtttttttaatgccagccagacagtgtaaacaaataattgtcagttttgccacgattgattgtagattgataagattcataagattgacttgagtcatattgacactattta

SEQ ID NO: 47223 - DNA, 427 bp, Zea mays
  Clone ID: LIB3066-023-Q1-K1-F9
cggacgcgtgggcggacgcgtgggtaacaccgtaagggcttccaagtccgacacgcttgggggcaacaagatgcacgcacttgtggagtacgagacgtcgcagcaagccgagaaagcagtggagaagctgaatgatgaacggaactggaggaaagggctccgtgtccgcacagtgctcaggcgctcgcccaagtcagtgacgaggctgaagcgtgcagacttggaccactttgtggcctacgacgacgactcgccgcactcctcatcagactccccgacggcggactgctcttcacctgccgaggcagcggcggctgacgctcacgtctatcaccagcagcagcaagaggagcagcagaatgggggcaagcacaaaggcagctgggctcgaggacgagctggcacggcgaccaagctgcacatcacg

SEQ ID NO: 47224 - DNA, 444 bp, Zea mays
  Clone ID: LIB3066-023-Q1-K1-G1
tcggacaaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcaggcacggcgttcg

SEQ ID NO: 47225 - DNA, 220 bp, Zea mays
  Clone ID: LIB3066-023-Q1-K1-G10
gtgtgcgcagccccgacggggcgcagtaccatgggcaggacgcgtgcgaagcccccgcagagacccctggtggcccgtggccctgatccggcttggaacatggccggtggccccgatgagccatggccgtgaatggcgaagcaaccatcagaaacaagaaagattaaacaaaatagtgataatgcgtaccacataatccttctgcacatttctgtttctt

SEQ ID NO: 47226 - DNA, 331 bp, Zea mays
  Clone ID: LIB3066-023-Q1-K1-G11
cacacgcgtgctcgacatcgctcacaaaatcttcccatttcagcacgatctcatctaaatgggcgtcttccacatgtgcgcgaactatctcatggataggaatcacttcaaagaccatgcatccgccaatgacctgaccgactataagactctccagatgctccattacgtctaatcgaacatcctcatacgcttgcatgactcaatgatataccaaacgatcaaactgacgaccacccacacatggctagagaaagccaagctctagatcacatcccataaggagaccttccttaggctatagctcttgagaaccaacgtcattacgact

SEQ ID NO: 47227 - DNA, 428 bp, Zea mays
  Clone ID: LIB3066-023-Q1-K1-G12
ccgttcccaaaataccccagctgctgcatgtcttgcatgcgaaccgaggagatccgcgaaacgctgaactccatcgtgtggcccgggtgcaactccgccaccagatcgctcatggtttcctcagacgacgatttgccagacggcgtattcgcagcgaatgaagaagaagacggcatggatacgtaccgtcggcggcgacgcgtggtctgcttgacgcgggccagatctccgatgaactagagcaaggagggcaggcgagcgggcgaacgggcgaacagtttcaaaatgctagggtttcacgacgcgcaaaaaggtaagaaagcctgagccacgccgactcccccctttttatacataggacgcgacgcttcaggaagcccgcagtccaacagtacacgttcatcaacggtcacaataaaacccccgga

SEQ ID NO: 47228 - DNA, 249 bp, Zea mays
  Clone ID: LIB3066-023-Q1-K1-G2
ctgctctgacatttttataagtacagacagggtcgctggagatttcaaggcagccagagagtgtcgcaaaacgcctggactcggtccacagacaaaggtgaattataacacgtgcccgcgtttttagtcctgccatcagatacatgaaactgaactcaggcttgttcggttctcctattgtggattgagtgagcttggttgggtttaaatccaatcaagtcaaactttttttaaatattttttaatctt

SEQ ID NO: 47229 - DNA, 282 bp, Zea mays
  Clone ID: LIB3066-023-Q1-K1-G3
tagctgagcttctggatccacaacttgatgtctttgccggacaccatcacggtaatcacaccgggctactccaacaactcgactgacattcatactaccgcattgttcacctatggcgacatcgacccttgacttatccactaatagcatagcttgccatcagcgctcctcttcttttgtcactttagcactcaaccacttccgccgtactcttccgctgactgatgttaccattcgtgtaagctactcttccacatacactagcctactactattaaccaa

SEQ ID NO: 47230 - DNA, 461 bp, Zea mays
  Clone ID: LIB3066-023-Q1-K1-G4
cccacgcgtccgcccacgcgtccggtccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgaccacgccgtcagcaccgagtccaagatcgacgacctcgcggagctggaggcggcgtcgtc

SEQ ID NO: 47231 - DNA, 259 bp, Zea mays
  Clone ID: LIB3066-023-Q1-K1-G6
ccagacgtacgctgccgtgtcatctttatcagtccagacagcttctctgaagatttaaaggcactcagacagggtcgggcaactcctggactcggtccacagacaacacgtgtactatatcacgtgcccgcgttcctagtcctgtcatcagacacatgaaactgaactcaggcttactactattctactattgtggattgagtgagcttggctggcttaaatccaatcaaatcaaactttttataaatatatcttaatc

SEQ ID NO: 47232 - DNA, 433 bp, Zea mays
  Clone ID: LIB3066-023-Q1-K1-G7
gctggacgtcgggaacaacaacttcctgtcgggggcggccgtccccagggccaacaagcccgactacggcgtcgacttccccggcggccatcccaccggaaggttcagcaatggcgacaacacggctgacttcgtcgcgaagagcatggggttgaagagtagcccttcgccgtatctgtcgcttgcacccaacggctccagccctctgctcgcgcagactgctctcaccactggtgtcagctacgcttccgcagacgctggcgtcctcgactcaaccaacgagggcaagtgcatcccgttgtcgacgcaggtgcgctacttcaacggcaccaaggcgaagatggtcgccaagaatggcgccgtcgcggtgagcaagctgctggccgactccgtcatcctcatgggcatcgccaacaacgacctgttcgtgttc

SEQ ID NO: 47233 - DNA, 416 bp, Zea mays
  Clone ID: LIB3066-023-Q1-K1-G9
cattcgcttacctgaagcacaagaataaacgcagccgggcatgggcgaagctaagctcaacagcgtgaccgtcctgctggtggccctcctcctcctgagcagtggcgttcaggacgctgccgccatgccaggcacgttgaactacgacgcgattgtcgccgacgagccaaacggaaagaacaaggacctgtaccgccccgtcgccaacgccaataaatacacccgcgggtgcgagcccatagaacgctgcaggggcgcgcgctgatcaccaagcatatacatatagcacatcgatttcttattattgcatgcacgtttatataagtgctcattgtcttgctgttgtaagtgccagcacaagcatatatacggcgtttatatatactacatactccgatcgttaaaaaaaacatgct

SEQ ID NO: 47234 - DNA, 444 bp, Zea mays
  Clone ID: LIB3066-023-Q1-K1-H1
acgaaaacgaaccatcgagcaccgactaaacgtgtacaactacttatagaccggaaccgtcaaactgggatggggaaacagaacaaacccatcaaccatggcgaactcggcgtcggggatggccgtgagcgacgagtgcaagctcaagttccaggagctcaagtcgaagcgaagcttccgggtcataacgttcaagatcaacgagcagacgcagcaagtggtggtggacaggctggggcaaccgggcgacacctacgacgacttcaccggctccatgcccgagagcgagtgccggtacgccgtcttcgacttcgacttcaccaccgacgagaactgtcagaagagcaagatcttgttcatctcctggtccccggacacctcgagggtcaagagcaagatgctgtacgcgagctccaaagaccggttcaagaaggagctggaggg

SEQ ID NO: 47235 - DNA, 442 bp, Zea mays
  Clone ID: LIB3066-023-Q1-K1-H10
cccacgcgtccggaacattgcccatccgagctaagtaattaggtcgaaaatgacccgtgcgggcagcagtagcagcagccggcgtgtgacgctggtactgctcggtctccgactgctgcttatggttggtgttgcgcaagcggtagtggagttggtgcctgctgatgataatatcgccgtcgtcgctgctggcacggcatgtggacgatggcgagccgtctcagcagtgcgcgaccccggtgagcgtgcaggaggcgtgccgcggcacgtccgagacgcacgccggcgtggcctacgaccactgcatggcgtcgctgggcgccgacccgcgcagcaaggatgccggcaacaagaacatgcacgggctggcggtgctggccatcaggatggccatcgaccacgcagccagcaccgagtccaagatcgacgacctcacggagct

SEQ ID NO: 47236 - DNA, 447 bp, Zea mays
  Clone ID: LIB3066-023-Q1-K1-F6
cccacgcgtccgcccacgcgttcgcccacgcgttcgcccactcgtccggaagatacaagagaatttgttggagagttgaatatcacactggtcaaaggcaccaacttggccgttagagacatgctaacaagtgatccatatgttgttttaacgctcggagggcagaaagttcaatcaacggttaaaaaaagtgatctgaatccggtatggaatgaagtgcttaagatatctgttcctcgaaattatggacctctaaaacttgaagtgtatgaccatgatatgttctcagccgatgatatcatgggtgaagcagagatagatcttcagccaatgatcacagccgccatggcctttggagatacttcacgtcttggtgacatgcaaattgggaggtggttcatgaccaaagacaacgccctgatgaaagatagcacggtgaatgttgtg

SEQ ID NO: 47237 - DNA, 444 bp, Zea mays
  Clone ID: LIB3066-023-Q1-K1-E11
cccacgcgtccgcccacgcgtccgcccacgcgtccgcccacgcgtccgctcttcccttgcgggagcaaagagaagtagccacaagcatgtctggcatcatcgacaagatccaggagacgctccacatcgggggcgaccacaaggaggagcacgagcacaagaagggcgaggagcaccacaagaagggcgaggagcaccacaagaaggacgacggggagcacaaggagggcatcgtggagaagatcaaggacaagatcaccggcgagcacggcgacaagtccggcgaccacaaggacaaagaccatatggagaagaaagataagaagaagacgacagagaagaagcacggggaaggccatgaccatggtgatggtgacggccacagcagcagcagcagcgacagcgactgatctcgcctcgccgagcgccgtacgcacatatgca

SEQ ID NO: 47238 - DNA, 434 bp, Zea mays
  Clone ID: LIB3066-023-Q1-K1-E2
cccacgcgtccggcgcctccaaggtcaccgtcaaggatgtcaccttcaagaacatcaccggcacctgctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttcttctccaaataccaaccaaattcaagggtt

SEQ ID NO: 47239 - DNA, 462 bp, Zea mays
  Clone ID: LIB3066-023-Q1-K1-E3
attcaagaacctactcgcctcctacattgaccaacaactaagcctccgtgaccgccacatctattaggtgcagccatgggtgcctgtgcaacgaagcctaagacgcttgaggggaaagccccagctgaggccaccatctccacacccaaggttgcacctgagaccactgccatccacattgaggttgcggcgaaacaggcagtagttgagaaggtggaggaggacaaggaggaggcactaacagtggcggcgaaacaagagccagcagccaccatcgagcctcaacagattgctggtgaggtgaccacttcggaagtggcggtcgtcgttgtcgagcctgagaacaaagaggaggaggaagttgtggagaagaccgtcatcgagaaggagaagccatcagcagtccatgaagaggaaaatatcgccaccgacaaggtggcagccgagcccacaacagaattg

SEQ ID NO: 47240 - DNA, 461 bp, Zea mays
  Clone ID: LIB3066-023-Q1-K1-E5
cccacgcgtccgcggacgcgtgggggcaggggagtggaggggaggggaagcatcgcaattgcgaacccccacctcgccgctcccaccaccgcggccgggttgcgtccgtttcgattgcccaggatgagcaccgagtccggggagctgctcgggatcgaccccgtcgagctccggttcccattcgaattaaataagcagatctcctgcacgctgcagctgacgaacaagacagacaagcaggtcgcgttcaaggtgaagacgacaagcccgaaaaagtactgtgttcgcccaaacaacggcatggtggcgccccggtccaaggctgacgttgttgttacgatgcaagcgcagcgggacgtgccaccggacatgcaatgcaaggacaagttccttgtgcagagcgccaccgtcgccaaggaggtcgtgccaaaggaggtcactggagacatgtttaccaaaga

SEQ ID NO: 47241 - DNA, 458 bp, Zea mays
  Clone ID: LIB3066-023-Q1-K1-E7
gggccttataaagtatctcagtactaatggtactaccaatgctgatcctgcagttgatttagtaagagcactgcagtcccaatgccgggacgataccagtactcaacagtttgaactctcttttcatggaagtggaaacaaatattcatgtagcagtctggcagaactagatcagctcacttgcaagaacttgtgcactgatataattcttgacgtccctggttctgatagagagatgcctcagttaggtgtcagtgctctcatgtgcagggacatctcattaaacggtcaacgagtggaaaacaaacatgagctttctgatcttgggcagaggggtccacaggtatctgcaattgacaaagtacttgattccatgaattcttatggtgacaattcgtatggggagatgccatcagcttcaaaaattcttgagctgtgggagcatgagaggtaaatga

SEQ ID NO: 47242 - DNA, 442 bp, Zea mays
  unsure at all n locations
  Clone ID: LIB3066-023-Q1-K1-E9
cccacgcgtccgcggacgcgtgggcagatcgatcgattacagcaatggcggccaaggtgttgctcctcctccgactcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgncgtctacgagaaggccgcgggcgccgtcatcgcggcgacgccggacaacaagctccgcgctatggcgttcgcgttcgacggcgcggt

SEQ ID NO: 47243 - DNA, 449 bp, Zea mays
  Clone ID: LIB3066-023-Q1-K1-F10
gcccaccgaattccctgcgattcctctcccctcgcctcctcgtctccccctaggggatcgggggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcccgctgatgttgccggacccagcgagggggtggcggcgatctccaaaggggggaaggtagggccgaaccg

SEQ ID NO: 47244 - DNA, 295 bp, Zea mays
  Clone ID: LIB3066-023-Q1-K1-F11
gccaagcctacaccctaaggacactcaaattttgcctattggtgtcccccaaaatgatggcgagctctatatcagtgatatcggcatctcgatcgagtaaaatgaccatcaacaactttactggccggttgcaggtttcctttgccacctactatatgactgacaaactcttgttcgcgctcaccctatacaaccattcgcatgagatgacactgtctcaggccaccaatgtcaccgctaactcaaatcaggcgatctacatcgtttacaaagtgtatctttaattggtccatac

SEQ ID NO: 47245 - DNA, 410 bp, Zea mays
  Clone ID: LIB3066-023-Q1-K1-F12
cccacgcgtccgcggacgcgtgggttcctcttcatcgcgtccaccacgttcctgtgcctcggcgtgttcggcttctgctgggtggacctgctgctcacctcccggcggcgcggcggcgtcggcatcggccgcgccgtggccgagtcgcccgtctccggctgcctcatcgcctacacgttcgtgacggcgtggttcgtgggcgggctcacggcgttccactcctacctcgtgtgcaccaaccagaccacgtacgagaacttccggtaccggtacgagcgcaaggccaacccgttcaaccgcggcgccggcagtaacgtggccgagatcttctgctcgccggtcccgccgtcccggaacgacttccgggccagggtgtcccccgccgacccggacgccgtcgcgctctatta

SEQ ID NO: 47246 - DNA, 466 bp, Zea mays
  Clone ID: LIB3066-023-Q1-K1-F2
cccacgcgtccgctgcgttgtcacccacccatcaaggttggggccgccagcagagttcagccgttcctgttcctgataaaacgagagaaggatggcagtgtctcagggagctgtcctattcttgtttctcctcctcgtcgcagcagaggtgggaaccatcgatgccaaaatgggagtagccatgcccatgcatgccttgataatggagaaagcgaaacagcaggagaaggagaagaaggaggagaaaagcacggagaaggaagagagtcaatgcttatcgccgagtctccagttcgagggcttctgcttcaacagcgacagatgcgccgaggtgtgcatgaaggagagctttcccggtggcgagtgcaagcgggacgtggccatgcgcaagtgcttctgcaagaagccttgctagttcatcggtcttgctaattgttgatgggtgcttcattaatttgatttgatg

SEQ ID NO: 47247 - DNA, 462 bp, Zea mays
  Clone ID: LIB3066-023-Q1-K1-F3
tcgcttgaagataacactatttattactaccgatgtggagggcagggtccataattccaatttagtaccccgtcctcccaatttcctttgtcattggctgttgttggtgatcttggtcagactagttggacaacatcaaccctgaatcacattaagcagtgtgagcatgatatgcttttactccctggtgatctatcttatgctgattatatgcaacacttgtgggattccttcggcacattggtggagccacttgctagcaaccggccttggatggtgacagaaggcaaccatgagaaggagcacattccattttttgagtcaggatttcaatcttataatgcacgatggaaaatgccttatgaagagagcggatctagatcaaatttgtactactcttttgaagttgctggtgcacacattataatgctaggttcatacacagattatgatgatagctca

SEQ ID NO: 47248 - DNA, 462 bp, Zea mays
  Clone ID: LIB3066-023-Q1-K1-F4
ctgacacatcgttgtgccaaccttgctcttggtttgactggttgcatgattgctgatgggtaatgccctgccttgtagttgcagggtgtaacactctaatattggtaatactagagaggctctgggccgtggtggcatcgaggacatcaagtacgtcggcagggccccgtcggctgctactgctacgggcttctactcggtgcacgtgcaggattagacggagctggtgcaaaaggccctgcagcgcgaccccatcaactacccgttctgaaagaaacgagacccctgtaaattcttggaaaattgggcaccttttgattttgatatacctctatagagagagcaggccttaaggtatgcctgtgctgctgtgcagccatttgttgaaataatcgtttcggactctacagtaccgcattatatagtatataatttcatgataaatattgtataagtaattat

SEQ ID NO: 47249 - DNA, 440 bp, Zea mays
  Clone ID: LIB3066-023-Q1-K1-E10
cccacgcgtccgcttcctctcgaggcgacgcctgggctaccgcgccgctactgcggcctcgggcgacaggtgcctagtctccatcaggtgccatgtcttcttcgggctcttcaccggcgacgtgcactgccagctctgcatgtatacacccaagtcctttactgggtccgccgacgcccctacgtacttcgttaggtttagtatgctgttaagtttgtaattctagggtctggagggaagcatagatctcaagaggggtgaaatttggtggtaatttcctgagaatttcaaggagacaagggcgtggaggttgattctggagggatctgtgagcacagcagcagaaatttgaggttggtggtagcctgttgatccacgatggtgggtaaggagctggtggtgcaaaggaatggccctggtgacatacgtgagattgctgc

SEQ ID NO: 47250 - DNA, 431 bp, Zea mays
  Clone ID: LIB3066-015-Q1-K1-G1
tcgaccacacctaagtccaaatccaaacatgtcagatcatgcaccagcaacgctactttgggttgtcagccagttgtgccatcaattcagtagcactcaagacaaacggagcaatctacagagaaataaatccaacaaaacaggtttccacactaaaaataacccgggataggtgcatcgtcatcccacagttccttgaattcactcatgtccatctctgctgactcctccggcatcttttcttgcatagcctgagactcctgcatttttgacacgacagtgaaaatcctctggtactgatctcttgcttccgggtactgagccatggacttcactcttgcaagagctttctggagccgttcttcagtctggtttcgtccttcttgcagaaaatcgtaatcatctccagaagacttattttggatcgaact

SEQ ID NO: 47251 - DNA, 421 bp, Zea mays
  Clone ID: LIB3066-015-Q1-K1-G10
tcgcccacgcgtccgcccacgcgtccggaaccacagaccacaaaggaggggacacggacacacagacacaccgtctccgcccgcccgccgcgacgcgccatggctatggctcgctccgtcgcgcacctcttctttcccatcctccttatctccaccgcgcccgccgtgcgggccatcaccgacgccgtcggcggccccggatacctccaggaggcgtgcaacaagacgctgttccccaaggtgtgcatgcacgcgctcaaggacaacccagagtgccaggcggagacggcggtcacccagcgccggctggccgagctgctcgtgtacgtgtcggccgaggtgggcatgaccgtggccgcgttcgcgcaccacgagctcaacgccatccaggacgacgacgttctgtacaagtgcattgaca

SEQ ID NO: 47252 - DNA, 238 bp, Zea mays
  Clone ID: LIB3066-015-Q1-K1-G11
aacaatcgtccgccaactcgtaccgcaccactgacgaaaaaggaggcgacacgggtacagagtcacagcttatcgaggcgtgcttgctaactcgcaaatgctatatatatctacgtaattcaactattatttccgatcttatatatctccttcactctcaaaactctggcgatccccaactcagaagccattcaaagattcccactttatgcctgaaacgcgactgtgtgaacaaagg

SEQ ID NO: 47253 - DNA, 424 bp, Zea mays
  Clone ID: LIB3066-015-Q1-K1-G2
accacattggccattgtcatccaactcttttctgtttaagtagcatcgattttgttccttaaaagggtgctaagttaggcacatttggagtattcagtcacattgcaatgattgacttggtagaaagattttcatgtgatttcttaaggtgggttagaggaaatagtcttttagggaagtgagctgaagtgttataccgtagagtgacctgattacacaaaatcagggtttcagtgtttttcttcttctcatattcagggatgagggagtggactacatggcttataggctgaacttgcacagtgaagtacttctgtaaaactcatagtgcttctaaaatcaaaatattgagaggaaatttattttttcagtttatgtggttttggttcttggaaaagtaaagcagttctcatggcagaaatat

SEQ ID NO: 47254 - DNA, 401 bp, Zea mays
  Clone ID: LIB3066-015-Q1-K1-G3
attactgttttctgctacacaaacgaagtcagttaatgaccttgcaagggttagcttaagggatcctgagtatataagtgtgcacgaggaggccagaacagccacaccggatacccttgagcagtatgccatgattgtacctcttgagcagaagttaaatatgctctggagcttcattaaaaggcatctaaattcaaagacgatagtcttcttatctagtgtcaagcaggtcaaatttgtttatgaaattattaagaaacttcgtcctagtattcctttgaaatgtatgcatggactgatgaaacatgtggtacatgaggccatagttgcagatttcaatgaagctacctcagagcttttctcaactgatataacatctcgaggactagatataaagatgt

SEQ ID NO: 47255 - DNA, 267 bp, Zea mays
  Clone ID: LIB3066-015-Q1-K1-G4
gtcacgacggtcaaggacctctcctaggaacgggcctcactgctcagccgccagcatcaagggctccgatgaggctgcggctgcggctaccgggcagcccactgcaagtgcctagacctgcagcatcaacgatgaccgccactgctccattgacagcgtgcatgacgagccgcttcatcagctccacgattactataaccccgagatcgtccccgtcaagatcatacacgaggacacgtttacattcgacgcttcagaaaaagagac

SEQ ID NO: 47256 - DNA, 236 bp, Zea mays
  Clone ID: LIB3066-015-Q1-K1-G5
gttattattagtccttgctgagatggatcagatcttgtgagttaagtaaagcgtgcaagagatgtcgacagacactacatgagatgacacggttctacaactctaccggagtctctagtttgttctgcttctgcatgcctttggcgtaatgtaaacgaacgctaaggtttctgtaattttgctgctgtcgcgctggcagtttggttccagatgaaaaaaaaaaaaaaatattagat

SEQ ID NO: 47257 - DNA, 413 bp, Zea mays
  Clone ID: LIB3066-015-Q1-K1-G6
ctcaacgcggtgcgtggggtggcggtgctctcgcgatcctcgtgtcgaatccagcggcgggggtgccattccctcccctggccgttgcccgcgcctcgcggtcgcgcaccggaaccggagccccgccgcgaatctagggttgcctccgcctcgccccctccttccgagactcctagcggcaggaattaggacgagggtaacaggcgacagatgctgcgaaggacgccccttgtcgaatgcgccggcgaccgatccgtggaggagcagccggagcacgcatgagttgaagggcaagctttgaaaatgtcatccactgtgccgaagtcatcaaatatcttctggcatgattgcctagttggcaagactgatcgccagatactactcaaccagaaaggctgtgttgtctggatcac

SEQ ID NO: 47258 - DNA, 251 bp, Zea mays
  Clone ID: LIB3066-015-Q1-K1-G7
tcttcctctcaccttactcattaattttctgtaccatatctatcctcttatctaatccagtctcgagagttccattgactccacttgacgttacacgatcctaaaactctaccaccgtaactagtaccgtgactttaatcatgcatcacacgtcaaatatactatcgatattaaacttatagcatctctaattacaaacaatctaactgtcatctaatgatacaaacgacaaatctttttaaataaccctt

SEQ ID NO: 47259 - DNA, 228 bp, Zea mays
  Clone ID: LIB3066-015-Q1-K1-G9
tcgatcgtgaggcttgcacctcgatacgctactctatggaactttcgtcctaccaggcttccgagcactcgtccacccactcttccgtgcactcgtccgaatacccgtcttatcaacctttcctgttaactacatatcatctcatgtactcccattcaatactcaactcctaatccaggccacatcaaacaacctatttatagagaaccacttccttccagatacgac

SEQ ID NO: 47260 - DNA, 438 bp, Zea mays
  Clone ID: LIB3066-015-Q1-K1-H10
tcgcccactcgtccgcccactcgtccgcccactcttccgcccacgcgtccggagagctgacaaggagacttggttcggactgccaacaagtgtctcgtgttataggcaatgaccttaacctgatttcacgcaatttacttcagggtgcaggtgcattaatttatctgctagtcttatcttggcctctcggattgtgtacaatgtttgtttgtgcaactctatcagcaattatgctagttcatggacggtttcagaaaagggcagctaaatttgcacaggagttcaccgcaaacgccaataatgttgctcaagaggtgataactttggttaggacagtgcgagtatatggaacagaaaagcaggagtttaaaaggtatgcaaactggcttgataagctgtatgatgtgagctttcggcaaacagtggcttatggaagct

SEQ ID NO: 47261 - DNA, 192 bp, Zea mays
  Clone ID: LIB3066-015-Q1-K1-H11
ctgacgcgtgggttcaaatgtcaagccccacttgcaaattaccccagcatcaagagcagtggccggccggccggtagctctcggtcgatccactgcggtttccagtcccgaataatcccaattcccaatcgattcgaagcttccttccttcgaggagagggggaggtggatggctccggggaagctttgctt

SEQ ID NO: 47262 - DNA, 407 bp, Zea mays
  Clone ID: LIB3066-015-Q1-K1-H12
ccctgcacgcctggcctgggctggccgcctccgaccaccgtacgtcctccaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgccgatcacg

SEQ ID NO: 47263 - DNA, 337 bp, Zea mays
  Clone ID: LIB3066-015-Q1-K1-H2
aaaacacataaaaaaaaaaaaaaaaaaaaataaaaacaaatataataaaaaaaacaaactaaggctatttgggggaattcatcggactccacggttacatcgccttcattgcattacaatagcgtctactttcttgtcatataattccaatcccttgacttcaattaacaccgtcttctaccttcaaaatcccgacctaacacgcatttactgccatgtctgttgaatcaccttccaatacatggactacttcccaaactgccactacttacaaagacctgaccatttttcttcacgcttttatagtacatggcacgctcctctttcatcaatattt

SEQ ID NO: 47264 - DNA, 338 bp, Zea mays
  Clone ID: LIB3066-015-Q1-K1-H3
tcgggagtctgatgaagttgatgaagaagggactgacaatggaggtgccaagcgacaagtcaagctttcaagcctaggcttcactggtttcaaaaggaaaaccgaggatatcgaatcaagcggaaaaggtcgttgcaaattcttccaggcttgcaaacttgagttggtcaggaagtttcagtgatgtgtcctaatttggtagtacgtacttatatttgtggtagctggagtgtttggtttagtttgttgtagagcctaatttgaaactggtctaaattggatgttgagattggaatgggaagataatgattttccccacataaaataaaattaataaa

SEQ ID NO: 47265 - DNA, 375 bp, Zea mays
  Clone ID: LIB3066-015-Q1-K1-H4
tcgcccactcgttctcccactcgttctcggacgcgtgggaaaaagaaaaaaacaacaaaataaagctttaaaggctaaacttaaatggtaaaaaaaaaaaaaacaaaagatatcaaataaaagcgggaaaagtctttgcaaattattctaggcttgcaaacttgacttggtcaagaagtttcaatgatgtgtcctaaattaattaatacgtacttatatttataaaaactggagtgtaaaaaccagtttgttgcaaagcctaatttgatactggtataaattgtattttcagattggaatgtttaagaaaatgaccttccccaattgccttacaaaaaatttgcaaaacctaaatgcaaattggaacgccccttt

SEQ ID NO: 47266 - DNA, 335 bp, Zea mays
  Clone ID: LIB3066-015-Q1-K1-F9
gaggagaaccagcagcctccaataagagccagccagagaaactaataaaactgtggccgtcggcatccgagcgaacaagccaaccgaccccgtccccaaggcaatccggcggcgacgtaccaccaccaccgcaggagcgagatggagatgaagaggatcctcttcgccgtcctcgtcgtcatcgccgcctcggccaccgcagtgctggccttcaccgaagccgccgccgcgggcgccccaactgcctccgagtcgtccgccgaggctcccgctggcgctggcgctggcgctgccgctggcgccgtcgacttcgggcccttcgtcagcagcggcgc

SEQ ID NO: 47267 - DNA, 389 bp, Zea mays
  Clone ID: LIB3066-015-Q1-K1-H5
ttcactcgtcctaccactcgtcctcggactcgtgggttttttttttttttttggttttttggtgtttttttttttgtttttttattttttttttatatttttttttttttcaaaaaagggacaatcaaattataaaaatttgcaagttcaattacaccaataaaattattttactaaggaaaaattaacaaaagtttaaagaaaggtaaaaaaccgaggataaaataattaaagccttcaaaaaaattttgtaaaatttttaaaataatcaacttgatctagaaattgatgaatacctgtttatataatctgaatacaaattttattttacaaataaaacttaacattaatctaaaaaaaaacaattgaataaaatttggttaatttat

SEQ ID NO: 47268 - DNA, 455 bp, Zea mays
  Clone ID: LIB3066-015-Q1-K1-E3
aaaggaaggagggcaggaggagaggcggaacaacccgtctccctccatctctctaccttctgctcctgcgcccctatccatcgctcgcaccacccactgaccggccggcggcatccttattaccataacatcacgggacggtggctcgatgcaaggaggcccactgagcccggatgagtactgggtgatatcgccgccggcgctgctgcaccagccggcgtccaccatcgtcgtggccatcgaccgggaccggaacagccaactggccgtgaagtgggtggtggaccaccttctctccggcgcctctcaaatcgtgctactccacgtggccgtccattaccacacgacccatgggttcgccatggttgaaaccacgcatggtgcgctggaggctgaaatgaaggagatctttgtcccctacagaagattcttcaaccggaatggggtggaagtat

SEQ ID NO: 47269 - DNA, 416 bp, Zea mays
  Clone ID: LIB3066-015-Q1-K1-E4
gttggttcagaattcaacaaacacacaggatgagaaagtcacaaaagtctcacctcctcggagaaaggcgtataaagaagacaaatctgatcggcagggcaactacgtgaaaaaggataatggtcctgagacaggtcggactgggtataagatacaacaggcaaagcagctgcaacagcatcaaaggccaacatctgcttcagcttcgtcaaggcaatctgaaaaggaaagttcttgtgatgatgtagaaattgatgcaattcttgaggaagaggaggccctcattgcagctcacaggaaggagatcgagaatactatggagatcgtacgggaagaaatgaaccttttggcagaagttgatcaaccaggtagcctgattgacaactacgtgacccaactgagctttctgctgtcac

SEQ ID NO: 47270 - DNA, 306 bp, Zea mays
  Clone ID: LIB3066-015-Q1-K1-E5
aattttactaatcaaactcttgttgggatatattcctccaattcccctcctcctcccaacggggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgtcgccgctgcgaccgtcgtgccccgcacccctagccctgctgcgtacgcgtccgtctccttctccg

SEQ ID NO: 47271 - DNA, 397 bp, Zea mays
  Clone ID: LIB3066-015-Q1-K1-E6
gcgaatcgacaaccaccccgccggggagggtaatccaagcgagggcgagccatcaccgtgctgttcctcgtttgctgtcgcctcgaagagcctcctccgttccctctccctcgaccgatcggccggtctcacggggcatttcgcggggctggtcgatctctccccgctcattctgtcaagggattggtcggttgccgattccgtgcggccggataactcggatttattcagtttttcgggttcgctacatgcgtgtgcgatgccggccagctccctcccggcgtcccccgacgccaccggcgacattggcgccgcgctcgagctcgatctcgaggatctcgccgtcggcggcggcacggactgcatcggcgcgctcgcctgcggcaggagcagcttc

SEQ ID NO: 47272 - DNA, 304 bp, Zea mays
  Clone ID: LIB3066-015-Q1-K1-E7
aaccataagtggattcgacctggacacctcttcacctgcggtcctggttcttacaaaatagcctctgtaaatgatatacctctcaatttcaaggtttctctattaaagggtgttccaaatccaaaggctattcattcttccaaagccgtgggagagccaccatttttcctaggttccgccgtcttatttgcgataaaggatgcgatctctgcggcaagggctgaggtggcgcacttggactgcttttcactcgactacccggctacaccggaaagaataagaatggcatgtgtggattccatta

SEQ ID NO: 47273 - DNA, 398 bp, Zea mays
  Clone ID: LIB3066-015-Q1-K1-E8
cccactcgtccgaattttactaatcaaattcttgttgggatatattcctccaggtcccctgctcctcccaacaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcggtcggcagcctgcggctgcagcggcaggcgtgctgcgagccgtcggtggcgccgtcgcgggcggtg

SEQ ID NO: 47274 - DNA, 460 bp, Zea mays
  Clone ID: LIB3066-015-Q1-K1-E9
tcgtggacgacaccggcgtcgtcgaggtggatgccggcgccgccaatgcggtggcgctgcgcgtgaagcccgccttgcagctggaggaaaagggggagctggagaaggaggtgtgggcgaggttctacggcaccggcttttggaggagcccgtcgcagctggacgacaacgacgacaggtgatcgggacaggcccgcgagcgagctatccacaagctcctccggcgatgcgtgggcttccttcgttttccgcgggaagaagagaggatcgaggaaagggaaacatgattgtgtgttcgatactacgattacgaacttcgttttcccttcttttttgtttgtttggaaggggaaatacttctcttctattctacaacaatgtcacgtacatgcaatgtaataataaaaaatgtatgtgatatatttaacaatgtgattgatgatggataaatggaaatgga

SEQ ID NO: 47275 - DNA, 468 bp, Zea mays
  unsure at all n locations
  Clone ID: LIB3066-015-Q1-K1-F1
cccacgcgtccgcggacgcgtgggtggaatgcagtttgcaatgcatcaccagcctcttgcctcgcaggggagtgccgctgatgttgtcagcagtggtgctatgccagctagggataccaagcaaaggcctacgaagccttgtgcttacttcaacagcgcgagaggatgccggaacggtgcgaactgcacgtttctgcacgatgtgtctgccgcgaggaaagaacagtcaaagggttccaaaaggattaagcttgacagcagaatagccgggcggtattgaggggctgctgccgccggttgatttttgactgttctttggttcaaaatcctcatttcgccctttttccccttaaaaaacgtttcagtaaatattgcgccccagctccttgtttctttcacttagccaatttctctntgttgactaaatgaggtgttttagaagaaagaaaaatatcccacgatttattg

SEQ ID NO: 47276 - DNA, 456 bp, Zea mays
  Clone ID: LIB3066-015-Q1-K1-F11
cggacgcgtgggcgagccgtccagttcagttcacctcggtccgggaccgcgagtacaccgacggcggcgcgtccgagcccagccgacgccgagccaatggtgactccagcgacattctccctccgccccagcgcgccccccgcgccgcctcgtgccgggctgccccgcgctcgggcctgtttcgcgcccgccatccgcacctccccttccgtcgccttttcctaccagcctcggcgcttcagtggcatccgccgcgccgtggccgtcgactccgagcagggcttccccgagtccccagagcaggagaagaagcccaagacgtactacttcctggtggcaaacgccaagttcatgctggacgaggaggagcacttccaggagcaactcgccgagaagctgcgcaactacgccgagcgcgacaaggagcaggacttctggctcgtcgtggagcccaag

SEQ ID NO: 47277 - DNA, 431 bp, Zea mays
  Clone ID: LIB3066-015-Q1-K1-F2
acgtccactcgttctccgactcgtgcgtggaattcagattgcaatgcatcaccagcctcttgcgtctcatgcgagtgcctctaatgttgtcagcactggttctattccagctaggtataccaagcaaaggcctacgaagccttgtgcttactataacagcgctagaggatgcctgaactgtgctaactgcacgtttctgcacgatgtgtttgccgagaggaaagaacagtcaaaggattccaaaaggattaatcttgacagcataatagctcaacggtatcgaagggctgctgcccaccgttgatttttcactgttctttggttcaaaatcctcatttcgaactttttccccttaaaaaacgtttcagtaaatattgcgccccagctccttgtttctttcacttagccaatttctctttgctgactaaatg

SEQ ID NO: 47278 - DNA, 465 bp, Zea mays
  Clone ID: LIB3066-015-Q1-K1-F3
gtcccgttcgttcgattcgttctttccgccatggaggctcggaggaagcccgcggtgtgcggtgccctgcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcatggtcgtggaggccgtattgccagtgcctgttggcggactgccaataggcgcgaacagctgcgtcgcatggcgtcctggctgcctcgccggccgatgaaggatgaacggttgcggccgatgatcgatgtgtccgtcggcatgtcgatcactcattgaaaccccctctaatcctgtgcggtattattttcatggcacctgtggccattaaagatccatggacacgtacagtaccaatacat

SEQ ID NO: 47279 - DNA, 390 bp, Zea mays
  Clone ID: LIB3066-015-Q1-K1-F4
tccacgcgtgcgcccacgcgtccgcgagaagagcatagactccctacacgtcgatggctacgccttcttcggcgtctggatgggccccgggaagtggtcgccggaggtgaggaagacgtacaacctgctggacacggcgagccggcacacgatccatgtgtacccgcggtcatggacggcaatcatgctgacgttcgacaacgcgggcatgtggagcgtgcattccaacatctgggagcggtactacctcggggagcagttctacatcagcgtcgtctagccagctcgatcactgcgcgacgagtacaacatgcccgacaacgccctacgatgcggcaaggtcgtggagctagccgtgccgccgtactacgctcactcgcgctaagacga

SEQ ID NO: 47280 - DNA, 430 bp, Zea mays
  Clone ID: LIB3066-015-Q1-K1-F6
cggactcgtgggccggcgagcaaggagcgcatgctggggccgcaggccatcggcttccaggagggcgactaccacgcccacctccgccggctcgtctcccgggctttctcccccgaggccatccgcggctccgtgccggccatcgaggccatcgcgctgcgctcgctcgagtcctgggacggccgcctcgtcaacaccttccaagagatgaagctgtacgcgctgaatgtggcattgctgtccatcttcggcgaggaggagatgcggtacatcgaggagctgaagcagtgctacctgaccctggagaaggggtacaactcgatgccggtgaacctgccgggcaccctgttccacaaggccatgaaggcccgcaagcgcctgggcgccatcgtggcccacatcatcgaggcccggctcgagggctagcggc

SEQ ID NO: 47281 - DNA, 58 bp, Zea mays
  Clone ID: LIB3066-015-Q1-K1-F7
tcttactccttaaccgactagctactactgatttattaaacctagtgccatatgggat

SEQ ID NO: 47282 - DNA, 317 bp, Zea mays
  Clone ID: LIB3066-015-Q1-K1-F8
tctcgtctgtcggtatgtatgtcgtctggaggaaaggaaatttaagttatatgaaatgaatatgctgttgatgtgtcaaattcaaaaaaaaaaaaaaaaaaaaaataaaaaaaaaaaaaaaaaaaaaaagaaaaaaaataaaaaaaaaaaaaaaaaaaaaaaaaaataaaaaaaaaaaaaaaaaaggggtttcccttttaaagaaccaatttcacaaaatccttcatttaaaggtattaactcttttaaagttcacctataattgaattaactgcctggcttttaaaaatctactctaccaaaaaaacatgtttttt

SEQ ID NO: 47283 - DNA, 440 bp, Zea mays
  Clone ID: LIB3066-015-Q1-K1-E2
gcagaggcgcagagacaggcgtcttcgtactcgcctatctccgcgactcaaagcttcttggatttcctaccgccgtcgctgcagctccaccccattccgtcgacaccatgagggagtgcatctcgatccacatcggccaagccggtatccaggtcggaaacgcgtgctgggagctttactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccggcagctctttcaccctgagcagcttatcagtggcaaggaggatgcagccaacaacttcgcccgtggtcactacaccattggc

SEQ ID NO: 47284 - DNA, 172 bp, Zea mays
  Clone ID: LIB3066-015-Q1-K1-C4
cacgtcagggtcacaactggcgtctgctggcattgctctaactgatgcatttagaactgagggttgtggcaatatttgaagaattaacaaaatgtaaatagctttggcagttactttacccttttagatgtaacaaactcatcccgttggttacatgtaccttgttttattt

SEQ ID NO: 47285 - DNA, 378 bp, Zea mays
  Clone ID: LIB3066-015-Q1-K1-C7
cggacgcgtgggctcgggcaatccagtcacggtgtacatcactgacatgaactgacgagcggatcgctccctaccacttcgacttgagcggcaaggccttcggctccctggcaaagcccgggctcaacgacaagcttcgccactgcggcatcatggacgtcgagttcagaagggtgcggtgcatgtaccccgccgggcagaagattgtgttccacatcgagaagggctgcaaccccaactacctggccgtgcttgtgaagtttgtggcggacgacggtgacatcgtgctgatggaaatccaggacaagttgtcggctgagtggaagcccatgaagctctcttgtggcgccatctggaggatggacactggcaaggcgc

SEQ ID NO: 47286 - DNA, 333 bp, Zea mays
  Clone ID: LIB3066-015-Q1-K1-C8
aaaaatcactagtacaattaggcaactaactattatcgctagtgtattcaaacgctctcaggtagatattaaaacttcacctttttgaattgactggcactgctagcacactatgctatatctagacttcacacatcttgtcaggtgatttacttgcatcctttacctaaaagaataccacattgacctctaccgaaactggatccactgtaatctgcttaatttctctaaatccaaccactttaatgaactcaacattacatatcattcttaatacccaaacttcacttcataactcactttaacatgacatgcaatccaattatcaaacat

SEQ ID NO: 47287 - DNA, 442 bp, Zea mays
  Clone ID: LIB3066-015-Q1-K1-C9
cccacgcgtccgggctccaggaggaggagggaggcgcagcagggcgggtgggggagatgtgcctctgggactggttctacggggtgctggcctccctcggcctgtggcagaaggaggccaagatcctcttccttggcctcgacaacgccggcaagaccacgctgctccacatgctcaaggacgagcggttggtgcagcaccagccgactcagcacccgacgtcggaggagctcagcatcggcaagatcaagttcaaggcgttcgacctcggcggccaccagatcgcgcgccgcgtgtggaaggattactacgcaaaggttgatgctgtagtatacctggtagatgcatatgataaggagcgatttgctgaatcaaagaaggagctcgatgctctcctgtctgatgattctttggccaatgttccatttctcatccttggcaa

SEQ ID NO: 47288 - DNA, 357 bp, Zea mays
  Clone ID: LIB3066-015-Q1-K1-D1
tcgggcctggccggcgaggcttgccatcgccctcggctccgccaagggcttggcttacctgcacgaagattggcaccccaggatcatccaccgtgacatcaaggcagccaacatccttctggacgagaatttcgaggctaatgtcgcggatttcggacttgccaagctgaccacagacaccaacacgcacgtcttcactcgtgtcatgggaactttcgggtatttttccccggagtacgcgtcgagcggcaagctcaccgacaagtctgacgtgttctccttcggcgtcatgctcctggagctcattaccggcaggagaccggttgatcccacgaactacatggaggacagcctggt

SEQ ID NO: 47289 - DNA, 335 bp, Zea mays
  Clone ID: LIB3066-015-Q1-K1-D10
cccacgcgtccgcccacgcgtacgcccacgcgtacgcccacgcgtccgcccacgtcgactcggtcgagggagtccaggctgttgccagcgagcgatggctagcaacggctcgtcgctggtgcgccgagcctgctcaactgtgcgccgaatgcctagttggaagaagcggctcgtcttattcgccgtcggagttagcaccttatcttatgcttgtcaagataatcgagctcttcaaattcgtgatgttactggaaacaagaagaaggcggttatccttggaactggatggactgatgcaagttcattgagaaatatcgacacatctttgtatgatg

SEQ ID NO: 47290 - DNA, 379 bp, Zea mays
  Clone ID: LIB3066-015-Q1-K1-D11
cccactcgtccgcccactcgtccgcccactcgtccgaaaaaaaaaaaaaaaagaaaaaaagaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggacgccaataaaaaaaaccatgataaatgccccaactattgaaaatctaaagcattcaaagggagccaaaaattaaaagaaactggactctttataaaaaacataatagataaaaaaacgatatactcacgcaatataaccgtgaacaaaaaaatcatcattaaaaaaaacgcataattaaaaaaagggcaaatacatatcccctac

SEQ ID NO: 47291 - DNA, 436 bp, Zea mays
  Clone ID: LIB3066-015-Q1-K1-D12
tcgaatagacgcaatactgatggcccaaaacatgttgattgcggtggttctcctgggtgccaccgttcttgtggtggcaagatcgttgcgggttccagaagaaccctcaaatgcggatgacataagaggtgcttgcatcgacgagtgcaccacagaaaataaggctcctggcgacaagaagacatgcgaagtgttgtgcaccaagctcacaaaaaagcctaccgaagaaggcaaacatgattgatgaagtaccactccgataatatataccctagtggatcagtggtcatctttgtagccatgtctgccacacgatggccttgactatattgacttatgcgtatgtttctggttttcactaatatcctaattcgctagccatataacctaatttcactcaaagcattttatatgcttcacttaattaaataaatac

SEQ ID NO: 47292 - DNA, 431 bp, Zea mays
  unsure at all n locations
  Clone ID: LIB3066-015-Q1-K1-D3
cggacgcgtgggcggactcgtgggcgcagccggcaccatctcttcccgcaccccccattcggacgccggagctcgacgaggacgaccgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctnctgtctgttgcatacaagaacgtcattggagcccgccgcgcctcatggcgcatcatctcctncatcgagcagaatgaggagggccgaggcaatgatgaccgagtaacactcatcaaggattatcgtggcaagattgagac

SEQ ID NO: 47293 - DNA, 142 bp, Zea mays
  Clone ID: LIB3066-015-Q1-K1-D4
acgtaaactcctcttctacctccttctctcaactttcacaatttctttactcaaaccttattcggtctcctgggctctactatcactatccactacattcccatatatccatcacactgtacatttcgaaaactatactaca

SEQ ID NO: 47294 - DNA, 345 bp, Zea mays
  Clone ID: LIB3066-015-Q1-K1-D6
cccactcgtccgcagaagattacagctggtataactgacctaattgatgttgagttcgatggtcagaggcgcaatcggtcattttccacatgatgcaataagcaagaaagtaatggtgaatacaaagtgcagtactcgtcctcgaccttgaatcgcattactggacctggagccattgcagatagctcttgagccttaccttgatttaatttacctgggttttgagagactatctatgaatatgctaactcgttcgtaaagtatctttttgtcccaattttgattgatggagctttaagcttgcttttctgtatgcaataaaaaaacttatcacatttttctttc

SEQ ID NO: 47295 - DNA, 398 bp, Zea mays
  unsure at all n locations
  Clone ID: LIB3066-015-Q1-K1-D7
cccactcgtccgctcaatcgtgtacggcggtggctcagcagagatatcttgctgaattgcggttgaaactgctgcagatcggcaccctggagttgagcagtacgctatcaggtcattcgctgatgcattagatgctgttccactagccttggctgaaaacagtggtttgtcgccaattgataccttgaccatggtaaaagctcagcaagttaaggagagcaacccccactgcggcatagactgcaacgatgtatgcaccatcgacatgaaagagcagaacgtctttgagaccctgattggcaagcagcagcagatcctgctggccactcangtggtgaagatgatcctgaagatcgacgacgtcatctcaccgtccgagtactgatgaagcctgaagg

SEQ ID NO: 47296 - DNA, 415 bp, Zea mays
  Clone ID: LIB3066-015-Q1-K1-D9
cccacgcgtccgctcgtggataacctggtcatcaccggcaagggaaaccttgacggtcagggcccagccgtgtggagcaagaactcctgcaccaagaagtatgactgcaagatccttcccaactcgctggtgatggacttcgtgaacaacggggaggtgtccggggtcacgctgctcaactccaagttcttccacatgaacatgtaccagtgcaagaacatgctgatcaaggacgtgaccgtgacggctcccggggacagccccaacacggatggcatccacatgggcgactcatccgggatcaccatcaccaacaccgtcattggcgtcggcgacgactgcatctccatcggccctgggacctccaaggtgaacatcactggcgtgacctgcggccccggccacggcatcagca

SEQ ID NO: 47297 - DNA, 309 bp, Zea mays
  Clone ID: LIB3066-015-Q1-K1-E1
tcgcccactcgttcggttacatgatcagctcgatcacctatcaagccaaagactttctataaacgcaagaagggatgctccccagacgtaaaagaacgacacacaatacagcataacgtaacctttccatctgtttgtcgagtacaaatatcaccccaaatttgcaagaccaatataacgccatacgatatattgtcaaccacaacaggtacaacataatacaactctaattcaacaacaatagcccacctgttgctatatccgacgtgctcctctagataacttagcgcgctctatatcattcttgtt

SEQ ID NO: 47298 - DNA, 415 bp, Zea mays
  Clone ID: LIB3066-015-Q1-K1-E10
gatgagtaccttctcactcgcagctacatcactggctaccaagcttccaagggtgacttggctgtctacacttcgttttcgtctgctccctcgtccaagtatatcaacgtagcaaggtggtttaatcacattgatgctctcgtgaggctgagcggaattactgcagagggccaaggtgtgaaggttgaatcctcagcagttccttcagccccaactccagatgttgctgaagcacaggccccagctgctgaggaggaggacgatgatgatgttgacctttttggtgaggagaccgaacatgagaagaacgctgctgaagagcgtgctgcagctgccaaggcttctggcaagaagaaagaatctgggaagtcatcagttttacttgatgtgaagccatgggacgatgagactgaca

SEQ ID NO: 47299 - DNA, 103 bp, Zea mays
  Clone ID: LIB3066-015-Q1-K1-E11
tcttctctgatttttctgtacatcattaaatccatacttttctctatcaatctttacaatgtgtctctggtcatgtgtaacaatcaaaccttccataactttc

SEQ ID NO: 47300 - DNA, 394 bp, Zea mays
  Clone ID: LIB3066-015-Q1-K1-E12
tcgggcgtcgatgctgctcgtcgggctcgccgtgggctccgaggaggaggaggacggctgcggcaaaaagaagccccacgtcaaccacggcaagtttaaggcggagccgtggactgacgggcactcgacgtactacggcgggcgcgacgggttaactgacaccacggacggcggctcgtgcggctacaagggcgagctggggaaagactactgcaccctgacggcggccgtgggcccgtcgctgtacaccaacggcaccgggtgcggcgcgtgctatgagctcaagggccccaagggcaccgtggtggtgacggccaccaacgaggccccgccgccggtgagcgggcagaagggcgagcacttcgacctcaccataccggcgtttctcaagatc

SEQ ID NO: 47301 - DNA, 372 bp, Zea mays
  Clone ID: LIB3066-015-Q1-K1-C3
ctcaacaacagccagctcgcgaaaataatgaagagccgcagcatggcatcatcggccgcgcgcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaagaggagtgcgacaaggcgtacgtggtg

SEQ ID NO: 47302 - DNA, 430 bp, Zea mays
  Clone ID: LIB3066-005-Q1-K1-B1
cccaccgtcgcgaccgtggcggactcgtggccactgcccggcaccaacgcgctagttatcgagggcgaggcgcctccacagcgcactacgagcgtgccccgcaagtactccgagtacacgccctgcgaggacgtggagcgctccctgcggttcccgcgggaccgcctcgtctaccgcgagcgccactgccccgcggacggcgagcgcctgcgctgcctcgtgccggcgcccaggggctaccgcaacccgttcccctggccggccagccgcgacgtcgcctggttcgccaacgtgccgcacaaggagctcatcgtcgagaatgcgctgcaaaactggatccgcgtcgactgctacaggttccgcttccacgggggcggcaccatgttccttcgcagaaccggcgcttacattgacgacatcgccaagctta

SEQ ID NO: 47303 - DNA, 423 bp, Zea mays
  Clone ID: LIB3066-005-Q1-K1-B10
cccacgcgtgcgcccacgcgtccgcccacgcgtccgcccacgcgtccgcccacgcgtccgcgcacgcgtccggagatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcct

SEQ ID NO: 47304 - DNA, 286 bp, Zea mays
  Clone ID: LIB3066-005-Q1-K1-B11
cccacgcgtccgcccacgcgtccgtatttatttattgcttgcggttgcctaattatgtgagcgtctgttgttccttccttccttggtgatcgtgtgggtcgccaagggggttttgtttctgtaatcctgcccgatcgatgctaatactatgatcccaatttggattttgcgatcctaaaaaaaaaaaaaaaaaaaaaaaaaataagaaatatcaaaaaaaaaaaaaaaaaaacaaaacaaaccaaaaatgataacaaatgcaagaataaaaaaactatagagaaaa

SEQ ID NO: 47305 - DNA, 397 bp, Zea mays
  Clone ID: LIB3066-005-Q1-K1-B12
tgaccttcagcaaggagacttcatcgtgatttacaaggacgacgagaacaaccgctttggcgtacgggcaaacaaggcaggagatgagcagaccggcactgtaccttaagtccatgaacacatgcacatctctgctccactgccagcttcacaagcgtcacatgactatgcaggccccgtagcatcagaagctgttatgctcgccatcgtgccacaagctgacgagatattcgacggcatactgaactccctgccggagataccagtggcgaacgtgaggtactacgacttcttggacccgatcagtgactgcatggacatggcaaatcctctgagctcatccaataaccccgtggtcaacctggctacgcactttcatgactagaggatcgacaac

SEQ ID NO: 47306 - DNA, 457 bp, Zea mays
  Clone ID: LIB3066-005-Q1-K1-B3
cggacgcgtgggcggacgcgtgggggcctgggctggccgcctccgaccaccgtacgtccgggaccgcgtcgccgccggccggcctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgccgtcaccgttcagctccaacacggcgcaccaccccgtctccgtgcccaccacacctaggttgtccttatcgtgctcgtcgttcggccacatggtgaccccgcccaccgacacaccgtcgatcacgcccaccaagaagcaggacgacaagccgaagccgacgcc

SEQ ID NO: 47307 - DNA, 472 bp, Zea mays
  unsure at all n locations
  Clone ID: LIB3066-005-Q1-K1-B4
ccaataatagcaagtgtgatcatccgttgatccatcttgctaataaccctgcgtgcccttggttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcgcccaccagcgcctcctcggctgcgttcccggccgtcggcgccgtgctgagcgcctccgtgctctccttcttcgcctactacctgcagtaaaattaaaggaggatcggagggagaggctgctggctgccattgcctgtattcggttggatcccgtttatatatatatatatatatttaagtactttaatttgggtctgaacatgtcgattgatccattcattntatttgctttgccatttctcccctttctgttaatttcgatatg

SEQ ID NO: 47308 - DNA, 473 bp, Zea mays
  Clone ID: LIB3066-005-Q1-K1-B5
cccacgcgtccgcccacgcgtccgcccacgcgtccgcccacgcgtccgcccacgcgtccgcggacgcgtccgcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtcgatctttgctgccttggcgagcttcagccgaatcaaggtcgagcatggcggcaggccagtaaatagagcaacacaaaacccttcaaaataatggagacctctgcagca

SEQ ID NO: 47309 - DNA, 439 bp, Zea mays
  unsure at all n locations
  Clone ID: LIB3066-005-Q1-K1-B6
cggacgcgtgggccgacgcgtgggccgacgcgttggctcctgaaaaatatccatggctgccggatgcaagccctctaacataaccattggcactcccattcttggtattctgggttgccttggctgctctgttggcttatgcatgattagtgggatcaagaggtttagcaagtttcaagttgatgtcagattccatgaggtgcactgcaacaagtcatttgttcattcaattccatggttgcacagaaaagatgaggcgatgccaagaaaaagtcgatatgtctatgtgtttaagttaaagggccaaaatgtatttcttgtttggtatatagcagccctacaacactntggtgaacttagttactgcagactaggtaattacagttgcaccttttgtattttatagcaaacccagaaattttcattggattctacgact

SEQ ID NO: 47310 - DNA, 414 bp, Zea mays
  Clone ID: LIB3066-005-Q1-K1-B7
cccacgcgtccgcccacgcgtccgcccacgcgtccgggctcccagttcttcatctgcaccgttgctacctcttggctcgacggcaatcacgtcatcttcggccaggtcgtcaagggcatggacgtcgtcaaggccatcgagaaggtggacacccgcaacggcttcacctacaaggtggtcaaagtcgctgactgctgacagctctgctagatctctctgatctggtatgttcggacaacctaccttcgtcatcgtctactactcctgcgtccattcctttggatctgaataatatggtggtaatctgaatggtggtattagtttatcatgtatcgctcgcagtataatatatcggtttaggtgatgatctttgaaaaataataaaattttgattcgaaacaacaacacaaactt

SEQ ID NO: 47311 - DNA, 451 bp, Zea mays
  unsure at all n locations
  Clone ID: LIB3066-005-Q1-K1-B8
cccacgcgtccgagccattgaagacaatgaagctcgggcattgatggcttgacaagccattgtgtcatgtgaggatccgttggtgaatttacaggaccagaaaaacaaattgactgaagaggcggaggtggagctccgacgagccaatgaggcaattgaaaagctgaaaaccttcaagaacgaatgtggactgcctcatgtgcaaatggaatggcatgatcaccatgaaatagaactggtccatgcactgcccttcgaggattctgatgattctgcgctgaatgaaagcaggcttgacctccaggaaatatgtcaaagagtcaaagaaataattgaatcttaccctgagctatcagttgcggaattagcagataaagttgatcgacttgtggaaaaggtgatcagccttgaacttgccactacttcacagaatgctcagatcgatngaatg

SEQ ID NO: 47312 - DNA, 444 bp, Zea mays
  Clone ID: LIB3066-005-Q1-K1-B9
cggacgcgtgggctttcagcagaccagctattgctctaatatgttttggcacaatcgcctgattccgaagtgttttgttaccttcttcgcccttcatgtggcttgctgggatgacttttggatatctttatggctttttgataatcacagtggggatgagcataggcatgtcgttgccgtattttataggttctgcattccactgcaggatacatagatggctggagaagtggccaaagaaagcagcttttgtaaggcttgctggcgagggagattggcatcatcaatttaaggctgttgctttactcaggatttctccatttccatatttagtttttaactacgcttctgtggctacgaacgtcaaatattacccatacatagctggttccatggctggaaccatacatgaaactttccttgcaatatacagtgggaaacttt

SEQ ID NO: 47313 - DNA, 464 bp, Zea mays
  Clone ID: LIB3066-005-Q1-K1-C1
ctcgcgcacgctctacatccagtcggagatcggcgggttcatcgacccgcagggctggcgggcgtggctcggcgacttcggcctcagcacctgctactacgccgaggtggaaaaccacgggcccggcgccaacatgaccagacgcgtcaagtggaggggtatcaagaacatcacctaccagcacgcgctgcagaagtacaccgtcgagagcttcatccagggccagcactggctcccacagctcggcgtgccattcatcccggggctgctgccgcagcagcaatcgggcaggatacactgacatctaaggaagatgatatatgatcggcaggctgcgttgtcgatatgacgtggcactaacatgtacgtaccatggtttagtttattggttggtttatgctattttgactactactttttttatattcgataaaaaaatgcagtacagaattaaaaacgcaaat

SEQ ID NO: 47314 - DNA, 443 bp, Zea mays
  Clone ID: LIB3066-005-Q1-K1-C10
accagctcttctgttgagaagagctacgagctgcctgacggacaggtcatcaccattggtgctgagcgcttacgctgccctgaggtcctcttccagccatccttcattgggatggaagctgctggtatccacgagaccacctacaactccatcatgaagtgcgacgtggatattaggaaggatctgtatggcaacatcgtcctctccggtggtaccactatgttccctggcattgctgacaggatgagcaaggaaatcaccgccctggctcctagcagcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacaggaaatgcttctaattctttgg

SEQ ID NO: 47315 - DNA, 435 bp, Zea mays
  Clone ID: LIB3066-005-Q1-K1-A9
agaaaaactagaaaccctagcgatgctgcagatccgcctgagcaagattggctcgtcggactccggcggtgccgccgctagcacggcagctggcgccggcgcccccgccgcggatggggcggctgcggcgctcggcggcagcatcctggaatcggtcaccgtggcatgccccgaccacctcgtgatcgcggacctacccgtcgcgaagagccttggtgccgacacggcctccgatgccgccgtcacgcgcgccatcggccgtcgctcccgtcgcccgctcggggagcgcgtccacatctgatcccgatgcgagttccccatcgtcatctacggccgcctgatcccttgtgaacatgccttctggttatcctgcgcaagaagcgattctagctgatatctctgagatgagcgcattcagaagatacaaagtctgaa

SEQ ID NO: 47316 - DNA, 410 bp, Zea mays
  Clone ID: LIB3066-004-Q1-K1-H3
gatctacacctggctcgccaagcccggggccggggtcatgatcatggacccctacggcgccaggatcagctccatcccgcaggatgcgacgccgtttccgcaccggcagggcgtgctgttcaacatccagtacgtcagctactggttcggcgagggcgacggggcggcgccgacgcagtggagcagggacatgtacgcgttcatggagccgtacgtcagcaagaaccctaggcaggcgtacgccaactacagggacctcgaccttggcgtcaacgaggtggtcggcgacgtctccacctacgacagcggcagggtctggggcgagaagtactacaatggcaacttcgagaggctcgccaggaccaaggccaaggtggacccctgcgactacttcaggaacgagcagagca

SEQ ID NO: 47317 - DNA, 358 bp, Zea mays
  Clone ID: LIB3066-004-Q1-K1-H4
acagaccaaggtttggagacagggatgagtaccgtggtggtcctcgtggtgcttccggtgactttggtggcgataagagtggagctcctgctgagttccagccatctttcaggagttctggcgcgaggtctggctttggccgtggtggtggcagcggctttggcgctggcccgacctcttcttccatggagtgaacagtgaagctgcccttagtttggacatgatgtttcccctcccgtgaggcgtttaattttgaaggacggttattatgtactagtaatgttttccggatcggctagtgctgacatgcaaaaaaaaatgttccatatttatacattggttccagtatagtagtctt

SEQ ID NO: 47318 - DNA, 176 bp, Zea mays
  Clone ID: LIB3066-004-Q1-K1-H5
cccacgcgtccgcccacgcgtccgcggacgcgtgggcggacgcgtgctctttcgcgcgggccctagtatctacgacgctactacataccgtacgcctccttcgacaagctttgacgaggggcacggacgatgaatactccgatcgtcgaggtgcagcacgtctttacacgccagat

SEQ ID NO: 47319 - DNA, 427 bp, Zea mays
  Clone ID: LIB3066-004-Q1-K1-H6
cggacgcgtgggcccctgggcaaattgcggtggccggggcccgccgccgcgacagcgccgtccgtcctcggttccgctcctccgtccgatccatacgtttccgttccctataaattctataaattcccgcaaagtcccgtaccgctcagccaacccaacacgacggcgagtcggcggcgagtgggagggaacaccgcagcagcgatgcgtcggggctcgctgccgctgccgctgctgctgcttgcggcggtggcggcggtagcggccaccgcggttcccgccgagccggcgtcgacgctgtccgggccgtcgcggccggtgacggtggcgatcggagacaggggccacgcggtggacctgccggacacggacccgcgggtgcagcgccgcgtcacgggctgggcgcccgagcagatcgccgtcgcgc

SEQ ID NO: 47320 - DNA, 421 bp, Zea mays
  Clone ID: LIB3066-004-Q1-K1-H7
cgacagcttctccacctcctgggcgaaccttccggcggccatgtacacgaggaccggagtgccggtggctttgtgcaggttcaggaagtacccacaggctttgggcgtcggacaaggaagccgtcggcctggtcgtttctcacctgaagaagatgctcccggatgccactgaaccgacgcagtacctggtgtcgcgatggggctccgaccccaactccctggggtcctactcgtgcgacctggtcgcgaagccggccgacgtgtgcgcgaggttcgccgcccccgtcgagaacctgcacttcgccggcgaggcggccagtgccgagcactcggggtccgtgcacggcgcctactcgtcgggcatcgccgctgccgaggaatgcaggaagcggctcctggcgctgaagggcatcccggacct

SEQ ID NO: 47321 - DNA, 291 bp, Zea mays
  Clone ID: LIB3066-004-Q1-K1-H8
acggcatagcacaggtgaacgcgacgatagcatccctggctaataacatcattgtcgggggcgccgtccttacgagactggacgtcctcctgacgtgcgggcccccgaaggtgccactcggcccaaacatcaccaccaactacaacggcaagtggctcaccgctagtgccacctgctacggttagatcaacggagcactgcgctcctgacatcggctgtgcatgctggatcaacaacctgaacctgccacactacagcggactgacgttatgcgccaacgatgctatcttc

SEQ ID NO: 47322 - DNA, 396 bp, Zea mays
  Clone ID: LIB3066-004-Q1-K1-H9
attgagcgcggttcctaaactcggatcctgcattttgtttcggcgatatgtgttggtgttaccagttgctgcagcgatacttccaatttctgtgccgatgggtttcctcgttttcttcttattttgtttcctcgtcgtcgcagcctgcaaattggtagtttcttggttcttatcagtggagctggctttggaatttgcaggcaccgttctgagctgcgctggtgctcctggaaaggtgttggtgcctggaggtggcagtgatgacttgctttcctccgtagagcctgtcagcgacactcaacctgaagaactacagcctttgcactttcatatcaggcattgtgcaatgcctcgtgaattgttggttaaggcaccgtgctggttcttgggctactg

SEQ ID NO: 47323 - DNA, 422 bp, Zea mays
  unsure at all n locations
  Clone ID: LIB3066-005-Q1-K1-A1
gcgtccagtcggatccagaactccggccatccatgtcagaggtggtgcagttgcttctccggtgcgtccagcgcacaaccagcaacaggaggctgggtggccaccgcaccgtctcgcagcgaagcgacgattctgattggtgatgctctgtttctgcctccatcctgctgctgcggcccagttgctgaaactgtctcagaacagaaccgtaggtgtgcggcccttggcatgccgctgtacaaaagaaaatgctttattagacaatctggttgctcgaacagtgtggcaacaaataagtcggttgatttaggtaaaggtaaaagcagattgggtgttctagtgagtagtgacattgtatttgtactcataaacttannaacatatgaccagctaattttaaaaatatataaaccatcttagaa

SEQ ID NO: 47324 - DNA, 424 bp, Zea mays
  Clone ID: LIB3066-005-Q1-K1-A10
gagccaccacaatttgtggctattttccagccaatggttattcttaagggtggtactagcgctgggtataagaaatttgtagaagagaagggtctgaaagatgaaacgtattgttctgatggcactgctctcattcaaatttctggaacagcggttcataacaataaaacgcttcaagttgatgcggtcgcaacatccttgagttccacagattgttttgttttgcaagctaaaaactcgatgtttatatggaatgggaatgcaagttcttttgaacaacaacagtgggctgctaaagttgctgaatttctgaagaccggtgttgctgtcaagcattgcaaggagggcactgagagctctattttctggtcttctattggtggaaagcagagttatacaaatagaaatgctgcacctgatgttg

SEQ ID NO: 47325 - DNA, 445 bp, Zea mays
  Clone ID: LIB3066-005-Q1-K1-A11
gaggcgtacgacgtacgcggacgcgtgggcggacgcgtgggcggacgcgtgggttcacactatcctgacaaaggatgggaagaggcacttgatcaagaaggatgtgccttgtgagactgatcagttgactcatgtttacactttgatcatccgtcccgatgcaacatacagcattctcatcgataatgaagagaagcaaactggcagcatctatgagcactgggatattcttccccctaagcaaatcaaggacccagaggctaagaagcctgaggactgggatgacaaggaatacattcctgaccctgaggacaagaagccagagggctatgatgatattcccaaggaaattcctgaccctgatgctaagaagcctgaggactgggatgacgaggaagatggtgaatggactgcccctaccattcccaacccagaatacaaagga

SEQ ID NO: 47326 - DNA, 422 bp, Zea mays
  Clone ID: LIB3066-005-Q1-K1-A12
ggagaccatggcggaccagctcaccgacgaccagatcgccgagttcaaggaggccttcagcgctcttggacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgaccaggaagtcgatgagatgatccgcgaggccgacgtcgatggcgatggccagatcaac

SEQ ID NO: 47327 - DNA, 463 bp, Zea mays
  Clone ID: LIB3066-005-Q1-K1-A2
cccacgcgtccgcccacgcgtccgcccacgcgtccggaataattttactaatcaaattctgggtgggatatattcctccaattcccctcctcctcccaacaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagcgcggccg

SEQ ID NO: 47328 - DNA, 182 bp, Zea mays
  Clone ID: LIB3066-005-Q1-K1-A3
ctcccgtctcgaccgcacgcgtccgatccgccacatgttcaagacccagtacgcttgttgagagatagatttcctcgtaaatagcggtggttatatcgcacggccagtgctatcatactatctacactgcatcatctattctgagaataactgcaatctttacccctgatactctacattca

SEQ ID NO: 47329 - DNA, 455 bp, Zea mays
  Clone ID: LIB3066-005-Q1-K1-A4
agacgcttgacgccaagcagctcaagactggaatgatgcacaaggggaaggtgaacaggggggacttctcagggccgctgctgtcgcagccccggcgcatcgacgagctcctgcacatccacgagcagcagatccggcaagctggtcgccggccatggttcatgaaaggcaccgaggaggaggagcactgatggcagagacacggcatggacacaactaaacgcccatcagatttgcacgtacttaccacagagcaagagaagatgctggaaacatatcaaaggagttggaccgtgagctagctctcctgatgagcaggtgttttttcagggccggtgacagacaaacgagtcggcctcatgccatcagggaagagctcagatggaagctgctgtagtggttttcaggtttcatgcataccagaattgctctacgcctctacctgaactagacaa

SEQ ID NO: 47330 - DNA, 436 bp, Zea mays
  unsure at all n locations
  Clone ID: LIB3066-005-Q1-K1-A5
tcggtcaacacccatcttagtctttctagagcctttcattaggccaatggtacccggtggaggagggcattcttggccgctcgccaagggcgaagaagttcagcagcaggagcatcgggtttctgaacaacacccagatgtcagcgtggcggacacggagcatgtaccaccggggcaggagcaccccactgatgtgcaagaccacgagcaccctcgcggcggtcatggcgcagatgctgtcccatcgggccacacacgtctgggtgacggacgcagagtcggaggaggacggcgtcgtcgtcggcgtggtgggctacaccgagatcttcaatgccgncaccaggagcacctgcccaagtccgacagcatcttgatgcaccacatcgtgctgtacagtatacttgctgtggttgatccgttggtgccccggtgcacg

SEQ ID NO: 47331 - DNA, 456 bp, Zea mays
  unsure at all n locations
  Clone ID: LIB3066-005-Q1-K1-A6
ccgagagcagagagacatggcgccccaacacccgcagccggcccctggtccggttccaatccggcttcttcctcttcctccttgccccgcccttcgccggcgcgtggggaaaggagggccacatcatggtctgcaagatcgccgagaagtacctgtcggagaaggcggcggcggcggtgaaggcgttgctgccggagtcggcgggcggtgagctgtcggcggtgtgcccgtgggcggaccatgtgcgctggcactaccactgggccagcccgctccactacgccaacaccccccaagtctgcaacttcaagttttctcgggactgccacaattctcgtggccagcaagggatgtgcgtcgtcggngctatcaacaactacacggaccagctctacagctacggccagaagacttcgtataacctgacggagagcctgatgttcctggcacacttcg

SEQ ID NO: 47332 - DNA, 430 bp, Zea mays
  Clone ID: LIB3066-004-Q1-K1-H2
cggacgcgtggggtgctgtacggccggatccagtgcaagggcaagtgcaccgagcagaagggcatcaccgcgccgcagatgaaggtgtgccaagaggcgtgcgacaaggactacgtggtcaaggcggctgaggtcaccaaggcctgcaacaccacctgcgccaaggagaagcagcctctgctcagcgagaactgcaggaggtcctgcacccctcctccttcctgaacgcagagcacgcccgccggtcgtcgtcttctgcctgcttgcgtgacactgaatcactgatacatcatacatgcatgcatgggatgcgatgacgatttgatgcatgcatgcatgggtatacctaccaatttgatgaccgacgatgtatagtttcgtcgactgcttcatacacatatatagcagcccaattaatgtaacgtcacgc

SEQ ID NO: 47333 - DNA, 422 bp, Zea mays
  Clone ID: LIB3066-004-Q1-K1-F8
ggcagaaggagcgacagggtctgctgaaccagaagggctgcgtcgtgtggatcactgggctaagcggttcacggaaaagcacgctcgcttgcgcactgagccgcgagctgcacggcacaagccacctcacgtacgtactcgacggcgacaacctcaggcactgactgaacagggaccttagcttcggagcagaggaccgcacctagaacatccgcagagtacgggaagtagcgaagctattcgccgacgctggcctcggctgcatcggcagcctcatatcgccctacagaagcgaccgaagcgcgtgtcgcgatctgctgcccaagcactcgcttatcgaggtgttcctggacgtaccgcttcaagtgtgcaaagccagggaccccaaatgcctctacaagctcgcacgcgccgacaaaatc

SEQ ID NO: 47334 - DNA, 299 bp, Zea mays
  Clone ID: LIB3066-004-Q1-K1-F9
caccagaccacaaggagggatattcgcaggaccagcagcacccgaggacgaggtgtgtggagaggctgctctgccataccaaaaagcagacagaggaccaaggaaggaagcagggatccggctttgctctgcaaccatgagctccctgtacgacgtctcctgcttcgccgctggccttgctggcaacgtcttcgccctcgccctcttcctgtcgccggtgccgacgttcaagagggtcctcaaggccaagtcgacggagcagttcgatgggctgccctacctgctgtccctgctcaact

SEQ ID NO: 47335 - DNA, 426 bp, Zea mays
  Clone ID: LIB3066-004-Q1-K1-G1
aaaaggtatcagcgtcgccaatctccatggagctcacaggcgccgcgctccggcgatacgcgctgccgtcggcgtccccggtggccgcgagggtggggaggaggaggcgaccagccagggtggcctgcgtcgggggcggggggttcgcggaggaggggcacctcaggtactacgaggtggccccgcggaggaaggcggtggcgagggacctgggaaagctccgggccatggggctcgtcgcgggggacgcagccaaggagaaggtcctctcggaagccacggatcttctgctgcaagagctgagccagatgaaggatgtgggatacaagataaacaaggtggagaaagaacagaatgctgctatgaaagcactgaagaagcaagagaagcgcaccaagaagactgccatcatgatgatgaagtgtg

SEQ ID NO: 47336 - DNA, 270 bp, Zea mays
  Clone ID: LIB3066-004-Q1-K1-G10
ctcactcgtccagccacgcgtccggactaggtttagagagcggcggatagcggccaggcgggggacgcaaagaagatccaggacgacttctgctcgacgctgcgcgacgccaagaagggtacggacctgctcgtgttcaatgagtcctgcacgctatcccaacatttcaacctgcagctgtacggtagtatccatcgcaaggtcaagtgctccgaacagaaagtcataactgctccactcatgaacgttttccatgacgaatactacaag

SEQ ID NO: 47337 - DNA, 352 bp, Zea mays
  unsure at all n locations
  Clone ID: LIB3066-004-Q1-K1-G11
gagtttgtaggagaagttggttagccatagggctatttataagccgcatggcagcagggaataaattaagcaagatcattaccaaaccaatctctctctcttgcaatgaccctctcaagcgcctagggctgctaccctagaaccaagcctgcggcagaggggtataacctcgccggagaagacagttatctccatggacagaaggtccatgacacaattgcacttgtttatgatgttagcggtgtagtgtaatcactattcntgttataatgttaacagtgtaaatgctgctgctaagtacctggtttttagactngtggcatggtctgtttcacttcacattgctatgtct

SEQ ID NO: 47338 - DNA, 303 bp, Zea mays
  Clone ID: LIB3066-004-Q1-K1-G12
gttgccaaagaattccctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaagggtttcacacatagcttcgtcgatttgaatttgatgtactaatggagtctaagggtggcaaaaagtctaaccgtagtcggtctatgatggatgaagcctcccttg

SEQ ID NO: 47339 - DNA, 292 bp, Zea mays
  Clone ID: LIB3066-004-Q1-K1-G2
cccacgcgtccgcgcaggcggcgcagtgcggtgccgagacggtggcgttcgtcaagggcctggagaaaatgccggggggcatgccgaccgtgtgcctgaacgagtgcgtggcctagttccagggcgcgctggtcgacctgcagcggtccaaggtggcggtgcagaaggccaaggacgaggccgccatccacatgttggtgaccgtgcttagggtcaacacatactcagccctgattatagacgatcgcacatgcatggcgactaactacgtcgtcctggatttactctggcg

SEQ ID NO: 47340 - DNA, 430 bp, Zea mays
  Clone ID: LIB3066-004-Q1-K1-G3
cccacgcgtccgcccacgcgtccgcccacgcgtccgcccacgcgtccgcaaagggccatccgctgcggtcagtgtaggtttctgaatcatagcttggcgatgcctgaggctagacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgg

SEQ ID NO: 47341 - DNA, 430 bp, Zea mays
  Clone ID: LIB3066-004-Q1-K1-G4
ctccctggcaaagcccgggctcaacgacaagcttcgccactgcggcatcatggacgtcgagttcagaagggtgcggtgcaagtaccccgctgggcagaagatcgtgttccacatcgagaagggctgcaaccccaactacctggccgtgctggtgaagtttgtggcggacgatggcgacatcgtgctgatggaaatccaggacaagttgtcggctgagtggaagcccatgaagctctcttggggcgccatctggaggatggacactgccaaggcgctcaagggccccttctctatccgcctcaccagcgagtccggcaagaaggtcatcgctaaagacatcatcccggcgaactggagacccgatgccgtctacacttccaacgtccaattctactagactttgaattgccttcgattcatccggcgcggc

SEQ ID NO: 47342 - DNA, 404 bp, Zea mays
  Clone ID: LIB3066-004-Q1-K1-G5
gagcggcccccgtgaggagctcccacacctcgacggctggcctgctcgcgtggcctcagcccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggccgagagcgccgtcgccgccgtcgcaactgcctcccgtgatcgtcaggctagccagatcaccttttcccaggacgggaccgttcctaccaggaaggcaacttcagtggctggggtggcaaggcagcgtgagcttagccataccgtcgagagtgagggggacagtaagatg

SEQ ID NO: 47343 - DNA, 429 bp, Zea mays
  Clone ID: LIB3066-004-Q1-K1-G6
cccacgcgtccgaaggagccgccgcgtgtccgttgtcttctacgtcgtcctcgccgcagctgcagccgcggcgcaggcatccaataacgtcacctccgacgaggattactgggcggagcgcgccgaggtggctcggtcgcgcaacctcgccgcctacgtcagcgaccccgtggccgccacgaaccgcttcaacgcggacgtgctgagggccacgacgcggcgggcgctggcgaggtacgatggcccgtgcatggcgaccaaccccatcgaccggtgctggcgctgccgcgccgactgggcgacggaccggaagcggctggcgcagtgcgcgcgcgggttcggccacaggagcgtcggcggcgcggccggcaagctgtacgtggtgagggacccgagcgacgacgagatgatcatcccgcggaagggcac

SEQ ID NO: 47344 - DNA, 423 bp, Zea mays
  unsure at all n locations
  Clone ID: LIB3066-004-Q1-K1-G7
aacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcngggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagctcgcccgc

SEQ ID NO: 47345 - DNA, 427 bp, Zea mays
  Clone ID: LIB3066-004-Q1-K1-G8
gtgcacgcccccgccaccggccggatcgacagcaccgatcaccctgaccgtctgcgcgcggcggctctcactccggtgacacgcagggcgcgcataggcgagggcctccccccccggcgagggatggtgtggtcggctgggatggcaacaatgcgaggcgcctccgccgccgcgctactggtgctggcgctcgccgccgccgtggcgcgcgcggaggacccctaccacttcttcgagtggaaggtgacgtacgggacgaggaccatcatggggacggcgcagaaggtgatcctcatcaacgacatgttcccgggccctaccatcaactgctcatccaacaacaacatcctcgtcaacgtgttcaacatgctcgaccagccgctcctcttcacctggcacgggatccagcagaggaagaactcgtggc

SEQ ID NO: 47346 - DNA, 171 bp, Zea mays
  Clone ID: LIB3066-004-Q1-K1-H1
ctgacgcgtcatcacagatgctcgtgtaccacacgtggcgattaggtgccctattctgaaggtcactgaacttctaatctgctgcaacattacatacgcttccttggacaatctttaacaaagcttgcccattctgaacactgtaaaccgtatctctcacatggtcattat

SEQ ID NO: 47347 - DNA, 337 bp, Zea mays
  Clone ID: LIB3066-004-Q1-K1-H10
gaattggataagatgagattaggacgctcgcaagctgaatctgtggtgcaaaagatagtcgagcttactagcaatctcataggttctgtcaaaggcgaagaattcgacatttataacttgctggatgatgaaattttaagcacgagcacagcccttgagtacagtttgcataagcataaccaactggaggctgacatagacatgttaaaagaatccttgcgacagaaggacatggatctgactgctgcttataaagcgcttgacgccaaagatcgagagttgaaagccgtaattggaaaggtagatgttaaggataaggaactagaaaacttggaag

SEQ ID NO: 47348 - DNA, 408 bp, Zea mays
  Clone ID: LIB3066-004-Q1-K1-H11
gcctggaacaacatcaacaacaagacggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgagcaggcggccaagcgcgccgaggtggccaggctcagggagctgcacacgctcaagggacacgtcgagtccgtcgtcaagctcaagggcctcgacattgacaccattcagcagagctacaccgtgtaaactcgactcaggttttttatttgtttttttttgcagacaaatacaaaccacacacatatatatatttgtaaagattcgttcgtattttcattttcaccggga

SEQ ID NO: 47349 - DNA, 270 bp, Zea mays
  Clone ID: LIB3066-004-Q1-K1-H12
cagcattacgaggccaaaagtaagctgctgctgttcttcgacccgtcccgttcgttcgattcgttctttccgccatggaggctcggaggaagcccgcggtgtgctgtgcccttcttgtgctgctcatcgtcgcctccagcgcaacggtgtcgactgctcatgacgagagctgctggaaggacgacgaccaccaccctatctgctttcccgaagactgcgtggcgacctgccaggatcacggccacgcggacggccgctgcaactgggcat

SEQ ID NO: 47350 - DNA, 338 bp, Zea mays
  Clone ID: LIB3066-004-Q1-K1-F7
cccacgcgtccggacggaaggactagcgtcatgggcacgcccaccgagacggccatcctggagttcggcctcgaggtggagaagtacaccaaggtggagcacgcggacgccaagaagctcaaggtggagccgttcaactcggtgaagaagaccatggccgtggttatcgcgtccccgaacgcggccggccacccgcgcgcgttcctcaagggcgcgtccgaggtcgtcctgagccggtgcggctccgtcttggacggcaccggtgccgcagagaagctcacggaggcgaaggcgaagcgcgtggccagcgccatcgactcgttcgcgtgcgaagcgct

SEQ ID NO: 47351 - DNA, 110 bp, Zea mays
  Clone ID: LIB3066-018-Q1-K1-C8
cccacgcgtccgcaaaacatggctgtgaatgtgagcaccatgtggtcgttgatgcaggcacggtttgctatggttgtggcgttgtccttcttggtgagcggcgcatggtg

SEQ ID NO: 47352 - DNA, 343 bp, Zea mays
  Clone ID: LIB3066-018-Q1-K1-C9
cccacgcgtccgcccacgcgtccggaggtggagtcttcagacaccatctcgagggtgatagttttgccggtcagggtcttcacgaagatctgcatgcctcccctgaggcgcagcaccaagtggagggtgctctccttctggatgttgtagtcggcaagcgtgcgcccgtcctcaagctgcttcccagcaaagatgagccgctgctggtctggagggatgccctccttgtcctggatcttggccttgacgttgtcaatggtgtcagaggacctgcgcggcatgctcaacatcgggttccagctgatgaccaccatcggcatcctggcggcgaacctgatcaact

SEQ ID NO: 47353 - DNA, 217 bp, Zea mays
  Clone ID: LIB3066-018-Q1-K1-D1
gcaaattaaagagggatcggattggaactcgatcggaaggaaggtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgaacgtgacgagtactt

SEQ ID NO: 47354 - DNA, 412 bp, Zea mays
  Clone ID: LIB3066-018-Q1-K1-D10
cccacgttgtacaaggagtcgtgtgagaagacgctctcccaggccaccaatggcaccgagaaccccaaggaggtgttccacagcgttgccaaggtggcgctggagtcggtgaaaacagcggtcgagcagtccaagacgatcggcgaggctaatgccagcgactccatgaccgagagcgcgcgggaggactgcaagaagctcctcgaggacgccgttgacgacctcaggggcatgctcgagatggccggcggcgacatcaaggtgcttatcagccggtccgacgacctcgagacatggctcacgggcgtcatgacgttcatggacacctgcatcgacggcttcgtcgacgagaagctcaaagccgacatgcacaccgtgctgcgcaacgccaccgagctcagcagcaacgcgc

SEQ ID NO: 47355 - DNA, 445 bp, Zea mays
  Clone ID: LIB3066-018-Q1-K1-D11
cacacgcagtcaactcgttgctgggggtgggatcccggccgagcaccatgcgaggaagtaacatgccgcggcacacgtcgccgttcctttttgccttgttggcgtcggcggcgaccctgctcagcgtcggcgacgcgttggtcgtcgacggcctgcaggtggggttctatggcaagacgtgcccggcggccgaaggcgtcatcagcgacatcgtcaacaacgaaatcgctatggaccggggcatctcccctggcctcattcgcctcttctttcacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggtctcgtgcgc

SEQ ID NO: 47356 - DNA, 431 bp, Zea mays
  Clone ID: LIB3066-018-Q1-K1-D12
aaattcatcaagctcaacacgatctcaattcgattccagttcatccatccaacgcctgccgcctgtacgtatagaagaaagaaggaagaaccgtcaccgtacgtcctcgccagtacaaataatggccctgctcaaagccgcgcgcgtcgccgatgtgcccaccctggacgtggtggtggcccccggcctggtggcggttgccaaggcgaggagcgccgcggcggtgggcggccggttctcggtgatcgggcaccgcggcaaggggatgaacgcgctggcgtcggaggacccgcgtctgcgggaggtccgcgagaacacggtccgctccttcaacgacgccggacgattccccgtcgactacgtcgagttcgacgtccaagtcaccaaaggacgggtgcccaatcatcttccatgacaacttcatcttcaca

SEQ ID NO: 47357 - DNA, 263 bp, Zea mays
  Clone ID: LIB3066-018-Q1-K1-D2
cccacgcgtccgccccatttccgccccccgctcgcgatcggcgaccgcgctccacgaatccggccgcggattcgcgaccgagccttgggccggcccgggctctggttcgcgggcgccgagggagggccgtggtgggtcgcgcggggaatgctctacctcaagcagccgggcggcgcggacgtagagttccggcaggcggcggcggcggctgcggtgctgtgatctgccgctgcggtggatatatgcgagattgagccagcacg

SEQ ID NO: 47358 - DNA, 213 bp, Zea mays
  Clone ID: LIB3066-018-Q1-K1-D3
cggacgcgtgggcaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcacgtttcagctgtctcaaggttgaaacatgagaatgttgtccaactcgtcggatactgcgccg

SEQ ID NO: 47359 - DNA, 315 bp, Zea mays
  Clone ID: LIB3066-018-Q1-K1-D4
cggacgcgtgggctgacgcgtgcgccgacgctttatccgacgcgtgggagatcgcgagcttgggggatacctacaagatgatgcttattaataaatcctatatatatatactatattttataattcctattctctaattattgtataatcttcaataatattgttaatatccaatcacccctcatgattacataagcatttatgattgtataaccaaattatataattttcatatactatgcaattaaaaaatattaataattcattaatttattataaaatatattaattatttattaaaattctatattttta

SEQ ID NO: 47360 - DNA, 193 bp, Zea mays
  Clone ID: LIB3066-018-Q1-K1-D5
gtcaaagggcatcgatgcgaaagcgttcggacctggtggctccttagacataaccaagttgggggcatccagcaatggcaagacagacagcactacatctttgcaggatgcatgggcatcggcgtgcagcagcactggaaagcagacgatgctcatatccagaggtgacttcattgtaggacaactcaatttc

SEQ ID NO: 47361 - DNA, 248 bp, Zea mays
  Clone ID: LIB3066-018-Q1-K1-D6
acgggttccaggacacgctgtacgcgcactccaaggggccgttctaccggaactggattatcggcggcaccgtggacttcatcttcggcgacgcggcggcggtgttccagaactggattctggtgctgcgccggccgatggacaaccagcagaacatcgcgaccgcgcaaggccgcgcggacgcgcgcgaagccacggggttcgtgctccagaagtgcgagttccaggccgaggccgcgcttcgggac

SEQ ID NO: 47362 - DNA, 221 bp, Zea mays
  Clone ID: LIB3066-018-Q1-K1-D7
tgtgtacccatttgtgctgcacacgagtttacggatgggccgagtcgctagctgagtcgtcgtcatcatcaggttgcttgagcactcgagcctctcagagcaaattaaatctaaccgtcgtcgtgtcatccgggtatatttaccttgtacatcgtcttttcatattgcttggtgtgtcagtgttaccgatggaggcataacataaatgatccatgaattcc

SEQ ID NO: 47363 - DNA, 243 bp, Zea mays
  Clone ID: LIB3066-018-Q1-K1-D8
cccacgcgtccgcccacgcgtccgttttcatatactatgcaatgaaaattatataatttggtgatacctgcagcagcaagctaattaagttggccgatatatatataatatataatggaagccctgggctttgattattggggaagccccaaccagaatgcggataggccaccaccccgcatgattacgttagcatttatgctggtataaccaaattatataattttcatatactatgcaatg

SEQ ID NO: 47364 - DNA, 411 bp, Zea mays
  Clone ID: LIB3066-018-Q1-K1-D9
cggacgcgtggggaatttgaagaggtggaagcagcacctgtgttggttgacggccctctagaaccgcaaacgtcaaatatcatgtcaactactactcacattcaagaggatcctttatctgcatttttcagtgcagctgcaaatgctggtggcaattctgctgtagctgttgcaaggcaaccaattcaactttttggtgctactccggtggctacacatgcagctactagtatcactacaatacaatcgccaggcttgcattatttgcttccttcacaagcctcatcggtttctgggatgcctgctgatgctcatggttctataggaaggtccacaaaccttgtaaatccatcacttttctcaccattgacgtcttcacagacaacaatggtgtgcactaattctgtagta

SEQ ID NO: 47365 - DNA, 123 bp, Zea mays
  Clone ID: LIB3066-018-Q1-K1-E1
ccgatccatctgggcgggcgccggcgtcggggccagccaagcttgccatggggcgtcggccgacagggtccacacacacgcgtcgagcgtggtcggacctcgggcgggcggggagccatgacc

SEQ ID NO: 47366 - DNA, 480 bp, Zea mays
  Clone ID: LIB3066-018-Q1-K1-E10
cccacgcgtccgcccacgcgtccgcccacgcgtccgagctgatgatgagcgactacagggtggagatggtgaacgatgggatgcaggagttctttgtagaatttcgtgggcctaacgaaagcatttatcaaggaggtgtatggaaggttagagtagaattgccagacgcatatccttacaaatccccatcgattggtttcatcaataagatatatcacccaaatgtcgatgaaatgtctggttcagtctgtttggatgtcatcaaccagacttggagcccaatgtttgatcttgtcaatgtgttcgaggtcttccttccacaacttctgttatatcctaatccttctgatccattaaatggagatgcagctgcgttgatgatgcgtgatcgccctgcttatgaacaaatagtgaaagagtactgtgaaaaatacgccaaaccaggggatgctggtgtcaccccagaagagcaatccagtg

SEQ ID NO: 47367 - DNA, 454 bp, Zea mays
  Clone ID: LIB3066-018-Q1-K1-E11
accacgcgtacagtgacacttgatgaccaagcaccgcgagcgcttgaaggtcttggaggcagtagatgctgctgtagaacttgggtatagccctgttaaggtcaactgtgtcatcatgcgtggtataaatgatgatgagatctgcaattttgttgaattgacgagacacaagcccatcaacgttagatttattgagtttatgccatttgatggtaatgtttggaatgtgaagaagctagttccttatgcagagatgttggacaaagtgcggcaaagttataaaggagtagagagacttcaagatcaccccacagacactgcaaagaatttcaggattgatggacatgttggcactatttcatttattacatcaatgacagagcatttttgtgctggcttgcatagattacggttattggctgatggaaaacctcaggtgtgcttatttggcccc

SEQ ID NO: 47368 - DNA, 240 bp, Zea mays
  Clone ID: LIB3066-018-Q1-K1-C7
aaacaatccttgcacccctcccctccgtcaccccaccacatccggccagcccaacgaaaatgtggcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactg

SEQ ID NO: 47369 - DNA, 412 bp, Zea mays
  Clone ID: LIB3066-018-Q1-K1-E12
gtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggtgacagccccaacacggatggcatccacatgggcgactcatccgggatcacgatcaccaacaccgtcattggcgtcggtgacgact

SEQ ID NO: 47370 - DNA, 333 bp, Zea mays
  unsure at all n locations
  Clone ID: LIB3066-018-Q1-K1-E2
cggacgcgtgggcaaaggccttcctcccggcgtatttgctttggctcttctcctccacgccataagatatctagcaattggtcactcgccttaattagttcgctttgcttttgaggttgattcgaccattttgctgtagcgtgaattgcatgcatggacatgcaacgctccaatggcctttggaatgtggaatttttttccccattttctgtatttttcctataaaaaatgaactggttcttatataattcctctcaaaaaanaaaaaannnnnnnaaaanaaaaaaaaaaaaaaaaaaaccaaaaaaaaaaaaaaaaaaaaaaaaagggggg

SEQ ID NO: 47371 - DNA, 447 bp, Zea mays
  Clone ID: LIB3066-018-Q1-K1-E3
gtcagaaaatagtgggatcgagttgtttcactgcacgagcacatcctccggcgaccaccggcctgggtctccgtcctctagcgaccgaccaacgcgccgagcgaagatgtcgtggcagacgtacgtggacgagcacctgatgtgcgagatcgagggccaccacctcacgtcggcggccatcgtcggccacgaaggcgccaactggggctaaagcaccggggtccccgagttcaagccccaagagaatgctggcatcatgaaagatttcgacgagcccgggcaacttggcccgaccgggctgatcctgggagggaccaagtacatgggcattcaaggggaacctggagctgtcattcgtggcaagaaaggatcccggggcattactgtgaagaaaacagggcagtcactcatcattggcatttacgacgagcccatgacttccgggca

SEQ ID NO: 47372 - DNA, 347 bp, Zea mays
  Clone ID: LIB3066-018-Q1-K1-A8
agcaatcacagccggacgatccgagcagagaaggggaggtacctgctacgactagctagattccacgcgcgatggcgcccaccaggatccgcgtggccttgctgagcttggcgctggtggggctgctcatctgccacctcgccaccaccgcctccgccggcaagaacagaatccgcatcctcgacagcgtcgacgactcggccggggacaacaacagctccgacgcctcggccggggacaacagcaccgactccgagtcggaaggccgcgtcgtctattccgacatgaagctggctgatgagactggatctgcgccggctccggcaacggcgccggggccgacgacc

SEQ ID NO: 47373 - DNA, 451 bp, Zea mays
  Clone ID: LIB3066-018-Q1-K1-A9
caccgccctggctagcaccacacaccgcaggtatggagaaggcgacgaggctggccttggcagcggcggtggttctgtgcctgctgctggcgaccgggccgcaggaggccgccggcgccgaggggatgctgtcgtatgataagttgctcagctgcaaggtgctgggcaactgcgacaagaacaggggccccggggccacccgcccggggaagcccgtaaacaagtacacccgcggctgcagcccgctgacccggtgccgcggcggctgatcatatctccggtggttctggtcgatgtgcgcgcaacgtcacgcgcgtgcaggcaccagcgccggccggcccctgagggcgggggcaaagggggcaaccgccctggtgggcctcgtaatctggaagaccccaattccgtgtacacattagtatactgcatatgagtttttgcatgtgtatta

SEQ ID NO: 47374 - DNA, 476 bp, Zea mays
  Clone ID: LIB3066-018-Q1-K1-B12
cggacgcgtgggcgccggcggaggagcagcggcggttccagggcgtggcctgcaacatggccgcgtccgaggacgagatcacggagcccggcgcgctgtccatggccttcatacgcaacgtggaggcggaggtgatgaggctggagaacctcaaggagtgccggatgagagaactcgtcgtgaagaagcacgaggagctcaaggagatccgccgccgcgcgcgtctgcccgaggacgacactaccgtcatggtgttcgacgccatggacagcgatgctgagcgtgctatgatcctggagcggctggaattgcagatctccaaggccaaggacctggagttcagccggaaggacgtgctggagaagatggacaggtggcaggcggcgctggaggaggagtcctggctcgaggagtacagcagaaacgagaacagatacaacaccggcaaagggacgcacctcgtgctcaagcgagcg

SEQ ID NO: 47375 - DNA, 292 bp, Zea mays
  Clone ID: LIB3066-018-Q1-K1-B2
gctatgcgtccgcttgtctttcgagtattctttagagtgatcccgaggagaaaagccgtaattgctggacagtacctgatagcataaactttaaagttcggagcaagaatttcccacacgacaaatcatagatacctgcagcaagttatctaatggagcttgcagccatcgactggtttaaggacaccaaacgtatggataacgttgctatgcacaacggttgtgttgctcaggctgctggtgaaaaagggatgcatacattgaatgtcaacatacagattccttgatcaac

SEQ ID NO: 47376 - DNA, 231 bp, Zea mays
  Clone ID: LIB3066-018-Q1-K1-B4
cggacgcgtgggtttcccgagccgggacgtgttggcagacggcgacgttaggaagtccggagagcgcctctgtggcctcgggaagagttatcttttctgcttaacggcccgccaaccctggaatcggttcagccggaggtagggtccagcggccggaagagcaccgcacatcgcgcggagtccggtgcgctcccggcgaatcttgaatattcagaaggcctaattccggct

SEQ ID NO: 47377 - DNA, 273 bp, Zea mays
  Clone ID: LIB3066-018-Q1-K1-B6
atgaacttgaagtttccacaaagcagccaatatttgtgggttctagtgttagtgatacagtggaaacctgtattgcaatgggaaacgagcgtgctgcactcagagtgaagtccgaattcaaggttcctgataagaggtggtactggcttaaaacgtgcgctttagccacagttggaaactgggatggtttggaaaaatttcaggggagaaaaggccaccgggaggctataaaccttttgtggaagcatgcatggatcctggtcaaaaaaatga

SEQ ID NO: 47378 - DNA, 226 bp, Zea mays
  Clone ID: LIB3066-018-Q1-K1-B7
gaggctgatatggatgcaatgtggaaacatcctgatgtgtataaggagtggataaaatctggtgagagacgtggaaatgtacgattctcccatgatgcaaagaacaggccttacctttctcgcgtcgaggtgaaggctgttgccgaaataatcatatcacgccatttgagcacaagaggagtaaaaccagaagctctcgcagcacttgcagaggtttgcagtatgc

SEQ ID NO: 47379 - DNA, 291 bp, Zea mays
  Clone ID: LIB3066-018-Q1-K1-B8
cccacgcgtccgcccacgcgtccgaggaatcatggtgtaaagcactccgtcttgcttctactacggacaaggacaaactcaaatcccatgaaatgctgacccaagagttccgcagttacatgtcctctctgaaagctggatacccttcctttctgggaccctcgacactctccagtcaggaacatgtgcttgtggacaacactgtgaagaatgacggaccttcaaaactccgaggttttctcaaacgattggtgggaaagaaggcatctgccaaggcttctcaggagagca

SEQ ID NO: 47380 - DNA, 441 bp, Zea mays
  Clone ID: LIB3066-018-Q1-K1-B9
cccacgcgtccggctgggcgatgtgcaggccaggatagtcggccctggtttcgatgggaccgtgcaggagttccttgaggaaagcctggggttccaacaggggatggctggtgtcacggttgcggtgctcattggcttctcccttttcttcttcgccgtctacgcgacttctatcaaggttctgaatttccagagaagatgaccagctgcctgagctaagtaagcctccgtggtttgcttttgctactgtgtggtgccaacatcaaagtctacttgctagctactcggcggatgccggatggatgaagcacccgttggtcgtaggattgaagttttcacacgtagagaggatggtagataattaaaggttcatgtctgtatatgattactatcgcaaatataatgagcaacagtagtgatgcatttgtgctgtacgtaaga

SEQ ID NO: 47381 - DNA, 273 bp, Zea mays
  Clone ID: LIB3066-018-Q1-K1-C1
cccacgcgtccgcatcgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgccttcggcaatggcaagacagacagcacgaaggctgtgcaggaggcatgggcatcggcgtgcggcggcactgggaagcagacaatcctcatacccaagggtga

SEQ ID NO: 47382 - DNA, 484 bp, Zea mays
  unsure at all n locations
  Clone ID: LIB3066-018-Q1-K1-C10
cagagagagagagagagaccgacgcgccggcagatcccaagttcaccggagagggggaagagggcgaccgaaggcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgccggccgtcgggacccctacgacgacctcatcgcccgccactctggctcgccgccgtcttcctgaacacccgttccgatctttgcccagaaggtctacttgggcatcaataagaaactctttcccctcaaactgattgtggntccatcctcttctgtctggaaaatgttgtcaccaaactaccctatt

SEQ ID NO: 47383 - DNA, 434 bp, Zea mays
  Clone ID: LIB3066-018-Q1-K1-C11
ccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacaacggcgacgatgacagcggcggcttcggtgtaggcctgggcagcactggtggcggtggccgcatcggcggcggaggactcggcttctcgtcctctgccggtggtgggcacggggcttctatcccacaattatcttctcacagcagc

SEQ ID NO: 47384 - DNA, 422 bp, Zea mays
  unsure at all n locations
  Clone ID: LIB3066-018-Q1-K1-C12
cccacgcgtccggctgttccccaaggtgtgcatgcacgcgctcaaggacaacccagagtgccaggcggagacggcggtcaccccgcgccggctggccgagctgctcgtgtacgtgtcggccgaggtgggcatgaccgtggccgcgttcgcgcaccacgagcccaacgccatcaaggacgacgacgtcctgtacaagtgcatcgacacctgctccgaggacatcgaggaggccgtggcgcacctcagcgccctctcccgcgacttctccgacgccaggttcctcgaggtcaagtcctggctcacctccacgctcggcggcaccgncacctgcgaggacgcctgcaaggacgcccccgtcagcgacatcaagaacgtctgcataaccaagagcttcgagttcgagaagctgctgcgcgtcacgc

SEQ ID NO: 47385 - DNA, 304 bp, Zea mays
  Clone ID: LIB3066-018-Q1-K1-C2
catctacgacatctgccgccgatcccttgacattgagcgcccaacctacaccaacctcaacaggcttgtgtcccaggtcatctcatcccttactgcctccctgaggttcgatggtgctctgaacgtggatgttaacgagttccagaccaacctggtaccctacccgaggatccacttcatgctttcttcgtacgctccagtcatctctgctgagaaggcctaccacgagcagctctctgtggctgagatcaccaacagtgccttcgagccatcttccatgatggccaaatgcgacccacgccat

SEQ ID NO: 47386 - DNA, 251 bp, Zea mays
  Clone ID: LIB3066-018-Q1-K1-C3
cccacgcgtccggaagccgtggtccctgtctttctccttcggccgtgccctccaggcgagcaccctgaaggcctgggctggcaaggtggataacttggagaaggctagagctgccttcctcgccaggtgcaaggccaactctgaggctaccctcggcacctacaagggtgatgctgccgacgacaccgagagccgtcacgtcaaggactacaagtactgagctgcttctctttgcgtgcccgttttggaac

SEQ ID NO: 47387 - DNA, 287 bp, Zea mays
  Clone ID: LIB3066-018-Q1-K1-A5
attcctcccaacaccacctcgcctgcgatctccgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaagagaaccgccgtgccctccgtgagctcctattctgctgccctggtgctctccagtacatcagcggtgtgatcctcttcg

SEQ ID NO: 47388 - DNA, 237 bp, Zea mays
  Clone ID: LIB3066-018-Q1-K1-C4
gtacaccttgcgtactagaggataagctgtcagaaatcacgaacggtacagtcctggtaaactacgggacatcagccgacacgcatcaagtcgggagatcggagccgtcttactggacctagagggcgggttctttgggggcagcagctgcacacttgagctcatgacagtcgttcacgctggtgccggaagtgcataaggtcaagatgtcacacaggagctgcatgatcagagtgc

SEQ ID NO: 47389 - DNA, 275 bp, Zea mays
  Clone ID: LIB3066-018-Q1-K1-C5
cccacgcgtccgcccacaggatccgagagacctcacaagccgccacgccagttccccatccggtcgcggcgcctaccccacccgccctgctcccgcccggtagtagtagcagagcctcgccgacgctgccgagaatagatggggttcgtgtccttcgtcgggcgggtgctcttcgtcgccgctttcctcctctccgactaccaggagtttaatgaatttggcgctgatggtgggccatcagctaaagcccttcagcccaaggtcaagggggttgg

SEQ ID NO: 47390 - DNA, 373 bp, Zea mays
  unsure at all n locations
  Clone ID: LIB3066-017-Q1-K1-H10
cccacgcgtccgcatcagccgcacccgagctagccagttgtatagcgacgcccacgcccggagcacacacgtatgtggcgcgcgctcgcacttgcggtcctcctcctggccgccgccgcggtggcgccgctggcctccgccgacggcgtgaagtccgtccccatccccggcgccaaggaggccgccagcggcgccaagatgttcgacagggaggccgacgccggtcacgacccggtcagcggcctgccggccgacccggcgcccgacgcgcgcccctaaggctacgcaccgtcgtcgttgtcgtcaccgncgtcgccgttccgacccgtttccgctgaacaccacgcgccttgtacgtgtgcttgtgatgttc

SEQ ID NO: 47391 - DNA, 443 bp, Zea mays
  unsure at all n locations
  Clone ID: LIB3066-017-Q1-K1-H11
gcgaccccggtgagcgtggaggaggcgtgccgcggcgcgtccgagacgcacgccggcgtggcgtacgaccactgcatggcgtcgctgggcgccgacccgcgcagcaaggaggccggcaacaagaacatgcacgggctggcggtgctggccaccaggatggccatcgaccacgccgccagcaccgagtccaagatcgacgacctcgcggagctggaggcggcgtcgtcgtcggatccgcaggcgcgcgcccgcttcaaccactgcctggagcagtacggcggcgccgtcgacctnctccgcgacgcgctggacaacctcaaggcgaagatctacggcaaggccatggagcagctgaccgccgcaatgggcgcctncgagagctgcgaggacgcgtggaagggcgnagaggagggatgtcccgtcgncgngcacgacagggagta

SEQ ID NO: 47392 - DNA, 480 bp, Zea mays
  Clone ID: LIB3066-017-Q1-K1-H12
cccacgcgtccgcccacgcgtccgcccacgcgtccgcccacgcgtccgctcgcggtggtgcgtgctcctcctcctccggctgctcccggggcgggcgctctcctgttcctcctcctcctgctgctggtgccagggccgggagggcggcgtggaggtggcgctcatggggctcgccggggacgggtcggcggacaccgccaacctcagtaatagtgaaaatggtcggttcagttatggagttgcaagttctcccgggaaaagagcatcgatggaggacttctatgaggcaaggatagacgacgttgacggagagaaagttggaatgtttggtgtgtatgatggtcatggaggagtcagagcagctgagtacgttaagcagcatcttttcagcaatttaatcaaacacccaaagttcatcactgataccaagggccgtattgctgaacttacaaccgcacaggatcagaatttctgaaagct

SEQ ID NO: 47393 - DNA, 304 bp, Zea mays
  Clone ID: LIB3066-017-Q1-K1-H2
cggacgcgtgggcgagaggagaaccaggagcctgcaataagagccagccagagaaactaagaaaagtctcgccggcggcgtccgagcgaacaagccaaccgaccccgttcccaaggcaatccgtcgtctacttaccaccaccaccgcaggatccagatggaaatgtagagtatcctcttcgacgtcctactcgtcatctccgtctcggtcaccttagagctggcctacaccgatgccgccctcttatgctctacatctgcatacgagtcattctcgatgctccacttgacactcctcttgctct

SEQ ID NO: 47394 - DNA, 473 bp, Zea mays
  Clone ID: LIB3066-017-Q1-K1-H3
cccacgcgtccgcccacgcgtccggcacgcctcggccgaacagttccccgagtccccgactggtctgtgtctctctattggcgacgactgggctaccgccgccacaggcgccctacgccaggtgtccaggtctcgggcccttctccggcaccgagcacccaccagcggaatataccatggaggtcaggcccatggtagctctgcgtgccgccctagttggtggggtagcggcatttgcgaagatcggtggggcgatgaaagccgcaggcggtgtcaagattggtgcagccgctgcagccgtcacggctgcaacatcagctgccatatcgggaaaagacgcataagaagacacttcaaagccggaaacgaaatgatatgacccatggattggtcgacaagtatgaaatcgcctctccagaggtgtagaagagagagggtgccatagtcaataagttacaggagtaaattttgat

SEQ ID NO: 47395 - DNA, 470 bp, Zea mays
  Clone ID: LIB3066-017-Q1-K1-H5
cccacgcgtccgcccacgcgtccgcccacgcgtccgcccacgcgtccgcccacgcgtggcgggcacgcgtccggtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcaggaggcgtgggcatcagcgtgcggcggcaccgggaagcagacgatcctcatacccaagggcgacttactcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggcaa

SEQ ID NO: 47396 - DNA, 471 bp, Zea mays
  Clone ID: LIB3066-017-Q1-K1-H6
ggaaaattttgcggggcgggaatgtgcccgaccgtttgcagatttcatcaatatgtgctggaaaagtgcagcgcttcaataggttcctatccaaaccataggatcatttggcatacaaatgtatcgaaacctgttgctggggtcccagctgcttggcttgaacaatgattccatcgacgtcgcggagtcccctttcggaataacagatgggaagacatagggtaaatacagcaaagcgaagcgagcatgtaggccacagtagtcagtctgttgttccgaaagatgtgtatatatgtattagcagcatgattgttctgattatctttttactgattttcgatggtaggtctgttccatcaagtatttaactaatcatttgttgctgttggtataggtcttttgttcttttagccgtcgttttgcattgaagatatgtagccaaaattaaaaacctgtgtcgaacagttatgt

SEQ ID NO: 47397 - DNA, 458 bp, Zea mays
  Clone ID: LIB3066-017-Q1-K1-H7
agaagttccattctgatgttgctggtaggagctttcacaatgggaggtttatacagaggaggcgtcagaaagctgcgtctttgcccaatgttcaattagaacaaggaactgttacatcacttcttgaagaaaatggtactgttaaaggtgttcgatacaaaaccaagtcaggtgaagaactaaaagcttatgcgcccttgacgattgtatgtgatggctgcttttcaaatctacggcgtgccctttgctctccaaaagttgatgttccatcatgttttgttgggctggtattggagaattgccaacttccacatccaaaccatggccatgttatcttggccaatccttcgccaatcctattttacccaattagcagcacagaggtgcgctgtttggttgatgtccctggtcagaaggtgccttccatagctagcggtgaaatggcaaattatctcaaa

SEQ ID NO: 47398 - DNA, 458 bp, Zea mays
  Clone ID: LIB3066-017-Q1-K1-H8
cgccgtcctaccttcatatacctagcagtgtctctgcatagaaagataaaaggtaggaggaggcgcagtgcgtggtgggattatttgtgaggagatattggagttattatatatatatatatataggtagacgatagatagacagctagatctatataaccatggtggatgggttccgatggatcagaccgggctctttcgtcctgtacttggtcttcttcttcctgtccgcagccctgtcggaggccaatatcggcgacttcgatgaatactggcagcagcgcaagctcatggccgacgccgcggctgaggccacgtacaagcatgacccggtcgaggtcgccaaccaacttaaccgtgcagtccacagatccgtcgagaaggaggacattggcacgaggcgggagatgatggggacgacgactaggaagtctaagttcagcgggccgtgcaaggcg

SEQ ID NO: 47399 - DNA, 400 bp, Zea mays
  Clone ID: LIB3066-017-Q1-K1-H9
ctgtatgtgatctctggtgttggtggcagcttgctgtcttctctatttatggtgtcaaatatggcagtcggtgcttgaggtgcattatttggactattgggctcaatgctgtcagagctcataacaaattggacgatatatgagaacaagtttgcagcactcttgactctagttatgatcattctcatcaacttagctgttgggatccttccacatgttgacaacttcgctcaccttggaggatttatgtcagggttctgtcttggttttgtgctgctaatgcgaccacagtttggatatattaaccaaaagaactctcctcttggatttcccatgggcgtaactaaacggaagttcaagacatatcaagtcatacttttggttatttctacaatgatac

SEQ ID NO: 47400 - DNA, 224 bp, Zea mays
  Clone ID: LIB3066-018-Q1-K1-A1
cccacgcgttcggcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcagtcaccgggcacggcggcaacttctaccaggacacagagatgacctcgggcgat

SEQ ID NO: 47401 - DNA, 444 bp, Zea mays
  Clone ID: LIB3066-018-Q1-K1-A11
cagctataacaggatcaagagcctggtgaccgaggagttgaagcagtatttccggccagagttcttgaacagattggatgagatgattgtattccggcagctgactaaattggaggtgaaggagattgctgacattatgctgaaagaagtgtttgacaggctgaaggccaaggagattaatctccaggtcacggagaagttccgagatagagttgttgacgaaggttataacccgagctatggtgccagacctttgcggcgtgctatcatgaggcttctggaggatagtctggcagagaagatgctggctggtgaggtgaaagaaggtgactctgccatcgttgatgtggattcagatggcaaggtgatagtcctgaatggtggtaacggtgttgctgagccactggaacctgctctcaatacctaaccgaggtcaaaatcatc

SEQ ID NO: 47402 - DNA, 456 bp, Zea mays
  unsure at all n locations
  Clone ID: LIB3066-018-Q1-K1-A12
cccacgcgtccgggcatggcgatggggatgccgccgatgagcaggacgaggaggttggcgatgccatcgcatgaccgccatcgaggagatggccggcatggacgtgctctgcagcgacaagaccggcaccctcaccctcaacaagctcaccgtcgacaagaccctcatcgaggtgtgcggcaagggcgtcgacaaggacatggtgctcctctacgccgccagggcctcccgcgtcgagaaccaggacgccatcgacacctgcatcgtcggcatgctcgccgaccccaaggaggcccgcgccggcatcaaggaggtccacttcctccccttcaacccggtggagaagcgcacggncatcacctacatcgacggcaacggcgactggcacagggtcagcaagggcgcccccgagcagatcatcgagctgtgcccgatgagcaaggatgccgagaagaa

SEQ ID NO: 47403 - DNA, 330 bp, Zea mays
  Clone ID: LIB3066-018-Q1-K1-A2
gcacacgcgaccgacgacgcgtggggtacgaccaccagcaagcgtgcggattcacgtgatcaacgccactgtcgccggaatcaaactactcaactccaagttcttccacatcaacatcgacaactcagagagcatcaccgtgaaggacgtgaacatcaccgcgcccgccgacgttgagaacacggacggcgtccacgtcggaggctcctccaagatcagcatcctcaactcgaccatcggcaccggcgacgactgcgtctcgattgggcccgggtgcaacggcgtcttggtggacagcatcacctgcggccccgggcagggcatcagcgt

SEQ ID NO: 47404 - DNA, 141 bp, Zea mays
  Clone ID: LIB3066-018-Q1-K1-A3
cccacgcgtccgagttgatcgatgtactaagaacaggatgtcaggacagctagattgattgtgtaatttgtaaccatatatgtatcgtctgatgacattatgggcgtgtttgtttgctgtctgcgaggcagcttttcatct

SEQ ID NO: 47405 - DNA, 392 bp, Zea mays
  Clone ID: LIB3066-018-Q1-K1-A4
actcagttgaggtactctgattgtttttgaaagctgggatctactgcaggagtttgagcttcagcatgaggtggaagatgcacatcaatggatattggtgccatctggtcaattcccaaccagatcagtctactagtctgtatttcatgggtcagtacagttcttaccaagcaatttgatctggaaaacctgtcttcgaaggaaatgcacgtgctttctatggtaggctgcacctaactgtagctggacaactgatacactagctcgctgcagcctgcctcacccagaacattgtctgctttgtgaccagctagaggagaacactaattacattatattatcatgtgactttgcacgacaatttttgcaccaccttttgggcattggcgggg

SEQ ID NO: 47406 - DNA, 412 bp, Zea mays
  Clone ID: LIB3066-017-Q1-K1-G9
cccacgcgtccgcccacgcgtccgcccacgcgtccgcccacgcgtccgggcgacggcgccacggagactgtgatcatgggccacaagagcttcatgatgaacatcaccaccaaggacacggccacgatggaggcgatcgggaacgggttcctgatgcgcgggatcggcgtgaagaacacggcgggagccaagaaccaccaggcggtggcgctgcgggtgcagagcgacatgtcggcgttctacgagtgccggttcgacgggtaccaggacacgctgtacacgcacacgagccgtcagtactaccgcgactgcgtcatcacgggcaccatcgacttcatcttcggcaacgcgcatgtggtgttccagaactgcctcattcaggtgcgcaagtgcatggacaaccagcagaaca

SEQ ID NO: 47407 - DNA, 469 bp, Zea mays
  Clone ID: LIB3066-005-Q1-K1-F1
ccttgaagaaggttgttctttctgatggtgcagtcgtaacagtgaagggtgctagagctgggagcctccgtttgccgcttgaattaccacttcctctcaaccgtaccacttacaagggtcgcctctcaagcctgatatccatcgcacaagccctgcgtggtgcagcccggtctaatcagaaacccctgctctctcttcgcgttgagggtccagtttccttgtcctcgactccttccatgtctcccaaggacaagctcaagctcaaacggttggccccaggccaagtggagctctcctcacaggcgggggcaatccctgctatcaccgaagacgaggatgaaccacataaccctggattgtggcctcttttgtctctgaatggttcagatggcagcctgcaggggtttgaagagctattggcctcagtacttggaaagaaggcaggcgagaagggtcccttcaagctact

SEQ ID NO: 47408 - DNA, 428 bp, Zea mays
  Clone ID: LIB3066-005-Q1-K1-F10
cagcgtggcgtttgtcaacaacaaattcgtaggatgtgggcacgggaccaagatgaacaaggcgtggacgctcgagaagcccatggacctgaagaagggcgtgaaccacgtcgccgtcttggcatcgtcgatgggaatgacggacagtggcgcttacatggagcaccgtctggccggcgtggacagggtgcagatcacgggcctgaacgcgggcacgctggacctgacgaataacggctggggccacatcgtcggcctcgtcggcgagaagaagcagatctacaccgacaagggcatgggcagcgtcacctggaagccggccgtgaacgacaggccgctcacctggtacaagaggcacttcgacatgccgtcgggagaggacccggtcgtgctggacatgagcacgatgggcaagggcatgatgttcg

SEQ ID NO: 47409 - DNA, 128 bp, Zea mays
  Clone ID: LIB3066-005-Q1-K1-F11
cccacgcgtcctaaaaaaaaaaaaaaaaatttaaaatttacataaaaatcaaaattaaaaatgaaattgttataaaacaaacaaatatacataaacaaatatatttaaccaataactcatatataaaa

SEQ ID NO: 47410 - DNA, 438 bp, Zea mays
  unsure at all n locations
  Clone ID: LIB3066-005-Q1-K1-F12
agaggatcggatcagaagaaaagaatagttaggtcccggtggtcgatcgaacgaagctgctgctgctaccggccggccgggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtagatccgacctgcaggaggaggcaacagctaccgtaataaccaaagcggaagcacaagaggcttcagctgaaggtggcgattaacctacctaaccatattatttattcattcatatgcatgcatccttgntgctatg

SEQ ID NO: 47411 - DNA, 461 bp, Zea mays
  Clone ID: LIB3066-005-Q1-K1-F2
cccacgcgtccggccacattcaccatcaccaacaactgcggctcgacggtgtggccggcgggcaccccggtgggcggcggtacgcagcttgaccccgggcagacgtggaccgtggacgtgccggcggggacccagtccggcagggtgtggtggcagcctcccatgacgctggccgagttcaccatcggcggcggcggcagccaggacttctacgacatctcagtgatcgacggctacaacctgcccatgctcttctcgtgcagcaccggcgtgaccctcaactgcggcgggcccagctgccccgacgcctacctgtttcccagcgacaacaccaagacccatgcctgcagcggcaacagcaactaccaggtcaccttctgcccgtgagatcgcgcgtgcgaggcatgcggcagtgtggccggacgatgttgcaatatgcaatgcatgctccagcggtccag

SEQ ID NO: 47412 - DNA, 473 bp, Zea mays
  Clone ID: LIB3066-005-Q1-K1-F3
gctttccaaagccttggtgtggtgtttggggatttaggcacatcacctttatatgtcttcggcaacattttccctcatgaaattgaagacacggaacaaattattggagcactctcgcttgttatttactcccttaccctgattccacttgttaagtacgtgttcattgtcttgagggcaaatgataatggccaaggtggaacatttgctctttactcgttgctttgccggcatgcaaagataaacactattccgaatcagcatagaacagatgaagaactaacaacatacagccgccacacatatgatgagaaatctcttgctgcaaagatcaaaaggtggttagaggggcaccaattcagaaagaatgtcattcttattcttgttctttttggtacttgtatggcagttggagatggaatcctcactcctgcaatatcagttctttctgcaactggaggaatacaagtgga

SEQ ID NO: 47413 - DNA, 471 bp, Zea mays
  unsure at all n locations
  Clone ID: LIB3066-005-Q1-K1-F4
cggacgcgtgggcggacgcgtgggcggacgcgtgggcggacgcgtgggctgatcgacaaggtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctnctaccccatcatcatcgaccagaagtactgccccaacaacatctgcgtcaagtcccgc

SEQ ID NO: 47414 - DNA, 447 bp, Zea mays
  Clone ID: LIB3066-005-Q1-K1-F5
cccacgcgtgcgcccacgcgtgcgcacacgcgtctgctgacccctttacattctctctctcgggcacgtattcgccggcgtggaatttgctccctcggcattctaccatttatcaatgcacagattgtgtttcaactccttgcgcaactctacccaaaattgcaagaccttcatcggaaagaaggggaagcaggaagaaagaacgttcttcactatacaagatatgcttctgttggatttgcaattgttcaggccattggacaagttctttatctccgtacctatgtgaatgatttcagcacagaatgggttctaacatctgtgacattattgacacttggatcggtctttactactttcattggtgaaagaatatctgatctgaaacttggaaatggaacatcacttcttatatttacaagtataatatcatatttgcctgcatca

SEQ ID NO: 47415 - DNA, 369 bp, Zea mays
  Clone ID: LIB3066-005-Q1-K1-F6
gctgactcggcattgaaccattcatcaatgcacacattgtgtaccaactccttgcgcatctctacccaaaattgcaagaccttcagcggaaagaacgtgaagcacgaagaaagaaggtacttcaacatacaatatatgcttctgttgtatttgcaattgatcatgccattgtacaagttctttatctccgtccctatgtgaatgatttcatcacagaatggctactagcatctgtgacattattgacacttggatcggtctttactactatcattgaccaaagaatatctgatctgaaacttggaaatggcacatcacttcttatatttacaagtataatatcatatttgcctgcatcatttgagagga

SEQ ID NO: 47416 - DNA, 475 bp, Zea mays
  unsure at all n locations
  Clone ID: LIB3066-005-Q1-K1-F7
caaccgaaaccgatggcgtcgggctcccgcggcggcggcgggagcgacttctccgtggtcgtggtgggctccgacgtcgccgaggcgaacgcctgcttctccgacctcgaggagcgccaggtcgtgcgcgtccagggcaccgatcgggcccgccgaaccatcgtccgcgtcgtcggcaagttcttcccggctccagcaattgatggtgaacgtctgaaaaagtatgtgttctacaaactccacaccgaattgcctgtgggtccattctgcatcttgtacatgcacagtactgtgcagtctgatgataacaaccctggagtgtcaatcttgaggacaatttatgaggagctttcacctgagtacaaggaaaggcttcaggttttctacttcttgcatcctgggcttcgctccaggctggccatcgccacacttggcaggctatttntaagtggagggttgtattggaaaatcaagt

SEQ ID NO: 47417 - DNA, 460 bp, Zea mays
  unsure at all n locations
  Clone ID: LIB3066-005-Q1-K1-F8
ggctggttcgtggatgccggcgccacaggctctcctgctgtcgctgctggtcgccgtgctaggggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaagtgcgctgcgtggacagccctagcgggtgcaagcccagcgcggcgacactggtggtgacggcgaccgacctgtgcccgtccaacgaccagcagtccgcggacagcggcgggtggtgcaacccgncgcgggagcac

SEQ ID NO: 47418 - DNA, 357 bp, Zea mays
  Clone ID: LIB3066-005-Q1-K1-F9
cattaatagcctggtggctggcagagagatcaccgggatcgcgagcttcaagcctgctgtgtcagcggaatcacgcctgtgaaagttgtttttttctttgttcccgaagacagtagaaatcaaccttgtacattcatatgattgggaataagaccggtaggaaagctgtaaaactcgacgtgcttcctcgtatgtactgttctgtttaaaattattcgacgttttgtcggaacggaacggaggacctgtatggctgtatatgatactaatcctatatatcacgcagtttttgaagattttgtaaaaaaaaaaatgaagtgcaaaatccttaacatacaaaaaaaaaaagggggcccc

SEQ ID NO: 47419 - DNA, 468 bp, Zea mays
  Clone ID: LIB3066-005-Q1-K1-G1
cggacgcgtgggcggacgcgtgggcggacgcgtgggcggacgcgtgggcggacgcgtgggcgcgtgcgtacattaatctaagcgatcttcatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaact

SEQ ID NO: 47420 - DNA, 420 bp, Zea mays
  Clone ID: LIB3066-005-Q1-K1-G10
cacaactatatcaagaaatcacaggttcttgacgactgccctggtgatctgaatgactggggccggcacacatctaaaggcgcatggccattctccaccgcggatcatggttggcctatatctgattgcactgctgaaggactaaaggcttcattattgttatcaaagatttctcctgaaattgttggtggaccgatagaagctaatagattttatgatgctgtcagttgtctgatgtcttatatgaatgataatggtggttttgcgacttatgaactcacaagatcctatgcctggctggagctgatcaatcctgctgagacctttggggatattgtgattgattacccgtatgttgaatgtacatcagcagcaatccaggccctgacatcattcagaaaactataccctgggcaccgc

SEQ ID NO: 47421 - DNA, 438 bp, Zea mays
  unsure at all n locations
  Clone ID: LIB3066-005-Q1-K1-G12
aggacagcgacatattcaagtgctacgacagctgctccgacgacgtggaggaggccgtcgggcaccgcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgtcctgccaccctccaacgccggagcgccctcctacggcgcggcggcgccttccgggggctccgncgatgcccccgccggcgcctccgagggccctgcgagcgccagcggcccgtctggtgacgacgcgccggcgtccggtgctggtg

SEQ ID NO: 47422 - DNA, 382 bp, Zea mays
  Clone ID: LIB3066-005-Q1-K1-E9
acggcagcgtctgatctttgctggcaagcagctggaggatggtcgcaccctcgcggactacagcgtccagaaggagagtacccttcaccttgttctccgcctcaggggtggtatgcagatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccttagcagactacaacatccaaaaggagagcacccttcaccttgtgctccgtctccgtggtggtcagtaagtcatgggtcgtttaagctgccgatgtgcctgcatc

SEQ ID NO: 47423 - DNA, 427 bp, Zea mays
  unsure at all n locations
  Clone ID: LIB3066-005-Q1-K1-D6
aaactgcgccgcagggagggccagaggcttcttctttgaaccacgaaccggctccccgccaggagaaaaaaaagccgacgacaaagaaaaagcgcttctgggctccgtcgtcgcatgaagaaggaaaccatggaggggcatgtgccattgccattgccattgctcccggacggagaaactgcggtgggctacagcaaggacgccgnctnctcctcctcggcggctctctcgcctctgcaagaggagatttcgagcctgcgatcgaggcagcggcgtgttgacaggagacggcgggaggcgctcgacaggctcgttgacctgaaaagaagcgttagggtcttctgccgggtccggccgctggctcacacgaacagcttgcatgcccaatcatcaccttgtaccgtcgagcangagaggatcacggtca

SEQ ID NO: 47424 - DNA, 497 bp, Zea mays
  unsure at all n locations
  Clone ID: LIB3066-005-Q1-K1-D7
ccgtccgggagaagtaccccaaggtgccataccaagaaatttctaagggccttgcnnttgataggtanntggtcctgataggggggttcttgactnacgccgtatcacagagnngctggttttacctggcnnattggtgttggtgccagcttatcnatggtcttcggcctattattagagtttatgacatnttaatnttctcgatgcaggcttattgatcatatcatcaattcagctgccaagtcaaattatatgtcagctggtcagatatctgttcctattgtttttagaggaccaaacggagctgctgctggagttggtgctcaacactcacagtgttatgcagcttggtttgcacatgttccaggacttaaggttctcacaccatactcttcagaagatgcccgaggcttgctcaaagctgctatcagggaccctgatcctgttattttcctggaaaatgaattgctttatggagaatctttcccagtttctgc

SEQ ID NO: 47425 - DNA, 447 bp, Zea mays
  Clone ID: LIB3066-005-Q1-K1-D8
cccacgcgtccgatggaagtagcaatggcacctgaatcagctacaaaccatgatccaatccgggcggctagcgatctctagtttatattacaattaggagcaagcgatccaattatcgatagagcgcgagatcgatcgatcatgccgggccgctcggtggtctccatcctgctccttctcctccatggcctcctctgcctgcagctggctgccttggccgagatggacgacgacgacgtcatggaggacggcagctgcatgcatttcagtgtgtccccgacgcctgctccgccggaggacgcggatgagcggcgcgactatttccgcgccatgcatgccaaggatctgttccggcacgagcagatgatcacgatgatgggcagcgaccggaacggcagcagcaggaggcggctggcgaatgagtcgtccaagctgccggaggtcatg

SEQ ID NO: 47426 - DNA, 402 bp, Zea mays
  Clone ID: LIB3066-005-Q1-K1-D9
tgatcgagctctgccaggagctcatcgtgagcagcgacaagaccatcgacgggcgcggagcgcaggggcacatcgtgggcgcgcagatcacgctgcagaacgtgcgcaacgtgatcctccacaacctgcacgtccacgacgccgcggcgcacggcggcggcgcgatccgggactcgcagcaccactggggcgtgcgcggggagagcgacggctacggcgtcttcgtgatggggtccagcgatatctggatcgaccacctgtccatgagcagctgcgcggacgggctggtggacgcggtggaccgctacaccgacatcaccggctgcaacggccacttcacgaggcacgaccacgttatgctgatcggggccagcgacgccgtgttcaaggacagggagatgc

SEQ ID NO: 47427 - DNA, 468 bp, Zea mays
  unsure at all n locations
  Clone ID: LIB3066-005-Q1-K1-E1
caaagattcattgggagatggtgttgtcagaggaagaatactgatcacaactcggaacgaggaagtggcaacaagcatgaaggcaactatccaccatgttgacaaaatggaccctgagagtgcctgggcattattgtgcaatcaagttgatgcagaatgcaattcggaagagcttgcaacattaaaggatgttgggattaagattgcagagaaatgtgatggccatcctctagcaatcaaggtcattgcaggtatcctaaggtcaagaggcaacagcaaggctgaatgggagatggttctgaacaatgattcttggtccatgtgcccaatccttccagaagtaccacaagccgtgtatgttagttatgtcgatctttcttctcaactgaaggagtgtttccttcattgctctctgtatccagaagaattccctattcagcgctntgctcttgtgcggcgttggattgc

SEQ ID NO: 47428 - DNA, 437 bp, Zea mays
  Clone ID: LIB3066-005-Q1-K1-E10
gattccgacaccgctgggctcagatgccgtcgccgacgccgccgccgcagcagcagcagcggcagtccggcatgactctctgccgcctccccacggccactcttggccttcccctttctctcccctgtttgctacctcgttcccgcccccgcctgtgcttcgccgcacgtcatgccagggccgtcgccgccagggcttcctcatcctctccatcaccggactcttcattcggttcgcggatggaggagtccgtcaagaagacggtggccgacaaccccgttgtcatctactccaagtcatggtgctcatattgcatggaggtgaaggcgctcttcaagcggatcggtgtgcagccccatgttatcgagcttgaccatctcggtgctcaaggaccacaaatacagaaggtattagagaggctgactggacagtctact

SEQ ID NO: 47429 - DNA, 427 bp, Zea mays
  Clone ID: LIB3066-005-Q1-K1-E11
cccacgcgtccgcccacgcgtccgagacccggtcccccaattccaattcgcccctctcgcggccgggctcgcgagacgccgattcggatcccatctcctgctcagagcctcgattcgaccggcggtggcgacgattcgaccgggtcggtagccaggcagaggcagcggaaggagaggatgagcttccaggacctggaggcggggcacgtccgcggggcgccgctcggcggcggccggaggaacggcaggggccccgcggaggcggggggcgccggcgccggcgcgtcgcatgccgtggcgtcgggcgtcttccagatcaacaccgcggttgccacgttccagcgcctcgtcaacacgctcggcacgcccaaggatacccccgaccttcgcgacaggatacataaaacacggtaacacataacacaac

SEQ ID NO: 47430 - DNA, 412 bp, Zea mays
  Clone ID: LIB3066-005-Q1-K1-E12
cccacgcgtccgcccacgcgtccgcggagaatcggattgctcccgaccgcgattacgccgaggctgtcaagcacaccaactccggtggcagcatggagctgcttgcgctgaatgttcagatataccttcaaatgaacaggacggaccacgcagagaagcagctcagggtgatgcagcagctggacgaagaccacacgctgacgcagctcgccaacgcatgggtcgaccttgtgctgggtggttccaagatccaagaagcgcgcctcatcttccaggacctgtccgagaagtacccgacgacctgcacgattcttaacgggaaagccctgtgctcgatgcacatgggcaacttcgaggacgcggaggggttgctgctcgagtcactgaacaaggacgccaaggatactgagac

SEQ ID NO: 47431 - DNA, 101 bp, Zea mays
  Clone ID: LIB3066-005-Q1-K1-E2
actagttctagatcgcgagctgccgacaaataaaaaaaaaaaaaaaacaaaaaaaaaaaaagaaaaaataataaatcataaaaaaaaaaaataacgacaaa

SEQ ID NO: 47432 - DNA, 468 bp, Zea mays
  unsure at all n locations
  Clone ID: LIB3066-005-Q1-K1-E3
accgagagaggaacgcgaacaaccaacgatcgcctcatcgccatggctcgctctgtccccggcgccgtcgccgtcgcgcctctgctcctgctcctcctcgtctccactgcgtccgctgcacggaccgtgggcgacaccgtgcaggacgcgtgcagcaagacacaattccccaagatctgcgtggacagcctcgccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacgacgtcgaggaggccgtcgcccacctcaacggcctcgtccgggagcccaccgacgccaagttcctggagctcaagtcgtggctcttctncacgctcggcggcaccttcacctgc

SEQ ID NO: 47433 - DNA, 445 bp, Zea mays
  Clone ID: LIB3066-005-Q1-K1-E5
gagaatccggactggtagaaactactacagaaggggtccggagggcaatgacatccaccagagaaatgttcctcacatcagggttgaatttcgacacactatctggaaagaagaaatggagctgatacattttggaaatgttaacctacccgaagaagttgacaggtgaagagcaggggaattgcagtgaagtctggcggtggcggcaaggggacgagagaatgtgtcaacacgagagactcgtttgcttgcagaggaggtatcatgacaatggatgtcgccaagtcctccgtgtcgaccatatatatatgaagaataataagaaaacacaaatacccaagtatttagaagcgttgaatccagatgtggcatgaggtcggagccaacgtgtacttgcatacgttacgtttatatacatgtactgctctgctggaatggtgtttcg

SEQ ID NO: 47434 - DNA, 467 bp, Zea mays
  unsure at all n locations
  Clone ID: LIB3066-005-Q1-K1-E6
cccacgcgtccgtcttgttttgcagtaccattttatgcagaccttcatactttgctttgtgggtaccttttttttgagtaattgacctagctacatcatcctgctttgcttaatagtcctactcgtatgtatctttaatgtaagcagaatttacttttggtgcgtgcgaataagaacaccgagctttggaaattttctcttaaaaaaatattcgcttgctcgtacttttactgggagtcattttctgggggtgctgctccgtcttcttctcgcgtcaccgtcctttttcctcctttaccaaagcctcatatttgcattgtcgattgcagataacagtctgatacccccccacccactgccttcactgactgctagagcccctccttgtcagtacagtgtttggtgctgaatcaaatccactgaagatgccaagttctgaaccagacagtgatgatgttntctttgac

SEQ ID NO: 47435 - DNA, 188 bp, Zea mays
  Clone ID: LIB3066-005-Q1-K1-E7
cccacgcgtccacagacgcatctacctacgcttggatcaacccgataaattcgtacagacacgtgatcgtttccaagctacctatgcttttaatcctactactctgcaatgaaagcactgtacataccctttaccacattgtacaagattcataccaaaagacacaattctataagatctaacttgac

SEQ ID NO: 47436 - DNA, 458 bp, Zea mays
  Clone ID: LIB3066-005-Q1-K1-E8
gaagcttttgctgggaaccttgaccagaacagcctgctgggcactttagattctttctctggtggaggcattggccggcttggaatttgctcccttggcattgtaccatttatcaatgcacagattgtgtttcaactccttgcgcaactctacccaaaattgcaagaccttcagcggaaagaaggggaagcaggaagaaagaaggttcttcagtatacaagatatgcttctgttggatttgcaattgttcaggccattggacaagttctttatctccgtccctatgtgaatgatttcagcacagaatgggttctaacatctgtgacattattgacacttggatcggtctttactactttcattggtgaaagaatatctgatctgaaacttggaaatggaacatcacttcttatatttacaagtataatatcatatttgcctgcatcatttgggaggac

SEQ ID NO: 47437 - DNA, 472 bp, Zea mays
  Clone ID: LIB3066-005-Q1-K1-D5
aggcagaagcagagataatggacgacgtacatgtctggttcgtctcgctggcctgccttggtggtttgtacatcgccgccatctgctggcggcccctcgcctatctcgcgttgtgcctgcgtgggccgaaggacctgcaccgctacggctcatgggccatggtgactggcccgacctccgggctcggccggtccatggccatggagctcgcgcgacggggcctcaacctcgtcctccttgacctcgacgccaacaacctccaggagacctacgaggccatcaagtccgtccaccccgtgaagataaggactgtggttctagacctctccctcgtcgccacaccagaaggcgacaaggcgatccgacgtctgcgggaggcgatcgaggggctggacgtggggatactggtgaacaacgcggcggtgaacacgcctggcgcagtgtacctgcacgaggcggacatcgagcgctt

SEQ ID NO: 47438 - DNA, 444 bp, Zea mays
  Clone ID: LIB3066-005-Q1-K1-C12
cccacgcgtccgcggacgcgtgggttcagagggtggcaataagagctcaggtgatggtggggcaagtgaaagggcatcagccttggcagctctttcatccgcattgaatccatcgtcgcaaggaaaacagtcagatgagaggcccacaaaacccagcagcacacaggcgcagtctcattcaggccaagggtctcagagagccgctgctgttgcagcactttccaatgttttgactgcagagggatcgcacagcccccgccacagtaggtcgtccccaacagcagatgctgagaagactgaattagctcctgcttctcctcaccagttggaaacagggcctgcagaagatgtccggacagagcctgatgtctcacaggaacaaactgctaacgaaaacggaggccagaccacctttagctacgaccgcttggtatcaaagtctac

SEQ ID NO: 47439 - DNA, 468 bp, Zea mays
  Clone ID: LIB3066-005-Q1-K1-C2
cggacgcgtggggccggggcggccgtcgctgccgcctacggtgcccaggtcttcctgcccggccttcgccggcgccgagcacgagaagaattgtagttgcatcctaagcatggactgtaatagtgatgatcttgataagcagaatgaagtgacgggatctcgagtattcattcctcaagatgcccaaggggttatccttgcttttcttcctggcagggatgttgtcaagctccgcagtgtgtgcaagttctggctagagtgcgttgaagaacatagttttatggaccgtcacctgaataatgcttgccgctaccaccagtccattgcttgtttcacctcgcttgatcatggcctagtccacatgtacacattcgatcctgccacaatgaatttcagaagtgtggagctcgtgttctcaagtaggtttaacatgtcagccccctgcaacggcttggtgtgtgcctatga

SEQ ID NO: 47440 - DNA, 467 bp, Zea mays
  unsure at all n locations
  Clone ID: LIB3066-005-Q1-K1-C3
gacaattttctcgtaaccttccgggctcctcttcctctcctcgcgttcccccaccaaaccgtaatccgagcacccagcgtcccaggccctacccgcttcctctcgcgccggcctttggggctctcaccctgagcggtaggaatccgcagggctccagttgggtgccagaagcatccaagtcgttggcgggagaccgggaaatggcggaaaaagagggggcgaaggttggggcggaagagatggaagagcgggagcaggaaggggaggcggaggaggtggaggtgaagtttcgtctcttcgacggctccgacatcggccccgtgcgctgcaacgccgncaccaccaccgtcgccgctctcaaggatcgcgtcgtcgccgactggcccaaagataaacaaattatcccaaaggctgctagtgatgtaaaactaataagtggaggcaaaattctagaaaatgacaagaat

SEQ ID NO: 47441 - DNA, 463 bp, Zea mays
  unsure at all n locations
  Clone ID: LIB3066-005-Q1-K1-C4
ctcctcgaccctcccgacgcggaaaaaaaacagggaggagaggagggagaaagggaagagggggccgaaatctcctccccctttccaaatcctggctcaataatctctccatcaggggatcctaaggctgatcactgatcaggtcggaggactcggcgggcgcaggcatgaacgagaaggcgtccgtctccaaggagctcaacgccaagcacaagaagatattggaaggtcttcttcggcttcctgagaatagagaatgtgcagactgcaagtcaaagggtcctcgatgggcaagtgttaatctcgggatctttatatgtatgacatgttctggaattcatagaagcctgngggtgcacatatctaaggtaagatctgctaccctggatacatggctgccagagcaagttgcatttatccaatcaatgggaaacgaataagcaaatagccattgngaagcaga

SEQ ID NO: 47442 - DNA, 434 bp, Zea mays
  Clone ID: LIB3066-005-Q1-K1-C5
cccacgcgtccgatgagcagctgcgcggactggctggtggacgcggtggacggctccaccgggatcaccgtctccaacggccacttcacgaggcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttctt

SEQ ID NO: 47443 - DNA, 482 bp, Zea mays
  unsure at all n locations
  Clone ID: LIB3066-005-Q1-K1-C6
cggacgcgtgggtccgcacgatgccggccgtcgggccggggagctacccggggcggatcgccgtggtcggtgacctgcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcgcggttcgcgttcccgtcggaggagagcgggtcctnctcgccgttctactactcgttcgacgccggcggcatccacttcgtcatgctngcgtnctacgccgacta

SEQ ID NO: 47444 - DNA, 308 bp, Zea mays
  unsure at all n locations
  Clone ID: LIB3066-005-Q1-K1-C8
caagcacaatcccgaaccctaaccagcgccccagctcgccgtcggcatgtccgccaggttgcggcggcgagtcctncaggagcgtgaggccactccgcatgacaccgacgtcgccgacgacgaccagtcggtggaggaggaggcttctcctccgcgcacctccgcgcggaatctcttcgatctcctcgacgacggaaacggcgacggcgacgaagaagatgaaaaggaagatgaaacagaaataattcaagctgtgagctatacagaacagagacattctgtgcaaaagaaagcgaacgctgttcccg

SEQ ID NO: 47445 - DNA, 400 bp, Zea mays
  Clone ID: LIB3066-005-Q1-K1-C9
agacactgagctggtctgtttagttggaaagccatctgtacgtttttcgccgatcatggaggatgagaggaacacccagcagcaccagggcggtgagcaggcccaggaccaggagaacgaggtgaaggacaggggactcctggacagcctactcggcaggaacaagcacgacgaccaggagaagaagaaccagcaggcggaggaggagctggcgaccggcatggagaaggtcacggtggccgagcccgaccacaaggaggagggacacgaggccgccgagaagaaggacagccttctcgccaagctgcaccgcaccagctccagttccagctcgtcgagcgacgacgaggaagaggaggtgatcgatgagaacggcgagattgtcaagaggaagaagaag

SEQ ID NO: 47446 - DNA, 405 bp, Zea mays
  Clone ID: LIB3066-005-Q1-K1-D1
cgctcgcctgagccagcacatatgcattcaccaacaaattcaagaacgcggacgtgccggggaccctgatgaagtgcgcgccggactactgcaacatctacatcgcggccaaggtcaatgccggcaatgtccggctcgccaagtgctgcgtacggtccatgcaccgtggcgccgacagcccttctgacaccgacttcgtacaggaatccgctctgtacattcaccgtggctccaggggacacggacacctgccggcagtgatgcctgacgccaggcgctctatggacggacgcaataccatgtcggagctcagcaagctcccaccactccgcgagcgctctctctcgtaatcggccaccaagaacgtcgtcgagatgccgggaaaggactactccgaggcgccct

SEQ ID NO: 47447 - DNA, 430 bp, Zea mays
  Clone ID: LIB3066-005-Q1-K1-D10
cccacgcgttcgcccacgcgtccgcgcagcgaagtaaacatgtctgaccgggcaaagatgtggtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatgacgcctgggcagtgcaacatggtggtggaaaggctgggcgact

SEQ ID NO: 47448 - DNA, 441 bp, Zea mays
  Clone ID: LIB3066-005-Q1-K1-D12
cccacgcgtccgcccacgcgtccgcccacgcgtccgctccttcacttcctcgctggcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaagtggacgcgttcgccaagcgcaccgcgcaggcgcgcaagcacgtcgcgaggtcggcccgcaccatcccgccgcagcaaacgcatgcgc

SEQ ID NO: 47449 - DNA, 472 bp, Zea mays
  Clone ID: LIB3066-005-Q1-K1-D2
cccacgcgtccggatcaccggccgtcgagcgagcagtctcccaattccacccaataactaagaacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggggcggcaacgttgggatgcatcgtgtttggttcatccgattaattaattgttttttttatttacgtggtttgcgattggttaattgtttgtttgttcgttcgtttcgtggtcgtg

SEQ ID NO: 47450 - DNA, 333 bp, Zea mays
  Clone ID: LIB3066-005-Q1-K1-D3
cccacgcctcagcatcaacatacgcctagtttaccatcttcaaaaaccacccaataactaagaacatctacaagagcgcgacgaacttacaaccactatacatatcagccacgaactcatccatccatcagccatttacataaagaagtttctctcccatgcactcttccccagctactcgttcacccacctacttgcctcagtaatctcctaagcacattcctattctctcaactgcacactcacacctgcaaatagccataccacactccacgccctctatgtcctcacaccctacaatatatcacctgacgactcatacatcacccacta

SEQ ID NO: 47451 - DNA, 463 bp, Zea mays
  Clone ID: LIB3066-005-Q1-K1-D4
tgaccttcagcaaggagacttcatcgtgatctacaaggacgacgagaacaaccgctttgtgataggagcaaagaaggcaggagatgagcagaccgccactgtacctcaagtccatgaacacatgcacatctctgccgcactgccagctccacaagcgttccatgactatgcaggccccgtcgcagcagaagctggtatgctcgcgatcgtgccacagggtgacgagatattcgacggcatactgaactccctgccggagataccagtggcgaacgtgaggtactccgacttcttcgacccgttcggtgactccatggacatggcaaatccgctgagctcctccaataacccctcggtcaacctggctacgcacttccatgacgagaggatcgggagctgctcgtttccctacccaaaatccgggcctcagatgtgagatcctggcagaaaaactgccgcggtc

SEQ ID NO: 47452 - DNA, 438 bp, Zea mays
  Clone ID: LIB3066-005-Q1-K1-C11
gcaaggcaaaggaccttggtgtcatgtttattgaaaccagtgctaaagctgggtttaacaggaaggcgctgttccgtaaaattgctgctgcccttcctggtatggagacactctcatcagcgaagcaggaagacatggttgatgtgaacttgaggtctggcaatgcaaactcgtcccagtctcaggctcaggctgggggatgcagttgttagttgcagtctctgacacttgctgctcatgatctctgagaccctgagcatcagaacgcgttaccactgatgcttctctcgggaaggagagttgatcggcattgaacacgcacacgctatagtttttacccggtgaatggaccatttgcattggaacgatacgtttgagttctctagtgttatttccagtggcctaagctagcaacagtgtatagttgggttggcactg

SEQ ID NO: 47453 - DNA, 149 bp, Zea mays
  Clone ID: LIB3066-009-Q1-K1-H1
aaaagagacaccacgccggccgcgaggaatgtcgcttgaaggccgacagacgcggcgggtgcgactatcgctctgagccgatgataaatgcccatgtggctctaacttcctatcatcaattgcaccctgccgatagcccattcagcaca

SEQ ID NO: 47454 - DNA, 423 bp, Zea mays
  Clone ID: LIB3066-009-Q1-K1-H10
cccacgcgtccgcggacgcgtgggtgcaatcccatgcattctaatctgccaccagaggtcagatggtgggttcagtcacagccaaattttgggatccagaaggatattgttagcaagcggttatgttcgttgggcagggacattcatgagaagcaagtggaagattcagtgccacaacctaaacatgaggaaacattactctgtcaagcagttgacactagcactgaaaagattggagatgcgttggagcctccatggatggtttcgccagccttcacgaagtattcccttgaaacaggtttagaagagatgaagactgttggtagctattctcaagtgtcgaagtgtatagaaactctcagcaattgtttgtacaaggataatgaattcccagattttgaatgtattgacccagcacctttg

SEQ ID NO: 47455 - DNA, 424 bp, Zea mays
  unsure at all n locations
  Clone ID: LIB3066-009-Q1-K1-H11
ggtcaaaccaaccgcgatccgcgaatccgcgggagaggaggggaggggcgcgggggcgatggagttcctgcagggccagaggctggagaccacgctggccgtcgcgggcgccgtcgttgccgtcgcagccggctccgcctacctcttcctccgcagtaggaagcccaggggatgcctagaccccgagaacttcaaggagtttaaacttgttgagaagaggcagctgagtcataatgttgccaagttcaagtttgcgctcccaacacctacttctgtattgggtcttccaatcggacagcatataagctgcagaggacaggatgcttctggcgaagaagtgatcaagccttatactccaactactctggactctgatgttggatcttttgagcttgttataaagatgtatccncaaagaagaatg

SEQ ID NO: 47456 - DNA, 427 bp, Zea mays
  unsure at all n locations
  Clone ID: LIB3066-009-Q1-K1-H12
gaccagcagcagggaacatcgtccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgagacgcacgccggcgtggcctacgaccactgcatggcgtcgctgggcgccgacccgcgcagcaaggaggccggcaacaagaacatgcacgggctggcggtgctggccaccaggatggccatcgaccacgccgncagcaccgagtccaagatcga

SEQ ID NO: 47457 - DNA, 415 bp, Zea mays
  Clone ID: LIB3066-009-Q1-K1-H3
cgttctctcttcctggtccaagtgatcttgccaagttacgagcagcgagcagagatgagggcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgttgagcaggtggcgcagacgggccaaggcgtggcggcaggcgtcaaggacacggtggcaggcgcggcggttggcgtcacgaacacggtggccgacgtggcggcgggcgtcacgaacacggtcacgggcgccgtggcgggcgtcacgaacacggtgaccggcgcggcggccggtgtcaaggacaccgtgaccggc

SEQ ID NO: 47458 - DNA, 419 bp, Zea mays
  Clone ID: LIB3066-009-Q1-K1-H5
cggacgcgtgggcggacgcgtgggcggacgcgtgggcggacgcgtgggcggacgcgtgggcggacgcgtgggcgcggctccgaatggcaacttccccgaaccccgcgacgattcaccgagccggcgcccagtgacccttccagaagcttccagaaggtcaccgccatggccgcgcccttcttttccactcctttccagccctacgtctaccagagccagcaaggatctgtgacggcgtttcagatatccggtggagatgtgcaggtcctgcaggtgatgctgaagtctcaggagaagctgactgcaaaaccaggtgcaatgtgctacatgtctgggaacatgcagatggacaacaattacttgcctgaaaatgatggaggcgtgtggcagtggatttttgggaaacgtgtaagcagcac

SEQ ID NO: 47459 - DNA, 412 bp, Zea mays
  Clone ID: LIB3066-009-Q1-K1-H6
ggggctacagccgcaaagacctcggcgtcagctacgttaaggagaagcagctgacggtcaacatggggatcagcaagctgagggagaaggtgaaggagcaccaagagaagttccacagcgcggccaagatcgctggaaccaaccccgtggagtggatggagaatgccgaccgttggatcgtcgggttcctcgagaagttcgaggaaggatgccacatgatggaaaccgccattaaaggtcgaattcaggagggtctgaagaggcaaggcaggtcagagtcgaacctttccggagaggactccgactcgtaataatggtctgtagtatccaaatcaaactagacggaagctggactggaggtcatactcgcgcagtctgtgtaacagtgtgagattgattagcatgtttttgt

SEQ ID NO: 47460 - DNA, 146 bp, Zea mays
  Clone ID: LIB3066-009-Q1-K1-H7
gggtctgaacatgtcgattgatccattcataatatctgctatgccattacttctctggctgttaatttcgatatgtaaagaggggagaatgggagacactattcgtttggacatgacaatcggaaattaatcaatacccatttgtt

SEQ ID NO: 47461 - DNA, 423 bp, Zea mays
  unsure at all n locations
  Clone ID: LIB3066-009-Q1-K1-H8
atcattaccatcgccgcgcccgcctgctggctcgccggcgatcgaatttgaccgccggtccgcgagcggagcatacgtgcatacatggtttgcctgacgccggcggcggcggcgctgctgctcgtcgtcgtcctagcggcggccgtgtccgcgctcccggcgatcaacgtgacgacgatggcgttcgaggacgggtacgcgccgctgttcgggcacggcaacatcctccgctccgccgaccaccgcaccgtcagcctcctcctcgaccgttccaccgggtccggtttcatctcgtcgtccatgtaccagcacggcttcttcagcgcgtccatcaagctccccttcgactacaccgncggcgtcgtcgtcgccttctacgcgtncaacggcgacgtgttcgagaagcggcacgacgagctggac

SEQ ID NO: 47462 - DNA, 200 bp, Zea mays
  Clone ID: LIB3066-010-Q1-K1-A1
cccacgcgtccgctccaagcgagctagagctagagctatagagatcactctccttcggcgcgtgaggtagtgacgtgacgcccagccatggcaacaatggcactgcgcgccgtggcgacggcgctgctggtggcggctgcgtacgtgtgcggcgcgtcggcgtcgacgctggtgctgtacaaccggtgcggggagacggt

SEQ ID NO: 47463 - DNA, 419 bp, Zea mays
  Clone ID: LIB3066-010-Q1-K1-A12
gagagagagagagagatggatgaggagtacgacgtgatcgtgttggggacggggctcaaggagtgcatcatcagcggcctcctctccgtcgatggcctcaaggtccttcacatggacaggaatgactactacggaggagaatcttcgtccctgaatctaaccaagctctggaacaggttcaagggcaacgacagccctcccgagcacctgggcgtcagcaaagagtacaacgtcgacatggtgcccaagttcatgatggcaaacggcgcgctggtccgcgtcctgatccgcaccagcgtgaccaagtatctcaacttcaaagctgttgacgggagctttgtgtacaacaatggcaagatccacaaagtcccggcaaccgacgtggaggccctcaagtcgaacctgatgggcctgttcga

SEQ ID NO: 47464 - DNA, 436 bp, Zea mays
  Clone ID: LIB3066-010-Q1-K1-A3
cccacgcgtccgcggacgcgtgggctgaccacagcaaccaacctcctctttcctttggatggatcggaccatcgatcacaattcacacagccctagcccctaggtagtggcatcatggcggtgaaggactgcggcgggcacaagggctgcgagtgcgagcgggagcggctgtaccggcggtgctgcgcggcggtcgtggctctgatcctcctggtcctcttcatcgtgctcgtcgtgtggctggtgctgcgcccccacaagccccggttctacctgcaagacctgtcggtgctgtgcctgaacgtgacgccggcggcgttcacgtacctgttcacgacgatgcaggcgacggtggcggcgcgcaacccgaacgagcgcgtgggcgtgtactacgaccaagctgacgcgtaacgcgaagtacaagggcgtggcgatc

SEQ ID NO: 47465 - DNA, 432 bp, Zea mays
  Clone ID: LIB3066-010-Q1-K1-A4
cccacgcgtccgcccacgcgtccgcccacgcgtccggcgctggtctggaagttcgacgtcgcgcccttcatggtgctcatcattgccatcctcaacgacggcaccatcatgaccatctccaaggaccgcgtgaagccgtcgccgacgcccgactcgtggaagctcaaggagatcttcgccacgggcatcgtgctagggacctacatggcgctcgccacggcgctcttcttctacctggcgcacgacaccgacttcttcaccaacgccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcaa

SEQ ID NO: 47466 - DNA, 367 bp, Zea mays
  Clone ID: LIB3066-010-Q1-K1-A5
gccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaagtgagatgcagggaaaaccctgaatggctcggcaatcaatcaacggggacattaatggccttaacctacaacctatcggttcctaacaatttgacttgaaccgcaaagccttcggcttcctggcaaagcccgggcttaaccgacagattcggcact

SEQ ID NO: 47467 - DNA, 368 bp, Zea mays
  Clone ID: LIB3066-010-Q1-K1-A9
cccacgcgtccgatagagatttagaatcttgagagggaagtcattaaccttgcggggcaactatcttcaacacatggtgagcaagcaagctccattgttcatactattctttaggcctacatccttcgagcagacaatgtacaacttcatgatcatcttcatgatgcaaatgaacagttgagacattatgaatctctactagaagatatacacaaggagtcaaaaaggaagattaaatcccttaccgattcactcaatgtatctaaacaaaatgaataaatgctgaatatagatgccgacgatgtcataaagctgatagaagctgctaaattcaatgaagaaaattttataataacttcaaatgaact

SEQ ID NO: 47468 - DNA, 434 bp, Zea mays
  unsure at all n locations
  Clone ID: LIB3066-010-Q1-K1-B1
cggacgcgtgggcccttccggccccctctcctcggcgcgatctaaatccggtccggcgatggacggcggtgggcagcccccggacacggagatgacagacgccggcttgggcggcggggggcagccgccgccgccgccgcagcagccggcgggcggggccgggatgatggagaacatccacgcgacgctcagccacggtggccgcttcatccagtacaacatcttcggcaacgtgttcgaggtcacctccaagtacaagccccccatcctccccatcggcaagggcgcctacggcatcgtctgctcggcgctcaactccgagacggcagagcangtggccatcaagaagatcgccaacgccttcgacaacaagatcgatgccaagcgcacgctccgcgagatcaagctgcttcgncacatggaccacgagaata

SEQ ID NO: 47469 - DNA, 424 bp, Zea mays
  Clone ID: LIB3066-009-Q1-K1-G9
cccacgcgtccgccagaagcagaagccaccgatcggcgtgccgcgtgcgtgaggcgagccgggcatcccgtcccgaggaggaagacaaccggcgacgctgggggaacatggggaagacgccggtgcggatgaacgcggtcgtgtacgcgctgtcgaccttccagcagaatgtaatgccagcgctgtggaaagacatcaccaccaagatccaacacaaggtcaccgagaactggatctccgccacgctcctgctaactcccgtcgtcagcacctaccaatacgccatgtggtacaaggagcaggataagctttctcacagatattaaatgcgctgcccttgacagacagcactcggagttttcatgatgggtttcataatccttccatgatgatttaacatttgtatgatcaatttcagttcaac

SEQ ID NO: 47470 - DNA, 93 bp, Zea mays
  Clone ID: LIB3066-010-Q1-K1-B10
attccctctctacccactcgtctccccactcgtcctcccactctttctatttaaaaaaaaaaatataaacaaaagacaagctaattataaaaa

SEQ ID NO: 47471 - DNA, 421 bp, Zea mays
  unsure at all n locations
  Clone ID: LIB3066-009-Q1-K1-F12
cggacgcgtgggcacagaccacaaaggaggggacacacacacacacacacaccgtcgccncccgtccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcaccccgcgccggctggccgagctgctcgtgtacgtgtcggccgaggtgggcatgaccgtggccgcgttcgcgcaccacgagctcaacgccatcaaggacgacgacgttctgtacaagtgcatcgacacctgctccgaggacatcga

SEQ ID NO: 47472 - DNA, 276 bp, Zea mays
  Clone ID: LIB3066-009-Q1-K1-F2
gggaagacgaagacagagtccgagattttgtggatcgaggtgaagcccggttggaagaagggcaccaagatcacgttcgccggtaagggcaaccagcagtggaaccagctccccgccgatctggtcttcgtggtcgacgagaagccccaccccgtgtaccggcgtgacggcaacgacctgttggccgaggtccgtgtgacgctcgcccaggcgctgggcggcacggtcgtcgtcctcaccgcgctcgacggccgcgagctcgccgtcgacgtgggc

SEQ ID NO: 47473 - DNA, 307 bp, Zea mays
  Clone ID: LIB3066-009-Q1-K1-F3
aatactactaatcaaaatcttgtcgggatatatctctccaattcccctactgctacggacggggcaacaacaatgtgttccggcctgcaaacataaccaaaaaaaaaacacactgaacccaataatactatcccacagaaacttttctctcagtccgttcgatcgatcgctgacgagtcgtttgccagacaccatcagcacccaaaaccatggcctgcaacctggctcaatgcagccaccgccgcctcggagactcgtcaacccacgacacctcgccctgctgcctacaagtccgtctccttcttca

SEQ ID NO: 47474 - DNA, 331 bp, Zea mays
  Clone ID: LIB3066-009-Q1-K1-F4
cgttctggcccatgctgtcctacgcttgcggcgagctgtgtgtgatcgtactgctcgacgggtctgccctggcgtcctatgcggccacgaggctggcgcgcgtctgcgggctccggccgccctgcatcctgtgcgggaggctggaccacgccctccacgggaagccatggttctcttcggacttggtctgtgccgcgcatcggtctgagatctcgtctctggctcactgcaagacccatgaccagcttgttgcatgctccggcgatctctctcggcctacgtcggccaggtcaagaaggttgtgttcttgttcggatccactcaagaatgc

SEQ ID NO: 47475 - DNA, 423 bp, Zea mays
  Clone ID: LIB3066-009-Q1-K1-F5
cccacgcgtccgcccacgcgtccgcccacgcgtccgcactgcctcaacgctgctgcggagcaaccgaagaagagcttcgatgatcgccgccgggcgcaggtgtttctgcgtgaccacatatccaactcggtcaacatcgtgtgctacgtcctcctgtcgatggtctccgtcgccgccataccgtacctctacccgcagatgcggcgcgcgcacgtcgccctcatctacctcgccgcgccggtcgtcgcgttctgcgacgcgtacgccttcggcgtgacggacatgaacctgtcgagcacctacggcaagctcgccatggtgctcgtgggctccagcgtggggcgcaacgacggcggcgtcgtcgccggcctcgtggcctgtgggatcgtgatggggaccatgtccaacgccaacaacctgatg

SEQ ID NO: 47476 - DNA, 412 bp, Zea mays
  Clone ID: LIB3066-009-Q1-K1-F6
cgccgttgtggatattgatgtgcactacgggaatggcaccgcggagggcttctatgggacagacaccgtgttgacgatgtctcttcacatgatgcatggttcttgggggccatcgcatccgcagagtggctccgtcgatgagattggtgagggcaaggggcttgggtacaatctcaatatacctttgcctaatggaagtggagatgctgcgtatgaatatgcgatgaacgagttggttgttccatcgattgataagtttcagcctcaactgttgtttcttgtggtcggccaagattccagtgcgtttgatcccaatggaagacagtgcttgaccatggaaggctacaggaaaattggacaaataatgaggcgcctggctgatcgccattgcaatgggcaaatactggttgtc

SEQ ID NO: 47477 - DNA, 350 bp, Zea mays
  Clone ID: LIB3066-009-Q1-K1-F7
ttaacatattgttatattgactgggttatttgtactgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatatcataccttttaaaaaaaattaatattcttccattttttttaaaataaaatattttattattcgataaattaataaaatttatacgcctattgttaaaaatacattaaccaaaaaaacacttactttaaaatactaaaagaatttattaaaataacatttttaccc

SEQ ID NO: 47478 - DNA, 324 bp, Zea mays
  Clone ID: LIB3066-009-Q1-K1-F9
aacacaccttcatctgcatctacgctggcacaactgcggatgaccctgatcaccgatgtaatggatcatgctggtcacagacgcccacgatatctccatcgtcaccggtaggacctccgaccaaaccgtcttcagtgcccaggactcgatcatgttccaagctatcaatgatggcaaagatctttacgccttcgatactattccatatattgacgatggcacacttcatcgacgcacgcacctggcctcacgatctaagtatttggaccctattgtcatataaagtgcttacacgtaatccgtcaggtccatcgctcatgtctt

SEQ ID NO: 47479 - DNA, 328 bp, Zea mays
  Clone ID: LIB3066-009-Q1-K1-G1
tcgcggacgcgtgggcggcaggatcaagttcaaggcgttcgaccttgggggccaccagagggggcgccgcgtctggaaggactactacgccaaggttgatgctgttgtgtacttggtggatgctgttgacaaggaacgttttgccgagtcgaagaaggagctcgatgcgcttcttgcagatgactcccttgcaaacgttcctttccttatactgggcaacaagattgacattccatacgcggcttcagaggaagagctgaggtactaccttggcctgagcaactttacaaccgggaaaggcaacgtgaacttggccgacttcaacgtt

SEQ ID NO: 47480 - DNA, 316 bp, Zea mays
  Clone ID: LIB3066-009-Q1-K1-G10
gcacgcctccgcggaccggttgcggttactgttgcagctcgcctaccaccgctctgtccgggttacgccggggttcgcgctccgtgaccttatccagtatctgtacagcgacaaagttgatgagaagaaggagctgatcaaggggataacgttcggtaacaaagacaaattccagcttacgcctttgcctcagcaagttattgtgatatggggagagcacgatcagatattccctgtcgagaaggcatttgaatttgcaagggaacttggcgcaaattctaggttggaggtgcttgaggacactgtccacatgccc

SEQ ID NO: 47481 - DNA, 404 bp, Zea mays
  unsure at all n locations
  Clone ID: LIB3066-009-Q1-K1-G11
cccacgcgtccgcccacgcgtccgcggacgcgtggggcagctgctttcccttcgggagggcgacggcgacctccccgacgacttcgagttcgacatccacgtggacgtcaccttcgccaacgagcgcctgcgccgcgcgtacgtcgcgctccaggcctggcgccgcgccatgtactccgaccccaagaacttcaccggcggctgggtaggagccgacgtgtgctcctacttcggcgtcacgtgcgtcccggcactcgacgacgctaacaccaccgtcgtcgcgggcatcgacctcaacggcggcgacatcgcgggttacctncccgcggagctcggcatgctcaccgatatcgccttcttccacattaactccaaccgcttctgcggcatcatccccaagagct

SEQ ID NO: 47482 - DNA, 55 bp, Zea mays
  Clone ID: LIB3066-009-Q1-K1-G12
cccacgcgtccgcccacgcgtccgcccacgcgtccggactagttctagatcgcga

SEQ ID NO: 47483 - DNA, 420 bp, Zea mays
  Clone ID: LIB3066-009-Q1-K1-G3
gagagagacgcaggcccgccggcgacgatcgaggagggaggaaccagagacccggcggcggcgacgatggctccgcgcagctcatcggcggcgacgtgcctgtgcctcgctctcgccgcggccacgctggcgctggcccacggtgcgcaaggaggaggaccatcggcatcggcggcggacctggacaaggtcacggccgagaccttcttcgacatcgagatcgacggcaagcctgcaggccggatcgtgctgggactgtttggggacaccgttcctaaaactgcagagaacttccgagcactttgcacaggggagaaaggaattgccaagtccggcaagcctctgtggtacaaggggtcgacgttccacaggatcatcccggggttcatgatccagggaggcgacttcaccaacggcaac

SEQ ID NO: 47484 - DNA, 418 bp, Zea mays
  Clone ID: LIB3066-009-Q1-K1-G5
ggccggctcgttgcacctcggcctccgactcccttggtcagcatagctgtcgcggcgggctccagcccgggcccctccgcgcccctctcctgccgcggaccggcgcctcgctggcgacgttcgagcgtgagggcgcgcaccggggccgacgacggccgcgggcatagggagtccccgtacgaggtgctcggcgtgtcgccgtctgcggcgcccaacgagatcaagcgcgcgtaccggcgcctcgcgctcaagtaccacccggacgtgaacaaggagcccaatgctcatgagaagtatctgcggatcaagcacgcttacaacactctgatgaactcagagtcacgatccaagtacgcgagcagcagttcggattcgtcctggtcctccagctaccgggagaggaaatcagctgctgcag

SEQ ID NO: 47485 - DNA, 256 bp, Zea mays
  Clone ID: LIB3066-009-Q1-K1-G6
cccacgcgtccggccggatggcgctgctcatgctttgtaaagtttgggaggacattgatcataattgaagtcaagtgataggatcctgttttttaagtacacgatacaacacaaatcttaacataaaaaaaaaaaaacataaaaatagataaaaaaaataaaaaaaagaaaataaaaaaaaaaaatataactaaaaaaaaaagaaaaaaaaaaaaaaaaaaaataaaaaaaaaaaaaggggcgcccctttaaaaga

SEQ ID NO: 47486 - DNA, 417 bp, Zea mays
  Clone ID: LIB3066-009-Q1-K1-G7
cggacgcgtgggcggacgcgtgggcggacgcgtgggtgcttcaagatcgaagggcggtaagcgatgaaaccttttccccataatatgcagcttaggacctgttctcgctcaatacattgcgccatgattatggcaggtagagtcctccccccctgaggtttgacatccgctggagcacagcctctcagcctttgctgactggacgagatactgagcgcaacttccatctgttgcgccatgtttcgctagcctagcgtgtaacagacatcgttttttggtgttggaagccccattggctttcgactagattctgttaaggtagggaatgaggttttagatcaccttggatgtaagagaagcaggtagcgccgtgtctggagtgtttagtatgtttagttatccgacgagtttctcgac

SEQ ID NO: 47487 - DNA, 419 bp, Zea mays
  unsure at all n locations
  Clone ID: LIB3066-009-Q1-K1-G8
ctccctcttccgcctcctccactccgccactttttcccgggacagcggaggtgggtgcaaatggggtgcctcctccttccccggaggaggcggcgagggtgggtggtggggacgaatggggctccacctggtccaccggcctcaccaaggaccactttgacggatcctcgccctccgtcagccgcctcgccccttcccagtccgcgcccgtctcccgtgagcgggcggccgttcgcgccatggacgagtgggacgagaggagccaggaactgtagcgcgaaaatatcgaggcgaaggcgtacgtggattcatgggacgaccggatgcgggagacctgtgcgctgctgaagcaggtgcgggtgccgggcgctcggngctcgtacctcaaggactcggagaaacaggagatgtacggttgc

SEQ ID NO: 47488 - DNA, 268 bp, Zea mays
  Clone ID: LIB3066-009-Q1-K1-F11
gtcctacgtcaccaggctcacgcgctacgccggctccctcgcctgcacgcccggcaggccctgctagatcaagccaccagcgaggacggccgacgaccagaggcagacctgcatgcattcgccggctcgccatgtatgaaacaggggagttgaaagcgcgacacaccagagaacgtgtctgtgtatactgtgcaaaggggctaaacgcaagagaatatgcacatatacaaagtcgcttattctgtctgcatattgaaggccaggtccg

SEQ ID NO: 47489 - DNA, 422 bp, Zea mays
  Clone ID: LIB3066-009-Q1-K1-D8
cccacgcgtccgctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcacca

SEQ ID NO: 47490 - DNA, 424 bp, Zea mays
  Clone ID: LIB3066-009-Q1-K1-D9
cgaaaatgcagctcccctgcctcatgcccatcaaatcgttaaacttgttagatcgggaggcggagagaggccagactgatgggaatggcagcgaaggagcactttgtgcttgttcatggtgaagggcatggagcctggtgctggttcaagctccgctggctccttgagggtgctggctaccatgttacatgcattgacctagccggaggcggcgtcgatcctactgaccccaacacaatccggtcgttccagcagtacgacaagccactcatagacctcatttcaaccttgccggagggggagaaggtgattctaatcggacatggtgctggagggctgagtgtgattcatgcaatgcacgaatttgttgacagaatcagccaagcattttttgtggcagctacaatgctaccatttggatttc

SEQ ID NO: 47491 - DNA, 396 bp, Zea mays
  Clone ID: LIB3066-009-Q1-K1-E1
gatcaagtgcgataagcctgtggagtgcggcgggaagcccgtggtggtgcacataacggacatgaactatgagcctatcgcggcgtaccacttcgatttagcaggcacggcgttcggcgccatggccaataagggcgaggaggagaagctgcgcaaggcgggcatcatcgacatgcagttccgaagggttaagtgcaagtacgacttcaaggtcaccttccaccttgaaaaggggtgcggccccaactacctggcactgttggtcaagtacgtcgacggcgacggtgacattgtggcagtggacgtcaaggagaaaggctccgacacgtacgagcccctgaagcacttctggggcgccatctggaggaaggacagcgacaaaccgcttaagggacc

SEQ ID NO: 47492 - DNA, 422 bp, Zea mays
  Clone ID: LIB3066-009-Q1-K1-E10
ggaggggatccaatcccgtgtgctaccaaccccaaccccaaacccaaacccaaaccgatgagattagagcatcgctcgcaactttttaggaactcgatgtggtgtgcatcctatttaggaatgtgtactgaaaccatggctctacgcctgtcacgggcaaaacccaccttctagaatctagattagggttacaacttataagtgcttcaagtgtgtgtcggggacctttttggaaggagcgtgtctttgcaaggagtcgaattagctcctggtgttgatcctgaagctctggaagttgctaaggattgtctggagtccatttttagtgttaactcaacagccactggtgacgcaatacaaccaggactgttgtttgagctatttgcttctctcgaagcaaatgaaagagaccaggcaagagc

SEQ ID NO: 47493 - DNA, 420 bp, Zea mays
  Clone ID: LIB3066-009-Q1-K1-E11
gacgcattcagctcctcgttttttctctctcctctcttcgtccccgcgtgggcaaggagagagagaaacaggggagcgccccccactcctcttcgctgccaagaaaccaccattcctaacggatttctacccagtcttctttaggatttccgattcggttctccggtgagagggtgggaattttattttcctccgctgcaaccggtgcaaacatttcgaatccctccattccattcctctccgtgcaatcgaccattcatatgttccttggctgcattgaggcatcggtacgcgaattttgatgtgagctgaccagacatggctgcgaaagacggctcgggatcacaagatctgggggggcacacgttctggcccatgctgtcctacgcttgcggcgagctgtgtgtgatcgtactgctc

SEQ ID NO: 47494 - DNA, 426 bp, Zea mays
  Clone ID: LIB3066-009-Q1-K1-E12
cacagattagggtttcggcggcaacaatggttgcgcgacggcggaaccaacgcgcgtgggcgggtctaggctcgggcgatggaggctgatgtccggactacgatggcaagggcgggtggatccgacacgtgcgggcgcgacggtggctgacgtgcgaacacatggtcaggtgggatccgacacgaacgaggtgcggctctagccgacgcgcggcggggcgggtttgggatggacagaaggggtccgtgacggccggacgacaagtccgcgacatcggcggcccgccgctgacagatggatgacgaggaccatcaatcaggcatcgtcatccttgagacctagcccgtcataggaaacacatctgaggtgggagcggctgcaataaaaattcacaaaaaagggaggatgcaataaaacataagtgag

SEQ ID NO: 47495 - DNA, 417 bp, Zea mays
  unsure at all n locations
  Clone ID: LIB3066-009-Q1-K1-E2
gcgaatcacactttcatagtatctcacgcggttccgattcacacgcttccacatcccacgaccgcgttgtcgccgatccgatcgccgctcctgtcgagctcatcacccagagcacctccgatcgcatcatcgtgctgtctgtgaacatcggccgtcccgacgatggatcagtcgagtgctgacgctggtctcgccaaatctactcacgccgacttactgttgatgctgcccgacaccacgcttgttactcacctaggcgtgttcgatctactctggccgctctactgctgctncagtcaggcgctgtccctattatcctgcggccaggcgagttcacgcttcttatggtccagacaggtgcgttgaatctggtctcgccggacgactgctactacaggcacgcactgaacgtttttc

SEQ ID NO: 47496 - DNA, 417 bp, Zea mays
  Clone ID: LIB3066-009-Q1-K1-E3
cctcgctaaggttcttgtgctgcagccctgttgcatgccatagtcctagcatagctggcgggaatctcttgccctccttgcttcctgatcctgcgcccttggatcaccttccatgtgttcttggccttgttcactcgtgcatctgaccatcagttcttaagagtatatttccattggaagcaaattttagggtttcctgggagagactctgccaaccttttttttttgccctggtgcatctgcatcaacttgttcgtttctctctcgtaaaaaaaaaagctcactgtcgtaaacgttttcgccaattgatccatgatagactaacgtcgtgtagatgtcacaaatcctctccgaggtgagtcaccgctgcagatttatgaacaactcgacgctccggcgaggcacccatcttgttct

SEQ ID NO: 47497 - DNA, 341 bp, Zea mays
  Clone ID: LIB3066-009-Q1-K1-E4
cggacgcgtggggttgccaaagaattcccttccctagccgtcgtccgcgctcgtctggctgggaagttcccggacccgagattttgcccaattcttaggttaaaaatcggtttacctggcttaaccccgggtcttcttcctttggttgttgttaaagggaaaaaattcttagatctgttccggatcaagcgttccaactcgggaatcaagggtttcacacatatatttgtccatttgaaaattatgtactcaaggggtctaaaggtggcaaaaagtctagcaattgtcgttctatgatgtatgaagcttccctttgctacaacatttaggacgttcgacct

SEQ ID NO: 47498 - DNA, 421 bp, Zea mays
  Clone ID: LIB3066-009-Q1-K1-E5
cccacgcgtccgaacaagtgtacgtaaagggcggccagaagctacagcaggtgctgggtgaacaagaacgcactcgagggttagcggatgcttccagtccatctctccgttgttctactcctgctgatagtactggtagatcaaacaataggatttctgggatcgaatctacacctgtggatcaagacggaactggaccatccgctttacaatcaatggtacagggatttcataatcaaagtgcaagtggatggagggagaggtggttttctcggagcaactctttactggatcttggttctgaggtgaggagggaggtcaacgcggggattgctgcggtgtctcgcatgatggaatggcacgatgcaagggacgggacgggagcggagccttctcctacctctgcatcaagatctggttc

SEQ ID NO: 47499 - DNA, 416 bp, Zea mays
  Clone ID: LIB3066-009-Q1-K1-E6
gcgcaaggaggttgacgcctaccgactcctgctcggttttagcgctaccgaggagggggaggaggaggatgacgagcaggagatggtcacgccgcatagtttccccatgtacgaaggagagcccagctcgtccaaatcggtcgatgcgaatcggatgcaacattttgggaatgattctgggttcagcttcaagacgccatcaccgtgtgaacaaccaacggtgccgcctcttactgcagggcaaatcaatgtgggaagcgatgattgtgttgctgttcagacgccggccaaagttcccgtggttcaatcaagactggagctagatagctctgaggatgaggactaggatgaggatgatggaccagacacggtggaaatcctccccttatccgcccggagccaaaatttggatcaag

SEQ ID NO: 47500 - DNA, 155 bp, Zea mays
  Clone ID: LIB3066-009-Q1-K1-E8
attcccgctgcgacccactcatccgaatctagatccttagcacacactgtctactactcaatcttacatacccttacgtgcgacaatttaactattacataccttcaactaaattcaactaactcaccgtctacattacacaatctatactcaca

SEQ ID NO: 47501 - DNA, 410 bp, Zea mays
  Clone ID: LIB3066-009-Q1-K1-E9
cggacgcgtgggccggatcttgcgaagccgtgcaagtatcctgcttcgcggaggaggtcagtcatccgcctgccgagggccgagctcttccgagtttctgcggagagtgggcaacttttctcggtcccgaatcgatttgcctgctactcgcggtaggcgaagggaaggattcaaatcaacataacatggccgcagccaccgccgccgcttccaccatgtcgctgctcccgatctcccagctcaggcagcagcacggcgcgggcgccatgaggcggcggccctgggtcgcgcggcggaggcgatacgtcgttccgacggcgaggctgttcgggccggcgatcttcgaggcgtcgaagctgaaggtgctgttcctgggcgtggacgacgaggccggcagcaagcagcacggg

SEQ ID NO: 47502 - DNA, 409 bp, Zea mays
  Clone ID: LIB3066-009-Q1-K1-F1
cccacgcgtccgcaggatgccccgcagcggcatttcggggaccctcaggtcgccccggagggacgtggtcatcggcacggggaaccccttcctgaaccgcaccgtcgacggcttcctcaagatcggcgctgtcggcgcctgcaaggtggcggccgacgagaccttcgactgcctccacaggggggatgtttcaaagcgcaaggttgagcatgccctgaagaatatgtgcaaggagggcgcatattgggggactgttgctggcgtctacgtgggcgtggtgtatggcgtgcagagggtccgtgggcgcaatgactggaagaacgcgatggtccgacgcgccttgtccggcgcgctggtcttcggcgtcagcaccaaccacggagacaagatcgtcaaggacgccatcacc

SEQ ID NO: 47503 - DNA, 424 bp, Zea mays
  Clone ID: LIB3066-009-Q1-K1-F10
cgcacttcttgatgaggcatgtatgttccccaagtccacacacgagacgtttgcccggaagctataccagacttttcaaaagcacaagcggtttgtgaagccgaagctatctcgtaccgattttacaatctgtcactacgccggagaggtgctgtaccagtctgatcagttccttgacaaaaacaaagactacgttgtggcggagcaccaggaactgctgagcgcttctaaatgctcgtttatctccggattgtttccgcctccgccagaggagacgtccaaatcgtccaagttctcttccattggagctcgctttaagcaacaacttcaagcccttatggacacattgaactccacagagcctcactatattagatgtgtgaagccaaacaatgtcctgaaaccagcgatctttgagaacgtc

SEQ ID NO: 47504 - DNA, 400 bp, Zea mays
  Clone ID: LIB3066-009-Q1-K1-D7
cctcaacctccagcccaacctccagcccggaatcgagagcaatggcgctcgccgagggcaaggagatcgttgcctccgctcccctcgtcgtcttcagcaaaacttcctgccctttctgcgtccgtgtgaagcagttgttcgagaagctcggagcaagctacaaggccattgagttggataaggaaagtgatggagctgagctccagaatgccctgaaggagtggactggacagaggactgtcccaaatgtcttcatcaatgggaagcatattggcggctgtgatgatactatggcactgaacaatgatgggaagctggtgcctttgctgactgaggctggaaccatcgccggttctgcctcgaagacaaccatcactgcttgacatgtgtgtaaccattc

SEQ ID NO: 47505 - DNA, 430 bp, Zea mays
  unsure at all n locations
  Clone ID: LIB3066-028-Q1-K1-C11
attttactaatcaaattcttgttgggatatattcctccaattcccctcctgctcccagcaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcngggagcgcggccgacctggcc

SEQ ID NO: 47506 - DNA, 210 bp, Zea mays
  Clone ID: LIB3066-028-Q1-K1-C12
aaaaaacaaaacaaaaaaaaaaaaaaaaaaaaaaaaaaaaaaaaaaaaaaaagataataacaactaaacaacaaattattccctctatcattcaatcccacttatttatcatacttaacccaataatccattcccacataaactcatctctcagtccaatctaacgatctctaccttttcaattaccatacatcatctttacccaaaacc

SEQ ID NO: 47507 - DNA, 251 bp, Zea mays
  unsure at all n locations
  Clone ID: LIB3066-028-Q1-K1-C2
cgccgtcgtgcgagagggaggagggagctctggacctccgtggggcgtggaggagtgggacgacgcacgccgaggcagccccggtcagttgctgctgtatccgtccaggatcggnggaattccaggaggcangaaggaaagttgagtgctacatagctgagtaccacaggtgatagattgatggctggcgctttggctgaggacaatgctggggatggtagatcctcatcaactgaagagatgtcaagtga

SEQ ID NO: 47508 - DNA, 383 bp, Zea mays
  unsure at all n locations
  Clone ID: LIB3066-028-Q1-K1-C3
gctccccgagatcaggaagaaactcttcagccagcgagtatcgtcctaatgttttttttttgttactctgatcgattgttttctgaaataaaccagaagcggtccgatcctacgaagatacacaggtcctgacattgggtgaagcccgtatgtgcacgtttcggatttcgcaacatcgatttgagcttcaacagttcttcgctagcttgtcggtagaggcggcaatggctgaagttgagtctgtatcccggtggataggggacctccgcgaccgttaccctgagtcgagttgtcacagtctgtatctatcgctcctgaaacctgangggcctgtattgtttgtcaagcacttttgtttcttctcttctggttgtaggctacta

SEQ ID NO: 47509 - DNA, 297 bp, Zea mays
  Clone ID: LIB3066-028-Q1-K1-C4
ttctggttccttaagtttgtgggccgtggctatttaatctccaactgcatccccagaagagctcgtctagatgagagactgggaactccgggattgggttggataaggtgttctgggaatggggaaccaatgcccaaacgggacccttgggagtgactactacaaccgcgccgcttccaggttcgctgatggttgccttgaggacgatcgctactctgacttgaagaagtttgacaagccatggcctgaggtgaactcgtttaagcccactgctgttggtattttgaagaggggatt

SEQ ID NO: 47510 - DNA, 366 bp, Zea mays
  Clone ID: LIB3066-028-Q1-K1-C5
cccacgcgtccggaataattttactaatcaaattcttgttgggatatattcctgcaattcgcctcctcctcccaacaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaagcg

SEQ ID NO: 47511 - DNA, 360 bp, Zea mays
  Clone ID: LIB3066-028-Q1-K1-C6
accaaaccgacgatggcgtcgaataagacggtcctcatcgtcgcggcgatgcttctcatgacgctcgtgctggaggccgcccctccggcgaccgccatggactgcaaggccgggtgtgacgaggtcacgggcccactccacatgagcatggaggactgcatgaagaggcactacaacaacatcgcgcgtgcagttgctccggctaatgcatgaccggccggggggtgggagggggcttccgaccgttgctctggggctgggccgatgagacatgatgacacttcagtgccaaccatgcatgataccgtgtggtagattatgtgcaacgtgttcatgcttatttaattctgtgcttgagca

SEQ ID NO: 47512 - DNA, 416 bp, Zea mays
  Clone ID: LIB3066-028-Q1-K1-C7
aaaaggaaaagaaaaggcaggagaataacgaagcaagatctgccgcggctccattttaactggtcggcgcctccgccgctgccgtcttccccctctcccctccgtaccactcgtcttcgtctagcctcccgcccgcagccaccatggcacccggcctctacaccgacatcggcaagaaaaccagagatttgctgtacaaggactacaacacgcaccagaagttctccctcaccacctgctcgccccatggcatcgcaatcacagctgcaggaacaaggaaaaatgagtccacctttggcgaatcttcacactcaaattaagaacaataaattgacggtcgatgtccaagcgaactcagaatcagatcttttgacaacaatcactgttgatgagattggtacctcagggctcaaatc

SEQ ID NO: 47513 - DNA, 433 bp, Zea mays
  Clone ID: LIB3066-028-Q1-K1-C8
agggtttatgtcagttctgttgaggaaataggatttcatttgagcagatacatgatgtcaagctgacttagcagaacccttctgtggttggatgcagaacccttctgtggttggatgctggttgctggtgttgcgatctgttgccaccttgtttattgttatagtagtggccataaaattagctggttcatgtgtgtattccagtttcatagagaaaggacatgttggtcgtagtagggctaatttgacattatggttactaattattctttaaactatttgagtacacgtgtgttacaactgggacatataattacataataacttatattctaaatgtgtcttatattgttataagaaaatggttcataatccatttggtatccttgccatacattaaatttggtttttaaatttagttgtttcacttcct

SEQ ID NO: 47514 - DNA, 432 bp, Zea mays
  Clone ID: LIB3066-028-Q1-K1-D10
ccaatccaaaccagacaagcaaggaatcccccgatggctcatcgcgttctcctcctcgtctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacgaggcgcccgtgctcccc

SEQ ID NO: 47515 - DNA, 436 bp, Zea mays
  Clone ID: LIB3066-028-Q1-K1-D11
cccacgcgtccggtggatggcaatcgacatttctcactaaagataaagctgttgccgaggaaagggccgcaaagctcgggataaagctagaatggaccgacgacggcgtgaagacggtcatgggccccatccccgcggtgaagtgggacgagagccgaggacggaagatctggttcaacagcattgtcgccgcctacattgggtggaaggacgcccggaacgaccccacgaaggcggtgaccttcggcgatggctcacccctgcctgctgacgtcatcgacgcgtgcggccaggtcctagaggaggagtccgtggccgtgccatggcagcacggcgacatcctccttatcgacaattgggccgtcctgcactcccggcgctcgttcgagccaccgcgtcgcatcctcgcctcgatctgtaaatgatgtgtgtagat

SEQ ID NO: 47516 - DNA, 432 bp, Zea mays
  Clone ID: LIB3066-028-Q1-K1-D12
accgccctgcttcccctctggtgttgggaatttgtgattttgacatacgacctgtatgggtatttttccggccggtgaaggatgataccaggatggacgcgctgaagtgtaacaacaactgcgccccgccggaggagaccgcggaggacgccgacgccgccggggcgctcgtcgagaaagacgggttctcggtcgaggacttgttggacctcgaggagtttggcgagcctgacaaggacggcgccgagcatgaggacgacgacgccccgccggtacccgccgcggccgaggagaggtcgaaagacgactcgcagccgttgtcggtcgtgacgtacgacctcccgtcgccgccgccggagatggttgacctgccgtcgcatgacgtcgaggagttggagtgggtgtcccgtatcatggacgactcgctctctg

SEQ ID NO: 47517 - DNA, 379 bp, Zea mays
  Clone ID: LIB3066-028-Q1-K1-D2
agatgagggtgctggtcgataatgggggaaagagctgagttccctctgcatatataggccggcggggaggagactctggggcatgggggaggaggagacatgacatgatggcgtcatggcgagcgagtgatgcgctctttcccagtcttctcttgcgtcgtactagctgacttttattgttactgccctaattctcaaggcagtgtctgttaaccaaatctcatgcatagttatctggtcattatgtaattaggagcttgcatttagctgcacgtttatgttcctaataaatatctagctgcatgtgtgtcgagcggttgtgcggccagaacaacgctgcgttcggtgtgcggctagggagtggtcaccgccatgcagt

SEQ ID NO: 47518 - DNA, 383 bp, Zea mays
  unsure at all n locations
  Clone ID: LIB3066-028-Q1-K1-D3
gcaaatcgaagggcatactatctgtgcgcttggggatgctgcggcatggcctgtgcaggggcttatgaggcacttcaggccagagttggagcggaggatccgcgagcgagctgaaagggagctgttggcggcttctgcataatgtgccagccatgttgcccctgtactagtttcctgatctcttcctaccgaaataatacaaactgatggagctcctttctgtgtaaggaaatgtagccttcctgatttctttaaaccatcatttatttgatgcactcaagcagctggtgaattttgatggactagataaactttccaaagagaaacaaactcgagggttgtaccgtgtatgctacataatattatngtggatgtggatgtct

SEQ ID NO: 47519 - DNA, 414 bp, Zea mays
  Clone ID: LIB3066-028-Q1-K1-D4
gtgcaccaccccgctcaccttccaggtcggtaagggctccaagcccggccacttggtcctgacccccaacgttgccaccatctctgacgtggagatcaaggagcacggtggcgacgacttctcctttacgctcaaggagggtccgactggcacttggacgcttgacaccaagaccccgctcaagtaccccctctgcatctgcttcgctgtcaagtccggtggctaccgcatcgccgacgacgtcatccccgccaatttcaaggccggcaccacctacaagaccaccctcagcatctgattagcctcttatgacgaatgatatttcaagagagctcatccggcccatgtgccagcgagctaatatttaattgtgtttctttggatatattgagggaccacacgagccaagaaaaa

SEQ ID NO: 47520 - DNA, 383 bp, Zea mays
  Clone ID: LIB3066-028-Q1-K1-D5
cccacgcgtccgcctcgtccagtcgccggttgcgtacgtgtatcgaccaacgacgctgtagtgctgagaacagattgaggacacatggacatgacggaggaggcggcggcaggagcaggaggctcatcgtcatcatcggggaagccggtgatggtggtgggcatcgacgacagcgaccacagttactacgcgctgaactggacgctgcagcacttcttcgtcgccgggcaaccgcagcagtaccagctggtggtgctcaccgccaagcccccggcatcgtccgtcatcggcatcgccggcgtgggctccgtcgagctgcttgccaaggtggagaccgacctcaagcgctccgtcggccgggttatggacaaagccaaagaagc

SEQ ID NO: 47521 - DNA, 426 bp, Zea mays
  unsure at all n locations
  Clone ID: LIB3066-028-Q1-K1-D6
cgtcatcgtcgtgggccttcatttctcctagaaggtcgagaggagaagaaggcgagacgtgcagtccgtcgggctccgatcgagaacagggaagcaagaggctgctagatcgagctcatcaaccaaccaagtcgtacgtcgtcagcatcacgaccggatggcgcgtgccgcgtccagctatgtatccaggagggggctctccgcagcgatgacggtggcggaggagtccgtgaagaaggtggaggacaaggcggtgaagctgggaactgtggccaaggacatcgccagcgccatggccaccacgacggaggagaagacggcgttctgggaacctgaccccgagaccggatactaccgtncggtcaccggcacgaaggatgtggacgccgtcgacctgcgcgccgagatgctcaagcggaggatgct

SEQ ID NO: 47522 - DNA, 233 bp, Zea mays
  Clone ID: LIB3066-028-Q1-K1-C10
aaaaaaaaaaaaaaaaaaaaaaaaaaatataaaaaaaaaaaaaaaaaaaaaaaggaaaaaggaaaaaaaaaaaaaaaaaaaaaaaaaaaaaaaaaaaataaaaaaaaaaaaaaaataaaaaaaaatataataatttttaattataaaacatatggtattttaaaataaataaaaataatacaatttattatatcaaatattacataaaataagctataagaaaaacttaaaat

SEQ ID NO: 47523 - DNA, 316 bp, Zea mays
  Clone ID: LIB3066-028-Q1-K1-A3
ataaagacgattcactatcctctgcaactcttttgaggggctgggaagtcacagtaattagacaagaggaaacaactgagggtcccttggaaatgcaaatagctcttccatcgatgccttcattgtacatcatatcctttctttatcaagcatgtttggagattcataaggttggagggcacatcctggacaggattattttgcataattttgcttgggagctactgcagaaggtcatcaatatttatgaaaattttctttcatctgttgaatctgggaattctccggtttcagagaaaggaattctgcaaatact

SEQ ID NO: 47524 - DNA, 163 bp, Zea mays
  Clone ID: LIB3066-028-Q1-K1-A6
aaaaaaaaaaaaaaaaaaaaaaaataaaattttaaaaaaaaaaaaaaaaaaaaaagaaaaaggggaaataaaaaaaataaaaaaaaaaaagggcggatgttttgggggtcctttttttggttccacgtttatgcaactttttttctatttttttgtgtctcct

SEQ ID NO: 47525 - DNA, 385 bp, Zea mays
  Clone ID: LIB3066-028-Q1-K1-A7
gcgatctcgaccaatggcggcaccaactgtggtgctcatcccgttctgcgtcaccgggcacctgacgtccatgctccaagccggcaagcggatgctgatgagcggcggcggcgacctggccatgtcgctcaccgtgctcctcgcgccactgccgatggccaggttctcgcacatcgtagagcgggaggccacctcgtgctcggggttcgacatccgcttccaccgcctacctgacgtggagctccccgccttctccggcccggaggacatgatctccagtttcatccagctgcaggcgtgcaacacctaagcgggcattgtcggcctggtaagccccgtcgccggcgacgttatggactacttttgcaccacgctgttcgacgtc

SEQ ID NO: 47526 - DNA, 255 bp, Zea mays
  Clone ID: LIB3066-028-Q1-K1-B10
catgaccatcttcattgaccgcgacatttcgtctcccaccactgactcatggaacctgaactagatcttaaccaccgtgatcgcgctcgacacctacatatccatcatcactgacaactacttatacctcacccactacaccaacttcttcacgaacgatttatgattgaattacatcaactagaacgaccagttaacttatgccatagctatacctacaaaccatcatcatcatcaaggcgctcatcttcacaa

SEQ ID NO: 47527 - DNA, 244 bp, Zea mays
  Clone ID: LIB3066-028-Q1-K1-B11
cccacgcgtccgcccacgcgtccgaaataaactatgaattagtgaattcaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggacccttttaaagggaaaaaattttgaaccgccgaat

SEQ ID NO: 47528 - DNA, 433 bp, Zea mays
  Clone ID: LIB3066-028-Q1-K1-B12
ctcctcctccttcctcggccaagcgaggagcgaggcgcgggcgcgagcgcgtcgttgagatggattcggaggcggtgcagcacggctgcgcgcattacagccgtgggtgcagcgtcgtggcgccctgctgcggccaggccttcggctgccgccattgccacaacgacgccaagaactcgctggaggtcgacccgcgcgaccggcacgagatcccccgccacgaaataaagaaggtgatctgttctctctgctccaaagaacaggacgtgcaacagaactgctccagctgtggggcctgcatgggcaagtacttctgtaaagtatgcaagttcttcgatgatgatgtctcaaagggccagtaccactgtgacggatgtggaatatgtagaactgccggcgtggagaactttttccactgtgataaatgtgggtg

SEQ ID NO: 47529 - DNA, 373 bp, Zea mays
  Clone ID: LIB3066-028-Q1-K1-B2
cggacgcgtgggttgtactccagcctctcgtactggagagatgctgagatttgttttgaacaaggctagagccctcaagttgtactcagctgcaacactccatgcagaaggctacatgcatgaggcgcgagatcaaacaacggatgcactggccgcctacgtcaacgcgttctcgaccgagcttgagcatgtgccgtccaaggtggccatcggcgcaatgctctccaagcaaggtcccaggtttctacctgcagcgaggtgcttcctctcggacgcccttagagtcgagcccacaaaccggatggctcggctctacctaggacaagtgcacaggtcttgatgggaggatctctgacgctgccgactgctttca

SEQ ID NO: 47530 - DNA, 249 bp, Zea mays
  Clone ID: LIB3066-028-Q1-K1-B4
gcgcactgcatgaggacgaggccagcgaagaagggtcacggatgtgcgctgcagttgcgggcgcggcggtgaccgccgcagttggagggtcggagcccgatggggcagcggcacgcctctgcaacagcctgcggggtctcggctcaagggcggtcggtgcacgtgcggggtcaggtgaagcaccagcccacgccagcgaccgccaggacggcccgcccggacgcccctggacagcccggtctcggagtc

SEQ ID NO: 47531 - DNA, 484 bp, Zea mays
  unsure at all n locations
  Clone ID: LIB3066-028-Q1-K1-B6
cggacgcgtgggcggacgcgtgggtgcatctgtcaagctgcgcatccagcagttcaagggctttgtggcgacgaagcagaggcttgtgctggatgggcatgagctggcaagaaacaactccccagtcaaggattatgggctggccgagggaaatgttctgcatcttgttattcgactatcagatctacgtgtgattaacattgagactgcaactggaaggaagtttcagtttcagggtggaccagagccgcaatgttaagtttctcaagaataagcttgaagcagagggtgatgaggatattggtaatcttgaggatcacaagcttgaatatgatggtgaggagcttgaggacaaccagctgatagctgatattagcaagaaggatgatgctgtgattcatttatttattcgganaccagcaaaggtatggacacaacaagttgatggagatactttggttacagttgtcaatccacagggaaa

SEQ ID NO: 47532 - DNA, 471 bp, Zea mays
  Clone ID: LIB3066-028-Q1-K1-B7
gtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttcttctccaaataccaaccaaattcaggggttacctcttgtctctctctctcttttcccttttgattaaaagtaagtgaattaggcgagggtttaattatttatttt

SEQ ID NO: 47533 - DNA, 399 bp, Zea mays
  Clone ID: LIB3066-028-Q1-K1-B8
agtacatcgattctccccccaagatcaaaggccggagaaggaggaagaaaggttagggagtcggctatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaaagaaattacaaaaaaactcagcagtgatgccctcattggcgagggctcgtatgccagagtctattttggtgtgctgaaagatgggacgaaatctgcagtgaagaagcttgactccagcaaacaggctgatcaagaa

SEQ ID NO: 47534 - DNA, 438 bp, Zea mays
  Clone ID: LIB3066-028-Q1-K1-B9
catgaccatctccaaggaccgcgtcaagccgtcgcccacccccgactcgtggaagctcaacgagatcttcgccaccggcatcgtgctcggcacctacatggccatcatcaccgccgtcttcttctacctcgcccacgacaccgacttcttcacggacgtgttcggcgtgaattcgatcaaggagaacgacagggagctgatggcggcgctgtacctccaagtaagcatcatcagccaggcgctcatcttcgtgacgcggtcccggagctggtcgttcgtggagcggccgggcttcctcctgctcttcgccttcttcgccgctcagctggtggcgacgtgcatcgcggtgtacgccgactgggacttctgccgcatccaggggatcggctgggcgtggggcggcgccatctggatgttcagcatcgtcacctacatccc

SEQ ID NO: 47535 - DNA, 308 bp, Zea mays
  unsure at all n locations
  Clone ID: LIB3066-028-Q1-K1-C1
ttgacgcgtgggcaagttcaacaaggtgtctttagctctgtagcggtatgcatggcttcgggtgccggtgccaccgtcaccggcagtgggactcgctcatcattgctcggtgagttnaacaacgtgccttcgatgatggtggcgtgagatacgcctgcaactcctaccaggtggctgcgactaggggcgtggcttcgggaggcggcgactccagctccatcctcacgacgactgttgggggccttcatttttcgaaggtccttaataacacggctaaccatctgttttcagcatattatgaagtatta

SEQ ID NO: 47536 - DNA, 319 bp, Zea mays
  Clone ID: LIB3066-028-Q1-K1-A2
cccacgcgtccggccagcgctcgcttctccccgtccccgccctccttcctttccttgtctagccgaaggccgaagccactgtgcgcgcgagcgcgacgcgagaggtagctgctgctgtgcccggcgcgcgcgtgcgtgcgacgatgtcgtcggcggtggaggccgtctcctgccccaaggtcgacgtccccgccggcccggagccgggggagccggccaaggaagcggcgccgtccgcggagcactgcgacacggcgcccaacggcaagtgcgcgccgcgttgccacggggaggaggaggacgacgacgacgaggagga

SEQ ID NO: 47537 - DNA, 436 bp, Zea mays
  Clone ID: LIB3066-027-Q1-K1-G7
cgcttctcctctccgggaatggcgtcggcgcgaggaccttgcggaattagtgtccgttctgacttcagttcagcctgccttattcacaaggctggagccccatcgaattctgtttctggcgtgatggctgttcaggttcaccgccaccgtaacaaggtccgcaatggccaagctatcaggtgtgcaatggcaactggaaaagagcagggtgcaatttccactgccagtagcggtgatcaaaccaagggcggtttgcgtggaaaattaaacaaagttgttttagcttatagtggtggtttggatacatccgttattgttccatggctcacggagaactatggttgtgaagtcgtttgtttcactgctgatgttggccatggtgccattgaattggaagggttggagaagaaggcaaaagccagtggtgcatgtcagc

SEQ ID NO: 47538 - DNA, 328 bp, Zea mays
  Clone ID: LIB3066-027-Q1-K1-G8
cacacggctggctcgctgcccgccggcttttaagagcgcgctaggacagtaggacgcgaacgagtctgcggccagccagcaagcagtgcgagtacaggcatggcggctgccggcggacgcgcggttgcggtggcagccatggtggcggtggtggcggcggcggctctgcctctgctcgcgtgtggcggttacgcggagtgctacgactactgcttcaaggactgcatctccaaggacaagtccatgagagactactgcagctacgcctgcgacaagacctgcgcgcccgacgcccggcagcggcgccccgcggtcgttcccatgaact

SEQ ID NO: 47539 - DNA, 263 bp, Zea mays
  Clone ID: LIB3066-027-Q1-K1-G9
atgacgcgtggcccaacgcgtggacaacgacatgcttatcaaggacgctaccgtgaccactcacggggacagatacaacacggatggcatgcacatggaccactaacccaacatcaccatcaaccacaccttcattgacgtagacaacgactgcatctgcatctgtgccgactcctccaatgtgaacaacaccggcatgacctaaaaccctggccaccgcatctgcatcgacaacctatgtcagtacacagacaagatcgacg

SEQ ID NO: 47540 - DNA, 453 bp, Zea mays
  Clone ID: LIB3066-027-Q1-K1-H1
cccacgcgtccgcccacgcgttcgcccacgcgtccgcccacgcgttcgcccggcgctccacagcgggtccccgggcccgggcgccggcgacctgcggggcttccacacgcagatgacccggcgcgggagcagctccgcgacggtcttgtggaacaccgccttgtcctgcgggatcagcaggtgctcgccgagcctctccaccaggaacctgccgaactcgggcgggtcctcgtgcccgaactcggtgcgcacctccaggacgaccacctcggactcggtctcgcccaggaaccttgccacgtcgtccagcaccacgtcgacggggtacgtggccaggacgccgtggcatacgcggcgccccttctggacgcgcacgtcgaggacgcgcgcgcccagcggcagctgctcgtacacggacagcgactggcactgcgcgaaggggcgggtcacgaa

SEQ ID NO: 47541 - DNA, 453 bp, Zea mays
  Clone ID: LIB3066-027-Q1-K1-H10
tccacgcgtccgtccacgcgtgcgagcatacactctgcccatgttgcatgaagaaagacaaagatcaggttgatgtcgtaggcgagaaggccctcattgagataaaaaagcagtacaaagtgattgatgcaaagtttatctctaagatcccaatgttgtctgagaagaaacaacactgagagagggtgctccaaaggtctaattcagcacattaccaatatatgaaagtagttcctttggctctgctatatcatcatttagcaacctttaagatgataccatagatattatatggattcctaaggttggaaatttgtgtcttccgagtcccctagaatagttgcttcttcctgtctgacagtgaatttgattctggatggatgtgacatatatatgcctgaccaattgtcattatttgctattcatatatgttactgcgtgtatttaatagct

SEQ ID NO: 47542 - DNA, 451 bp, Zea mays
  Clone ID: LIB3066-027-Q1-K1-H11
tctgtcttacactattttcctgatggcatacactctgcccatgttgtatgagaaatacgaagatcaagttgatgtcgtaggcgagaaggccctcattgagataaaaaagcagtacaaagtgattgatgcaaagtttatctctaagatcccaatgttgtctgagaagaaacaacactgagagagggtgctccaaaggtctaattcagcacattaccaatatatgaaagtagttcctttggctttgctatatcatcatttagcaacctttaagatgataccatagatattatatggattcctaaggttggaaatttgtgtcttccgagtcccctagaatagttgcttcttcctgtctgacagtgaatttgattttgtatggatgtgacatatatatgcctgaccaattgtcattatttgctattcatatatggtactgggtgtatttaatagc

SEQ ID NO: 47543 - DNA, 375 bp, Zea mays
  unsure at all n locations
  Clone ID: LIB3066-027-Q1-K1-H2
cccggtcgaccccgcgtctcgtccacgcgtctcgctgccctacagatgcacaaggactgggtatcagtccatccgtcaactccgattgttgagcttncacaccttaaccgtgttgtcggatggactgtttccctgtcctacagatgcacaaggactgcgtgagagatgtcgcgtgggccccatacctgggccttacaaagtccaccatcgccagcgcctctcaggacagaacggtcgtcatctggacagcatcatgagaaggcgagcagtgggactgccggatgctgtatgatttcagaacccccgtttggaggcttgtctggtcactgactgggaacatactggcggttttcgacagcatcaactatgttaccc

SEQ ID NO: 47544 - DNA, 424 bp, Zea mays
  Clone ID: LIB3066-027-Q1-K1-H3
cccacgcgtccgaccaaaccgacgatggcgtcgaatgagacggtcctcatcgtcgcggcgatgcttctcatcacgctcgtgctggaggccgccccttcggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtgtccactcgatcgagagatcgatcgatgcttggtattatatttggatttcacatta

SEQ ID NO: 47545 - DNA, 485 bp, Zea mays
  unsure at all n locations
  Clone ID: LIB3066-027-Q1-K1-H5
atttcttgcatttctccaaacgcaggctcatgtgaacacacactaaataccttgagatacgctgatagggtcaaaagtctttccaagggtggaaacacaagaaaagagcagcccacaggaccaactaccacttctagccgggagtcttcgtcagctccatcatattcattgcctgctgaagctgaagaaattcctaaccagattcaagagaagagaccagttgatacttatcggaaaggcactgaaaattttacctccaacccttccgcggagcctgatagaaattccttcagtatggttccaaattattctaataaagggagagaagacaatggtgcagcatctggtaatgatagggagaggtatgatttgaagtccacccaaactgcttacactagtaaggcacagttggttcagaattcaacatacacacaggaggagaaagtcacaaaagtctcacctnctcggagaaaggcttataaaga

SEQ ID NO: 47546 - DNA, 72 bp, Zea mays
  Clone ID: LIB3066-027-Q1-K1-H6
aaaaaaagaataaaatacaacaacaagcaaaatgtgaacacacactaaataccaaagagaaacgctaataag

SEQ ID NO: 47547 - DNA, 481 bp, Zea mays
  Clone ID: LIB3066-027-Q1-K1-H7
cggacgcgtgggcggacgcgtgggtttctcagagattattgtcaaagattacgcatatccaagggcgatcgcattagcgatagctcaagtcctgatggcgatcgggcacttcaacttcgcgatggcttggcccgggacaatgtacatcggcacgctgctcgtcggagtaggctacggcgcgcactgggccatcgtgccagccgcagcctcggagctgttcggggtgaagaacttcggagcgctgtacaacttcctcacggtcgcgaacccagcaggctccctggtcttctcgggggtcatcgcgagtggcatctacgacagtgaagcagcgaagcaggctcagcagcgccacaactccacgtcgctggcgatgagtggcagagtggctggcatggtctctggagccgctccgtcgttgaagtgcgagggcgccgtctgcttcttcctctcatcgctgatcatgtccgggttctgcatcatc

SEQ ID NO: 47548 - DNA, 401 bp, Zea mays
  unsure at all n locations
  Clone ID: LIB3066-027-Q1-K1-H8
cccacgcgtccgacaaaagagagaaccggcggcgagctaggagctagccatggacggacacggcgcggtctcgccgtggagcgtgctaggcggggcggcggctgtgctgttcctgtggttggcgtcgcaggtgctggagtgggcctggtgggcgccccggcgcgtgaaccgtgcgctgagggcgcagggcctgaggggcacccggtaccgcctcctctgcggcgatctcatcgaggagcagcgtctccgcgcggcggccctggcaaggcccgtccccgtggatcgaccacacgacttcctccctcgcgtcgcgcctttccttcaccgcgtcctncaagagcacgggcagctctcgtttacatgggttgggccgaccccaaagagtctaatcaccgatcccg

SEQ ID NO: 47549 - DNA, 422 bp, Zea mays
  Clone ID: LIB3066-027-Q1-K1-H9
cggacgcgtgggcggacgcgtgggcggcggcgtcggcgtcggcgagctggaggcctggctgcgctggcaggccgccgcccggctggacgccgtcacgcggagggagatggctccgcacgacacggaccgcgacggtgccgtcacgctgcgcgagttcttcgcagactggatcaacatgggacatgacaaaatggggtggtggatgcacaagtttgcgagcgcggacagagacggggacggctcgctcaacgccgtcgaattcaacgacttcctgcatcctgaagacagcagccaagagagcgtgatgctgtggctactcaaggacaagctaagcgagatggaccacgacggagacggcaggctaagccaggaggagttcgtcgcccaatctcacatcatcatctccggcgcgcgtcacgccg

SEQ ID NO: 47550 - DNA, 355 bp, Zea mays
  Clone ID: LIB3066-028-Q1-K1-A1
caggaatctgttatttctactgtcctcaagctctgcctgaaaagcttgcaagaatttgtccgtcttcagactttcaacagaagtggatttcagcagattcagctggatatggaatttctcaagacctctcttaaggaatttgtggatgatgaagcagccattagctttttactcaaagaggtgaacaatgctgcccatgagagatgtcttgacccaatccctcttgagccccccatattagataagctcataaatgcaaaactagcaaaaattaaagagagaaacccaaatatgcggtagctatgcacagattggtgtctgttactagaattcaggtctgtccatttgaatgcac

SEQ ID NO: 47551 - DNA, 428 bp, Zea mays
  Clone ID: LIB3066-028-Q1-K1-A10
gccggggatccgcgataaggcgaactccaagttggcgcttagagaggagcaatacagcggcatgcttctgtcggcctacaaggagatggtccgtcagctgtcctacttggttgaagcttcccattctatgcgccgtttttctaaagcggctccaaattgccccatcacacagttttctgaccgccaagataatttgaatgattcaggggatggtggaggagccccagtattcaaatggttctctgtattagaatttgagagtcttgcccaggagcttgttcagatgtttgtttcagagcaaaagttgaagaggctgctactcttggaatttctctcgattgctttaaaggaaggtgtagaactccagacatcattaaattggggtgatgaactatatgatggtgaatcaaataaacttcagagtattg

SEQ ID NO: 47552 - DNA, 303 bp, Zea mays
  Clone ID: LIB3066-028-Q1-K1-A11
cccacgcgtccgcccacgcgtccgcccacgcgtccgataacgatatatttatgacagggccaacaataatttgtaagctaaattcaagcattttattttatatttcaataaagaaagggagaaaagctacctcctgatcaaaaaaaaaaaaaaaaaaaaaaaaaaaaaaaaaaaaaaaaaaaaaaaaaaaaaaaaaaaaaagaaaaaaaaaaaaaaaaagagacaaaaaaaaaacaaaaaaataatctgactaagaaaaaaaaaagaaaaaagaaagaacttggtgagccttaatctttaggg

SEQ ID NO: 47553 - DNA, 243 bp, Zea mays
  Clone ID: LIB3066-028-Q1-K1-A12
aaaaaaaaaaaaaaaaaaaaaaaaaaataaaaaaaaaaaaaaaaaaaaaaaaaaaaaagagaaaaaaaaaaaaaaaaatataaaaaaaaaaaaaaaaaaaaaataggaaatacggtgggatggttttaaggttcctgctgataaaattcggtgcactggctttagaattctattatggtgactggaaaaactgtggatttgcctaaattattgggcttggaaaattgttaaatttttgcagtt

SEQ ID NO: 47554 - DNA, 308 bp, Zea mays
  Clone ID: LIB3066-027-Q1-K1-G6
aaggactaaattattatactctaaatacatatacatatatagtattaacagagggatctgctggaaattgtaaggtataaaaatttatgatctatagcttgtgctgggcacaaccgcacgagctatatatgtagtttggttacctttttaatttgtggcagagatggcgaatttagttaggtatatacgtttgctttttgcaactttgcattgctatatggcaaattttgaagcatgtttatctgttgtactagctgaaaatgaattcgttctgtgctaacaatgtattcaataaatatctcgatttt

SEQ ID NO: 47555 - DNA, 346 bp, Zea mays
  Clone ID: LIB3066-002-Q1-K1-E8
aaggacgcggcgaggtccacctccagctctacctgcccggctggcggctgcccccgtcttcgtcttccttaatctcaaattcccaatcctcctccgacgccttgtttctggatcatccagcggggggacgccggtgtattgctcggtcctcctccctggttgcccgaggcagccgtgacggaggcggaggtggcggtgggggaccatgtacagatcggcgggggtcgcgatggcgtggaacgtgttccgcgtctgcacggctctacgagggctgggttccatcatgagcctactcgacctggccatcgacggcgtcacctactacgctgtcaccatgtgcatctac

SEQ ID NO: 47556 - DNA, 360 bp, Zea mays
  Clone ID: LIB3066-002-Q1-K1-E9
ctttcttaaagaaaaaaaattcttggttactgggagtggtgggaagccgtacaccctttcttcacaattcttaaccaatgcttgttgttcaccttttccatttggttcagggaaaaaggcttctatattttctaattggcttatagctcagcaaaagaatactacagacagtggagtttatttgtatccagatatacaatgtggagaaattgttcatctattctctctggttttgtcaggaaaccttctcatttcacctttcttgcctagtgaaggagttggtgaggctgatgagcctaacagctctggtcctttggtcgtagataccagcggtttggctgacaacagtcataagcgcaa

SEQ ID NO: 47557 - DNA, 425 bp, Zea mays
  Clone ID: LIB3066-002-Q1-K1-F1
acggctcatccagagggcaagcaatagttagttccgatctgtgtgtgtgaaagtcttggttagacacagatcctagggctcagcctggccgggaaggtagagcttaaccactaccagcgacaggaggaggttgcgagaatgtcacagcttttttcttcatgtttatcactatcatgtccatcatcggcgtggttttgtctttcgtcaagcacacctgtgaattaaacagcaaaagaggtaagaggaaaagagcatagcttaataggtatcaacacagttcagtgacgtttgtattctgagatgtttctcatctattaaagccttagttctttgttacctttttcacaactctgtactgttgcctcatattctgattgcgttttcaaaatgtgatgttggtgaaacaaaacgtattgatggtttgt

SEQ ID NO: 47558 - DNA, 410 bp, Zea mays
  Clone ID: LIB3066-002-Q1-K1-F10
cacccgcgcgcgcggcggccggcggcgagccctcacccatccgagcaagccgaggaggaagcgagcgcgcgaaagtatcaggaggaggcatgggtaccctggggcgcgcgatcttcacggtgggcaagtggatccggggcacggggcaggccatggaccgcctcggatccaccatccagggcggcctccgcgtcgaggaacaggtttcaaggcatcgtacaatcatgaatatttttgagaaagagccaaggatccatagagatgtgtttgttgctcccagtgcagcagtcattggggatgttgagattggtcatggatcgtcaatctggtacggatccatattgagaggtgatgtcaacagcattcatattggatctggtactaatatacaagacaattcccttgtacat

SEQ ID NO: 47559 - DNA, 415 bp, Zea mays
  Clone ID: LIB3066-002-Q1-K1-F11
cttctcgaagctcgtggtgggggcttcaccagtggaggtggagatcttctcgaagttggtgctaccccccccacggccgacacttgtaagctctccaccactgccaccaatgacctacccacctccaccaactctggcgagctcaccgcctcctgcactgaggtcccctcctccaccggcgccaatcaactctccacccacaccggtcaaatcctcaccaccacctgctcctgtgagctcgccacctacaccagccttcccatcaccaccttcacctgcaccatcatcaccttcaccgtcggcacctgaggagttcatcttgccaccaatcatggctcaacattatgcgtcgacaccgtcggctctgttccaaggatactaagcggtgatcacagcgcgctctactgacgatgag

SEQ ID NO: 47560 - DNA, 396 bp, Zea mays
  Clone ID: LIB3066-002-Q1-K1-F2
cgatcacaataagatggcgtgtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtgga

SEQ ID NO: 47561 - DNA, 409 bp, Zea mays
  Clone ID: LIB3066-002-Q1-K1-F3
cggacgcgtggggccaaaaggcactgaagaagccagtcaatagcgagttctactactagtagctagcctgctgatctgttctgttgtttagttcgcaaagccttctgtttcggcgaccatggaggatgagaggaacacacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggcgatcgatgagaacggcgagattatcaagaggaagaagaagaagatggg

SEQ ID NO: 47562 - DNA, 420 bp, Zea mays
  Clone ID: LIB3066-002-Q1-K1-F4
caccaagcagcagaagaaggtcaccaagagcattatttccaatacctcgaatggattgaaggaactgtttgctgaagtcgagaaggagctcacatcaagcagcagtagccatcctaatgtagcagctggtcccactactgcttaaatgttatcagtatcacatacaaacaattattacaggattcacatcaaagcaattcaggtacaaggctaacatcagtacaacaccaaaagatagattgggcattgcatgaatcacatgcgtatgaagaagccagaagagtggatagctgtttgtgatctcttcctgttctcttctgttcacggtgtcacctgcttcagcgctcttgcactgccggtagaaagtcttacagagatgagagctaaaaagggtttcaaagtaacaggttgtttcagaaa

SEQ ID NO: 47563 - DNA, 423 bp, Zea mays
  Clone ID: LIB3066-002-Q1-K1-F5
aaactttgcgccatttgatgcgtatgacccgaacatgggattcaacaatgtcaatgattcctaaaggtggtgatacaatttggggaaatctggattggtctccagaagatggcattgaatgtaaagctaagaagcacaaagccaacgatactggggtttctaaggatagcaatgggggaaatatcgaggttcaacctgaacctattaactatggaaggctggtatcttttggtaaagatgtagcagaagcaccttcttcagagattgagcagatagaatttcgtgatgctgttaaaggtaataatatcgcccattcaaatacgtcatgccgggagatctggacagagtatcacgaattatgatggggtggaataaaggcagtcgcagactacatagtttacactgctagttctgttgtagacc

SEQ ID NO: 47564 - DNA, 312 bp, Zea mays
  Clone ID: LIB3066-002-Q1-K1-F6
ggaggagaaccacttgtccaccgggacctgaagcccgccaacatcctcctggaccacaacttcgtcagcaggatcagcgacgtcggcttcgcaaggctgttcccacagtccgtggccgtcgtcacccattacaggttgacttatccggccgtccctttgtgctactttcactcggagtaccatcagactggcatgctcaccaccatgtcttacgtgtacttcctcggcatcatgcggctatcagattatctcgcgtgggtcgccaatgggcctaacgcatcacgtgtagatggcattatagagaggtgcctt

SEQ ID NO: 47565 - DNA, 424 bp, Zea mays
  Clone ID: LIB3066-002-Q1-K1-F7
cccacgcgtccgcgataataacatgagaaaattatctgaatgacattatcgttacatagtcaagaagaaacatagtcaagaagaaacggattgcaagaatgcaatggaaagaagggatccctcttttacaataaaagggatcgtattttgagcggcacctccacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgagggctccgtcgatgcccccgacggcgcctccgagggccctgcgagcgccagcggcccgtctggtg

SEQ ID NO: 47566 - DNA, 277 bp, Zea mays
  Clone ID: LIB3066-002-Q1-K1-F9
cggactcgtgggcggacgcgtgggttgatgagaaaaaaaaaaaaaaaaaaaaaaaaagggaaaaaaaaaaaaaaaaaaaaaaaaaaaaaaaaaaaaaaaaaaaaaaaaaaaaaaaaaaaaaaaaaaggaagaaaaaaataaaggaacaaaaattaaataaaaaataaatgaaaaataaaaaaaaaataaataggggcacctaaattaaattaattggccatatataaaaaacgtaattgactggaaaaacactggggtatccaaatttaatcgcttt

SEQ ID NO: 47567 - DNA, 397 bp, Zea mays
  unsure at all n locations
  Clone ID: LIB3066-002-Q1-K1-G1
cccacgcgtccgcagccacactgtccccatctacgagggatacgccctcccccacgccatccttcgtctcgacctggctggccgcgacctcaccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactncatcatgaagtgcgacgtg

SEQ ID NO: 47568 - DNA, 396 bp, Zea mays
  Clone ID: LIB3066-002-Q1-K1-G10
gaaacgttggcgtgttggttgggtggcgtcggcatggacgaggcaacgaagaagaatgtggaggctacggtgctggagatcctccggggctccgatatggagtccgtgacggagtacaaggtccgcgccgctgccagcgaccgcctcggcatcgacctctccatacccgaccgcaagctcttcgtccgcggcgtcgttgaggaatacctactttcactctcctccaaggaggaggcgaaggcggaggaggagggcgtcactggcagggagagcaagggcaaggaacacgaagaggaggacgaagaggatgacgatgaggaggaggatgaaggtaagggtggcgggaagagagagtacgatgaccaaggtgaccttatcctgttgccgctttcgagc

SEQ ID NO: 47569 - DNA, 324 bp, Zea mays
  Clone ID: LIB3066-002-Q1-K1-G11
cttgaatttgtcatatccaaagatgatggatgtagctgtacctgccaatttggtctgcggtatccaggatccaccaccgaagatctgagctgttccagtggaagcctgcaactgcacttctggttgtttatgaactctggatcgccaccagaggcttgcagctgagttgttcattaaataatttgtttgctgcatcctgtgatatcgcgagaaaataatctaaccaatggccggtgtagcctctggttgtatgtggcaaggcactattgtttagagagatcaaaaggaacaatgctgatagtcaatgaagtttgattgcctgac

SEQ ID NO: 47570 - DNA, 407 bp, Zea mays
  unsure at all n locations
  Clone ID: LIB3066-002-Q1-K1-E7
ggacgaagctacgcgctgcaccgaccgaccaaaccctaggcgttcggcgggcgtcaccacggcggcgaagaaagggtgcctcgcgtcgccttggtgtccccgaagtcgtcgacggtgcagctcgatccgcctcgtcgagcatgtcgaggagggtcccttgcaaattcttcttgcatggagcttgcttcaaaggagattactgtgaattctcccatgactgcaatgatcaaccagataatgtttgcactttctaccagaaagggacgtgcacctttggtagccgttgcagaaatgaacatgttgaagttcattgtaactgcccccaaccagcaaccactgtagcgcgtgcatcctncaattcttctcagctagttgcttcttccagagatccccattgcagcgaatgc

SEQ ID NO: 47571 - DNA, 409 bp, Zea mays
  Clone ID: LIB3066-002-Q1-K1-D2
ggaaaagagtccgatgtcttcctcgtcgaccatgcgtggtccttccgcctccctgatgcgctcaagcagttgcgggaagtaccaggattggctgaaaggatggcagcattgatgtgtgtcgatttggaccgcaagattgaagaagatgagcaggatgatgacgagagtgggagcttggagcatgtatcgcaagtagtcgagaaagaaagggctagagttcaggagagaagtgattctacagcttggctggaacttgaagaacttggaattgatgatgacatgctagtagccttggatctatctgcaaattttccgaatctagtagctctgaacctatggggaaacaagctgcgggatccagagaaagttatgcaagaaatcaggaagtgcacaaagctaaaggcacttt

SEQ ID NO: 47572 - DNA, 402 bp, Zea mays
  Clone ID: LIB3066-002-Q1-K1-D3
cgcggagaaatcgttcgggcgtgacatagtcgacgcccactacaaggcctgcctgtacgcaggcatcaacatcagtggcatcaacggggaggtcatgccggggcagtgggagttccaggtcggaccgtccgtcggcatctcttcgggcgatcaggtgtgggttgctcgctacattcttgagaggatcaccgagatcgccggcgtggtggtgacgttcgacccgaagccgatcccgggcgactggaacggcgcgggcgcccacaccaactacagcaccgagtccatgaggaaggagggcgggtacgaggtgatcaaggcggccatcgagaagctgaagctgcggcacaaggagcacatcgcggcctacggcgagggcaacgagcgccggctcaccggcaggca

SEQ ID NO: 47573 - DNA, 430 bp, Zea mays
  unsure at all n locations
  Clone ID: LIB3066-002-Q1-K1-D4
cacttcctcgctggcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcangcgctcacgttctgcgacaccatgtacatgaacac

SEQ ID NO: 47574 - DNA, 387 bp, Zea mays
  Clone ID: LIB3066-002-Q1-K1-D5
gactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtctactgcgacctgcagattttactcttgtagtgccctgagtagattctagcaataatatccaacatgaaacatgttac

SEQ ID NO: 47575 - DNA, 359 bp, Zea mays
  Clone ID: LIB3066-002-Q1-K1-D6
cccacgcgtccgcccacgcgtccggacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctgatgcttccgcggctgaacatgcaatgcgacccgtctagcccagccaaccgcatcaggcgcgcaatgcacgtctcga

SEQ ID NO: 47576 - DNA, 257 bp, Zea mays
  Clone ID: LIB3066-002-Q1-K1-D7
cggacgcgtgggcgagggggtggtggagagcaagcccgccttcgtcgtcgtcgcctcgtccgcggcgacgcagtccagggcgcgccaggaagcaccggacccggcgccggcggcccgaccagaaccaatccaggggcgtccgcggccgcccgtggggcaggtgggccgccaggatccgggacccggtcaagggcgtccgcgtttggttgggaactttcccttcggccgaggccgcgcggcgcgcttacaaccacgcg

SEQ ID NO: 47577 - DNA, 368 bp, Zea mays
  Clone ID: LIB3066-002-Q1-K1-D8
ctcactcgcccataaatatatatctatctatcgccatcgagcaattataatgggacagaataataaacatcatggggcaagcctcacggctcgtcctactcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtgcaccgccgggcggcacgcgtccaagtacccggtcatcgacaacctggccgtgctgaacatgcaggtggacgcgttcgccaagcgcaccgtgcatgcgcgcaagcacgtcgcgaggtcggcccgcacc

SEQ ID NO: 47578 - DNA, 413 bp, Zea mays
  Clone ID: LIB3066-002-Q1-K1-D9
gttcttccacatgaacatgtaccggtgcaaggacatgctgatcaaggacgtgaccgtgacggcgcccggggacaggcccaacacggatggcatccacatgggcgactcatccgggatcaccatcaccaacaccgtcattggcgtcggcgacgactgcatctccatcggccccgggacctccaaggtgaacatcaccggcgtgacctgcggccctggccacggcatcagcatcggaagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatct

SEQ ID NO: 47579 - DNA, 266 bp, Zea mays
  Clone ID: LIB3066-002-Q1-K1-E1
acgcttgaatttgtgcctctctgattcccttgagccaaatccctcacctcatagttccctgtggcgcctgcagaattctgaggaataccaggtttcccccatccttttccataaaacatatttatgtatccatactaaagagtactttctgaggagtacttcatagattttttttttaattgccttgtttgccttcagtttccttaattttcatggtttacatggatgtgtgtgtaggggctatatttgtgtatatacacgtgggt

SEQ ID NO: 47580 - DNA, 196 bp, Zea mays
  Clone ID: LIB3066-002-Q1-K1-E10
ggttgaagaagctttgaccatgatggtcatactgaatgctaaaacatgtactcctaggaacatattgtgattgttcacgtatacaggtttgaatttagctttgatatgaataatgagaaccaagtgtgtatgaatggagaaggggtgtaaccggatcggatacgaacgaatattgcttgtaccatatttatttcat

SEQ ID NO: 47581 - DNA, 417 bp, Zea mays
  Clone ID: LIB3066-002-Q1-K1-E11
cacgctcaaggaggagctcatcatccgcggcgacaagaccattgacggccgcggcgtgcaggtgcgcatcaccaatggcgcgcagctcacgttgcagttcgtcaacaacgtcatcatccacaacatccacatcaacgacatcgtctcctccaacaaggacggcggctacgtccgcgactcgccggaccacttcggctggcgcaccgtctccgacggcgacggcatcaccgtcttcggctccaccaacgtgtggctggaccacctctccctctccaactgccaggacggcctcatcgacgtcatcgccaagtccactggcgtcaccatctccaactgccacctcaccaaccacaacgacgtcatgctcttcagctccagcgacaagcatcccgaggaccagatcatgcagatcaccgt

SEQ ID NO: 47582 - DNA, 421 bp, Zea mays
  unsure at all n locations
  Clone ID: LIB3066-002-Q1-K1-E2
cccacgcgtccgcccacgcgtccgcccacgcgtccgcccctcgatccccctcaatccatatggcggnggggggggggcgatgcttgcggttgcgctcgtcgccattttgatctccagcattgtggtcgccgcctcattacttggatctccgacgcgcgcggtggtcgggtgggcgatgcttgcttgccattgtgctcgtcgtcgcttggatctccggcatggtggtcgccgcctcatcgtcgggtgagcaggtgtcctaccgtggcgactggatccgcgtccagcccgtgcccggtgccttcgtcgtcaacttcggccacatcttgtgactcacatttctcatgtttttgaatatgtatacaaatataaatgttgcagttaccctttcactgacatggttgatagacagatttacctcata

SEQ ID NO: 47583 - DNA, 426 bp, Zea mays
  Clone ID: LIB3066-002-Q1-K1-E3
cccacgcgtccgcggacgcgtgcgctcacacgatcgaaaataggttcacttccgtgaagatggcccatccacagaagagatagccgaggttgtcaagtcaagtgtgctccctgacatgttcaagagcacatatgagtcaatcaccaatggaaatcctacgtggaatgagctgccagtctcaacaagcactctctacccctgggatccatcatctacatacatgcatgagccaccttacttcaaggatatcaaaatgagtactgctggcccgcggtctgtgaaggatgcatattgcctttcgaattttggtgacagcatcacaaccgatcacatctcacctgccggaaacattcacccagacagcccatctgcaaaatatctgaaggagcgtggcgttgaaaggaaggacttcaactcatatggtag

SEQ ID NO: 47584 - DNA, 409 bp, Zea mays
  Clone ID: LIB3066-002-Q1-K1-E4
gcggagcgcgccgaggtggctcggtcgcgcaacctcgccgcctacgtcagcgaccccgtggccgccacgaaccggttcaacgcggacgtgctgagggccacgacgcggcgggcgctggcgaggtacgatggcccgtgcatggcgaccaaccccatcgaccggtgctggcgctgacgcgccgactgggcgacggaccggaagcggctggcgcagtgcgcgcgcgggttcggccacaggagcgtcagcggcgcggccggcaagctgtacgtggtgagggacccgagcgacgactagatgatcatcccgcggaagggcacgctgcggcacgcggtgatccaggaccggccgctgtggatcgtgatcgcgcagatcacgctgcagaacgtgcagaacgtgatcctgcacaatc

SEQ ID NO: 47585 - DNA, 426 bp, Zea mays
  Clone ID: LIB3066-002-Q1-K1-E6
gtcgtgtaccacctcttgctgctcgtccactgtcacggactcgtcctcgtcgcccccgtcaccggcggcggccaatgccgcgcccgcgccacggaaggcggaggccgagactggcggggacgaggacggttgtgctggtaaggcggcgccggcgaagaagcgggagcggagcagcgaggggaagcacccgacgtaccgcggcgtgcggatgcgggcgtggggcaagtgggtgtcagagatccgcgagccgcgcaagaagtcgcgcatatggctcggcacgttcccgaccgccgagatggccgcgcgcgcccacgacgccgccgcgctcgccatcaagggccgcgccacgcgaagtgcccgccacaagagcggcagctgttcgacttgccggacctgctcctcgacgtccgggacgggttcgggcgc

SEQ ID NO: 47586 - DNA, 415 bp, Zea mays
  Clone ID: LIB3066-002-Q1-K1-D11
attgaccgcaaagggccatccgctgcggtcagtgtaggtttctgaatcatagcttggcgatgcctgaggctagacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagacatttttcgagtccaggaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgac

SEQ ID NO: 47587 - DNA, 427 bp, Zea mays
  unsure at all n locations
  Clone ID: LIB3066-002-Q1-K1-B6
gcggcggtgttccagaactgcctcatcatcacgcggcggcccatggacaaccagcagaactcggtgacggcgcacgggcgcaccgaccccaacatgaagtccgggctcgtcatccagaactgccgcctggtgcccgaccagaagctgttcccggaccgcttcaagatcccctcgtacctgggccgcccctggaaggagttctcgcgcctcgtcatcatggagagcaccatcgccgacttcgtcaagccagaggggtacatgccctggaacggcgacttcgccctcaagacgctctactacgccgagtacaacaaccgcgggcccggcgccggcaccagcaagagggtcaactggcccggcttccacgtcatcggacggaaggaggccgagccgttcaccgncgggccgttcatcgacggcgccatgt

SEQ ID NO: 47588 - DNA, 407 bp, Zea mays
  Clone ID: LIB3066-002-Q1-K1-B7
cggacgcgtgggcggacgcgtgggccggtgtactgcagtaatgtaaaggtccacaatgtgacgattaagacctcattggacgctccactgactgatggcatagttccagattcatgttcaaacttatgcattgaggacagcaccataagtgtcagccatgaagccatctccctgaaaagcgggtgggacaggtatggcatttccttcgggaggcctacctccgacattcgcatcagcagagtggacctgctatcatcttccggagccgctcttgcattcgggagtgagatgtctggtggtatctcagacattcatgttaaccacctccggatccacgactcctccaaaggtatttctttcaagacctcacccggccgtgggggttacatcgaggacgtggtcatctc

SEQ ID NO: 47589 - DNA, 417 bp, Zea mays
  Clone ID: LIB3066-002-Q1-K1-B8
cccacgcgtccgagcgccccagcccagcgatcgccggagcccgggcctccccaccgctcgcgccggcggtcgccgatcatggccaccacccccgccgaggatccggagcctgggctacctcctcccaaggctctctgcgagcagccgcggcggcggcgcccgtgcgtcctcctcagcttctcggcagcgcgcgaccgcttcctccggggccggttcctctcggcgggcctgcgccccttctctgtccgcctcccctcgccggccggcaccagcaccgtcgtccacctctgggcgccggcgcggtccgcgcggcggcccgtgctcctcctccacggcttcggcgcgtcggcgacgtggcagtgggccccgtacctccgcagcctcctcgcggccggcctcgaccccatcgtcccggac

SEQ ID NO: 47590 - DNA, 413 bp, Zea mays
  Clone ID: LIB3066-002-Q1-K1-B9
caagaagcaccgcctgacgttctcgatcccgggccagcccctgtccgcggccggcgaggtgggcgtggccatccgccacctgcgcgccgtggaccccgccctcgccgccgtcatcgacgcgcacgagccccccgtgttccagtgcccgcaccgcccgttccactccctcgtacgatccatcctgtaccagcagctcgccttcaaggccgccgcctccgtctactcccgcttcctcgcgctcctcggcggcgaggccagcgtggcccccgacgccgtcctcgcgctcagcccgcaccagctccgccagatcggggtctccccgcgcaaggcgtcctaccttcacgacctcgcccgcaagtatgcctcagggatcctctccgacgcctcgatcgtcaacatggacgaccgctccc

SEQ ID NO: 47591 - DNA, 420 bp, Zea mays
  Clone ID: LIB3066-002-Q1-K1-C10
cccacgcgtccgaatttcatcccaggaattgttacttcagtcatattctcagctgtaatttcattgtcagcctcatccacaattttattactgcgacttgaatgaagccactctaacagggatgaaattatcctcaacactgactaactccatgtcaaaagaagaaaagcataattctgggtacatgtacacaaaaattgctcagctactgattaaaaatgtagcttaagaaactaggctgtaatcatttcctctcactcagaagagcctctgtatgtgtcgatcatgctgggtccaggactaacgagtgcaagaataacaaggctgctcaacaacaccagcagcattcccagggagttcataaacatggcttctgtggagaagcgctcaatcattttggcgctctgcataaagattgac

SEQ ID NO: 47592 - DNA, 415 bp, Zea mays
  Clone ID: LIB3066-002-Q1-K1-C11
cccacgcgtccgcgagcgaggatgaggcgaaggcgtgcttggcgaaagaagccagcgtcgactccattggacgtcgccagtgtcgaggagtacaagcagaaggcgggcttggtgtcgaagcggggccggaggtcgacaggcagcaactaactaccgtgaccatcgtcaccgttgtggtggttcttcgccctccgtgccttcttccccctgtccgatagccgacgccggtgcgagatctactcccccccatcctcgcttcaacgagcacctttctttaatcggttagatggtgcgcttacctcgtcctcagttgctataatgggctccaagtgatgggaggcatgaaacatgctgaagtgatacatgctcgtattttgaaaccagatagctgcaaaaccaagtcaataaagcaaag

SEQ ID NO: 47593 - DNA, 380 bp, Zea mays
  Clone ID: LIB3066-002-Q1-K1-C2
cccacgcgtccgcccacgcgtccgcccacgcgtccgaaggaacaatgaagcaaaccaaaacccaatcagaatcagggtgggtaggcggaggaaggaaggggaaaggcgacgagctggtgacgacgaggagcaactagcgtcgcgaagccgccgagccccaggcgaagtcacaggccgccgcagcggtgccggcgcccacccgatccgccgccgccgccgacctcgtgctcgcgcctccggtcggaaggagggggtgtcaaacccatggagcagcctgccgctcccgatcggagcgattttcccgccggggagtgcgaatggcgggaggagctgcggcagcagcagtctcaggtggacgcgctgcgggagcggctcgtgga

SEQ ID NO: 47594 - DNA, 390 bp, Zea mays
  unsure at all n locations
  Clone ID: LIB3066-002-Q1-K1-C3
cggacgcgtgggcggacgcgtgggcggacgcgtgggcctggagggtgcaagggagggaggcggtcgaatccgtcatccactgagcaccgccagccccgcacgcggaggtcggagggctacgctccggagtccgaggggaaggcagaggaggcaagcaggccggatgggtgccgctggtgacgccgcggcagcgggcacgcggtgcgagctctgcgggggcgcggcggccgtgcactgcgccgcggactcggcgttcctctgcccgcgctgcgacgccaaggtgcacggcgccaacttcctggcgtccaggcacgtgaggcgccgnctgccgcgcggnggcgccgactccggggtgtccgcgtccgcgtccagcggctcctgcctgtccac

SEQ ID NO: 47595 - DNA, 424 bp, Zea mays
  Clone ID: LIB3066-002-Q1-K1-C4
acgcgcgcacgcacgtatggtcgaacaatattaggagagaagctcagagaccggttcctggccttccaaaaaagaagtagacataagatagatctctccgcctctcctcgcccaacctcctccaacaagtaacattgaccgcaaacggatcatcgtccggtgcggtcaatgtaattaactaagcttctcaatcatacatagcttggcaaatgcctgagggctagctagacaaggtccgttgagctagcccctttgggaagaagggagaggaatggcgctggtggcccgttgagcgaggaagaggctattgagaacccgttaacaagaattgccagcagcatctggacaatcttgttaacagagttccaaaggttcaattccaagcggatacaatttccgagttggatcgagaagagtgcgtgca

SEQ ID NO: 47596 - DNA, 404 bp, Zea mays
  unsure at all n locations
  Clone ID: LIB3066-002-Q1-K1-C5
atcgatcagctagctagctgctgccaagagctagccaggggacagagcagcagcttgaagttggtcaccaatgctaaggatgggccgcgccagcgccacagcaggtgtgttgcgcttcgtcagggcgttcgccctctgcgtggctacggcatgcctcctcctggcggccggcatgccctcgcctgtggcggcgcaggacccgtcgaagctgagcctgcagtactactccaagacgtgccccaacgtggagcacgtcgtccggacggagatggagtgcgcggtgcgcgccgacacgcgcaacgccgngctcatgctccggctccatttccatgactgcttcgtgcaggtgatcagtcggtccgtcctatatatatcagctaatgcagcaacagcagctagctgat

SEQ ID NO: 47597 - DNA, 290 bp, Zea mays
  Clone ID: LIB3066-002-Q1-K1-C6
gcaagacattctcgtacatcaatacttccacagaatctctgacacatattagggacgtttcaaaattgaggtggacatgagatagatctatgctgatctgctacgagatcctgattaaaccatatcatattgaccgcaaacagatcattgctcgcagcgaacaatgaaattaactaagcttctcaatcatacatacctatctaaatgcctgacgactttctacactagcttctatgagctaggacattttgtaaaaatgaagaagaatagagctggtggcacttttaact

SEQ ID NO: 47598 - DNA, 334 bp, Zea mays
  unsure at all n locations
  Clone ID: LIB3066-002-Q1-K1-C7
ctctgtccctctacggtgcttctgctcgccggcccaaaatcgcctcatcgaccacgcccccttccaggctcccgtctccatgggtctcctctcaaacaggattgggagggagagcctcaaggcgggggatcatatctactcctggagggcggcgtgggtctacgcgcatcacggaatatatgtgggcgatgataaggtgatccatttcacangaggaagaggacaggaggtcggaacaggaactgtcgtcgatattattcttgtgagttccaccccaaaacgaagcaacacgccttgcccggtgtgcaccgacgaaaccagggacagcagcaca

SEQ ID NO: 47599 - DNA, 417 bp, Zea mays
  Clone ID: LIB3066-002-Q1-K1-C8
agcagaactctctcgacctcatcggcgttggcggagcgcgtgttgaccggagatggcgccgagcgggtggaggaggagcgcggcggcgcgggtcgcctggcgcccggacacggtttgcctgtggctcgcgctcggcgacgccgtactgacgctcgcccaggctaagaaggacctgacggaggttaccctccaggtctacttcgacatcgagatcgacggtaagcccgcaggccggattgtcatggtgctttatgagaagactgttcctaatactgtagagaacttccgagctctttgcgcaggagagaacggggttgccaagagtggcaaagcccttcactacatgggaagtcagttccacagaatcatcctcagcttcatgctccaaggaggtgacttcactctcggggacgggag

SEQ ID NO: 47600 - DNA, 416 bp, Zea mays
  Clone ID: LIB3066-002-Q1-K1-C9
aattttactaatcaaattcttgttgggatatattcctccaattcccctcctcctcccaacaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagc

SEQ ID NO: 47601 - DNA, 229 bp, Zea mays
  Clone ID: LIB3066-002-Q1-K1-D1
cccacgcgtccgcccacgcgtccgccctcgtcgtcgtctcactcaccccgccttcacgcctgcctcaccaaataaggtcccgcccttttccgacattcacaggggggacaggaaatcagcggccatggcctcgattccggcgacgaccttcggcggcatcttattcggcctcttctgtgccgcgggtggtgccgccgttgacaacgaactttccgagtacgttattcaa

SEQ ID NO: 47602 - DNA, 406 bp, Zea mays
  Clone ID: LIB3066-002-Q1-K1-D10
cttttatttaaaaaaaaaaaaggtatcttattatatatgatgcagtgctgcttacaagaagcagatggtacattactacatttcaaacttcattgcaaagtagaatatatatggacataagatcacatggatgttgctccacactttttagcacacacagatatacaacgcaaatacacattgattgccttctctggaggcaattcaccacacgtgcgttcctttagttacccccaagaggatggcaacggcagcaacaacggcagcaattgtgcaagcaacgtatcctggtttctctcgttggtcatgtatattctactttgcaatgaagtttgaaatgtagtaatgtaccatctgcttcttgtaagcagcactgcatcatatataataaggaaccttttatttt

SEQ ID NO: 47603 - DNA, 286 bp, Zea mays
  Clone ID: LIB3066-002-Q1-K1-B5
cccagcgtccgcccacgcgtccgggcacgacgaagccggccttaaccaacggcggcgccagggccagcttcggcagcaaaccggcggccggcgtgggcaccgtgcttggccgggccatggaggacacgcgcgcgagctactcgatgggccaagggctctggcgcgggcacttcggcgtgacccacctgtgcacgcaccggacgagcggcgagaaactggcgtgcaagacgatcgcgaaacggaagctggcggccacggaggacatggacaacatgcgccggaaggg

SEQ ID NO: 47604 - DNA, 253 bp, Zea mays
  Clone ID: LIB3066-016-Q1-K1-D11
gcgtctcgctcatctgcattcccatagccatgaagtccgccgagctcgagcaacgcccgcatcaggcagtccggccaatcccatctcaactgtggtgcaaaaactttggcaaggaatactgaaggaccttccaagtagcatgaagcgcggacaccttgcttttgccttcttttgattctctttctcttttggctcaatcatgttatatgagaaataaaataaatattggactcaaataagaaaccggtgattc

SEQ ID NO: 47605 - DNA, 340 bp, Zea mays
  Clone ID: LIB3066-016-Q1-K1-D12
atcccattccccttccccctcttcgactacctctgtggcgtcggaccgaacccgaaccaggaagcctatactaaccctaggaggacagcagcctccgccaagctctactacacgctgtaggaagccgcggagctgaatggcctcaccaacctgcagccaccccacggatgccacgaccacaacttcctctactacctcaagctcaccaccaagaccttcgaggagatcaccaaccactacaactacgtcacccacaacctgcaacatctacacttcaaaactacaccgtccctgcttacctaatacaaaaatgcactcattatgccagatattcatattt

SEQ ID NO: 47606 - DNA, 382 bp, Zea mays
  Clone ID: LIB3066-016-Q1-K1-D2
cgcggttcctaaactcggatcctgcattttgtttcggcgatatgtgttggtgttaccagttgctgcggcgatacttccaatttctgtgccgatgggtttcctcgttttcttcttattttgtttcctcgtcgtcgcagcctgcaaattggtagtttcttggttcttatcagtggagctggctttggaatttgcaggcaccgttctgagctgcgctggtgctcctggaaaggtgttggtgcctggaggtggcagtgatgacttgctttcctccgtagagcctgtcggagacactcaacctgaagaactacaggttcgattgtccccttctgtgccttcatggtacaaatggtccaaatgtctgatgaaattaaattgggtttca

SEQ ID NO: 47607 - DNA, 442 bp, Zea mays
  Clone ID: LIB3066-016-Q1-K1-D3
gagcgctcttctgggcgcataggcatgaaaagattcgaggagatggactgggacaagaatggaacggtgaccttcaaggaattccttttcgctttcactcactgggtggggatcaataatgaagaagacgaggacgaagaagaatgagcgtgtcggctgaaggagattaggcgttccgaatcgaccgagccagccagccagccagccagcccccctcaggggaggcctccagcagctccctcctgccgtggatcagaagcggtagagctcatgtgttctctgtgtgtgccgagctgatgggtagatgtcatgttcgtataaatagaatgaaacactagccgtgtcaagggatttgcttgataaaaaaaaggttacgctggtcaaacgcttctcaattaattaggttaccttggcattaataaagtatttgcagtgtgtttgg

SEQ ID NO: 47608 - DNA, 371 bp, Zea mays
  unsure at all n locations
  Clone ID: LIB3066-016-Q1-K1-D4
gcacgcctggcctgggctggccgcctccgaccaccgtacgtcctccaccgcgtcgccgtcggccgggctctgcccagcccgggctgcctgcgagggcttctgatggccctcgacgccgtcctttcctcctagtgcccagctttattgcagatccagccctctgatcctcgtcttctttcacctctccaacatgaaggtcaacaccaagatcaagctggagccggtcatggcgccgtcgtcgtccctgccgcggagcgccagcgagctacccgacccgtcgtcaccgttcagctccaacacggcgcaccaccccgtcttcgtgcccaacaacacctaggtggtccttatcgtgctcgtcnngtcggcacatg

SEQ ID NO: 47609 - DNA, 490 bp, Zea mays
  unsure at all n locations
  Clone ID: LIB3066-016-Q1-K1-D5
tcgtctcgtcttcgtacttgagccggcaagggccttcggctttccctggcaaagcccgggcttcaacgacaaggctgtcgccactgcggcatcatggancgtcgagttcagaagggtgcggtgcaagtaccccgccgggcagaagattgtgttccacatcgagaagggctgcaaccccaactacctggccgtgcttgtgaagtttgtggcggacgacggtgacatcgtgctgatggaaatccaggacaagttgtcggctgagtggaagcccatgaagctctcttggggcgccatctggaggatggacactgccaaggcgctcaagggccccttctccatccgcctcaccagcgagtccggcaagaaggtcatcgccaaagacgtcatcccgccgaactggagacccgatgccgtctacacttccaacgtccaattctactagactttgaattcccttcgattcatccggcgcggtgggctatggacctgc

SEQ ID NO: 47610 - DNA, 471 bp, Zea mays
  Clone ID: LIB3066-016-Q1-K1-D7
aaagaactcgctccattcagagattcagagaagacccgcctctcccgtgaggccgtgacgcgacgccggatcgtcctcgtctcctagctcgtggaatgaagggaggtggcgtcatcagggccgccggcggaggtgccggcggtgcgggtctgttgcgaacgcgactgcggcttcccgtggtgctcctctcctgctccctcttcttcctcgccggcttcttcggctcgctcctcttcacccaggatccggaggaggcggatatgccggtgccgagagagcggctgttggaggcggcgtggccggagatgccttacggcgagtccggcgaggctgcgccgtccttgatcccataccagattttgagctggcagcctcgtgctttgtactttccacaatttgcgacatcagaacagtgtgaaaatatagtaaaaacggcaaaggagagacttaagccatcaacattagccctga

SEQ ID NO: 47611 - DNA, 54 bp, Zea mays
  Clone ID: LIB3066-016-Q1-K1-D9
cgacgagctgccgatgctgactgtgcaccacggtcacctcaagtcatcgaacgt

SEQ ID NO: 47612 - DNA, 367 bp, Zea mays
  unsure at all n locations
  Clone ID: LIB3066-016-Q1-K1-E1
cgtctcgaganaaggcaaggggcgccttcgctcgtccgtngcttcagtagggtggaccgtcctnncagcgactctcccggagcgatatgcctccactcgtnnattctgtcgtgccggacccgtgcgttngctcgcccggcgcctttggcgtcatctcnntggaagnnntcgccacgagcccttgcatatcgagcccgtgaattggagggatgatcccanngagtccctgaaggggcggctcgggagggttcgtggactcatctgcnntgctgctccgcgaatgccacaccacattcgacacccatgcgacnnctcttttttaaattccttaatgtggcgacgaattggcagaatggaaatgatgccg

SEQ ID NO: 47613 - DNA, 457 bp, Zea mays
  Clone ID: LIB3066-016-Q1-K1-E10
ctcacccctgaggccgcgcagagccactgcttgcgtctctgtctctctgtctgctcgttttgctgcttctgcgactcgtaggagggtgaggtcttgcttgcctcgcggaatggcggcggccggggcatggctggcccgtgcgacggcgacggcggtgctgggtttcgtcctggcggtggcgtcagctgaggcggcatcgggggacgtggagatggttttcctcaaggccgcggtggccaaaggcgcagtgtgcttggacggcagcccaccggtgtaccatttctctcccggctccggttctggcgccaataactgggtcgtccacatggagaggagggtggtgcaggaatcctgatgagtgtgcggtccgcaagggcaacttcaggggctcctccaaattcatgaagccactctcgttttcagggatattaggcggcaaccaaaaatccaatcctga

SEQ ID NO: 47614 - DNA, 331 bp, Zea mays
  Clone ID: LIB3066-016-Q1-K1-E11
cggacgcgtgcggctcgaattccgtctcttgtccctgtcgtccttgcccggattccccggttggtgagacgttaaagaggaggcggaggaaatggatggtgagtgacgagaggttcccggtgtgtgaggccgcgctcggcgctcgagtcgctcgacgacttcgccgctggactcgtctgtgtctacctttccatgccggactccgactactacttcctcaagttgccacgtaatctctatgaactccaaatcctcactggccatcttgagaactatactagtgactacaccctacaggtgttcctagctcattgagctgtgtacatcttta

SEQ ID NO: 47615 - DNA, 394 bp, Zea mays
  Clone ID: LIB3066-016-Q1-K1-E12
gcggttcataacaataaaacgcttcaagtttatgcggtcgcaacatccttgagttccacaggtgaatttgttttgcaagctaaaaactcgatgtttatatggaatgggaatgcaagttcttttgaacaacttttgtgggctgctaaagttgctgaatttctgaagaccggtgttgctgtcaagcattgcaaggagggcactgagagctctattttctggtcttctattggtggaaagcacagttatacaaatagaaatgctgcacctgatgttgttattagagagcctcatttgtataccttctctctgaagaatgggaagctggaagtatgaaattttcaatctttcacaagatgatcttgtgaccgaatacatgatgatacttgatacacac

SEQ ID NO: 47616 - DNA, 350 bp, Zea mays
  unsure at all n locations
  Clone ID: LIB3066-016-Q1-K1-E2
gtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccggtcgcaagccagttgaccacacactgccccgtggccagcagagccttgtgacatgggctacaccgaggcttagtgaagacaaggtgaggcaatgcgtcgatccaagactcggagatgaataccctncaaaggctgtag

SEQ ID NO: 47617 - DNA, 357 bp, Zea mays
  Clone ID: LIB3066-016-Q1-K1-E3
ctgggcagaaggacgacgccatggcagcagagagcgggtgcgggtgcgggtgcggccgtgcgtggtggagttccttgttggccttgcgaagcaatagaggaagatgatgaggaagacgacgatttcgatgatgatgaagcagtcaaggtcttccgtcggcagaaggtcgatcaagctgtaaaagaggctgtgtcaagggtgctgtccatggtagactctaccgaagcgaggatgcaatatcgacgaatgcttgaggagtttcgccaggcaactgcagaattggaaggatcaaatgaagtgacatcaatatttgacagtgacttagagttattagggatcaacaatttcatgtaaaga

SEQ ID NO: 47618 - DNA, 365 bp, Zea mays
  Clone ID: LIB3066-016-Q1-K1-E4
tgaggcgtgagtccgtgaccattcccgtcggccgtcccaaaagaagcgcaaatttacaacggagtggaccacgggccacacaatcccaaatctaaccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcgggcccgggactggcggagcggttcctcagggccttccggccggcgctgtacgaggtgctggccgtcgacggcgacgacgtgcg

SEQ ID NO: 47619 - DNA, 471 bp, Zea mays
  Clone ID: LIB3066-016-Q1-K1-E5
cccacgcgtccgcccacgcgtccgcccacgcgtccgggagcacagagctagctagccagccagccagcagccagcttgctcgccgcgcccgtccttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggtgccgccgtcgccttcttcttcgcctactacatttaatgaagccggccgcggccgtccgcccgaaggccgagaaaaaacgaaacgggagaaaaaatgacatggcttcgcgcattccgatgcgtgggcatgtttttgattcgacacaccttttgtcctctttttctttggtccctctttc

SEQ ID NO: 47620 - DNA, 437 bp, Zea mays
  unsure at all n locations
  Clone ID: LIB3066-016-Q1-K1-D10
gtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggttgtgtgatactgtgatcaagcaaggagacgacacttgaattctctacagtttggcatangtcgggagagacactctcgaccggccacaccatgtaacaaactaacc

SEQ ID NO: 47621 - DNA, 371 bp, Zea mays
  Clone ID: LIB3066-016-Q1-K1-B2
acgacctacgcttacgttcagttggcgcacgaggatgctagtcatattagactgggggaggcggttcatctgggggaggggactccagtagcatataaattcaaatctcccgattttgtagttcacctgcgttctagatgctactagtactacttgcatcagttttgctgtcccactatttccgaagcttagcctcgcaaggtttctgataccaaattttgaccttgccaaatgttttgttacctcgtcatgcacactgagtgattcagatgttatatacgtcttatcggatatttgcttttttatgtatggcactatgatttctagctataccgattctaattgtaagtttgagttattctggtcaaaaa

SEQ ID NO: 47622 - DNA, 403 bp, Zea mays
  Clone ID: LIB3066-016-Q1-K1-B3
cgcttccatgtcctgatttgcgccgtaagcgcccgaatctagccgcaaggttgagatccgcgtccatttctggcttccgagcgtccgctgcttgtcggtagacgcggatctgttgaattttgtgactcaccgtcgtcgatccgcaggatctttgtacagtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaaacaggttgcttgctgggttaccaggccaaccaataactaccacaaggctgatggtcagaacactggcaacttcctta

SEQ ID NO: 47623 - DNA, 186 bp, Zea mays
  Clone ID: LIB3066-016-Q1-K1-B4
acgctcatccatatccccatcctcaccttaagctttcgaatctaacctcaaggttgaaatccacgtccagttctaacttatgagcgtgcacttcatttccatagactcatatcagtttaaatttattactcactatattctatccgtataaactttatacagtttctcttttcaataatcaatatt

SEQ ID NO: 47624 - DNA, 372 bp, Zea mays
  unsure at all n locations
  Clone ID: LIB3066-016-Q1-K1-B5
cccacgcgtccgcacaggtgtttgaatgccaaaggggatgatgctggtgtttgcgaaaaatttgccaagtactacaggtccctttgccctggagaatgggttgagaaatggaacgagcagagggagaacgggacgtttccaggacctgtctgaatgtaccgcccgagacctccagttggaccagtcaacaagttggccaggcagtcctactgttccattctgcattcctacttcccgaatcgtaaatgccttttgtccctagctcttcaaccaggcaccacaaaactgttagtgatgcctctcgtacgcagctctaataatttggctacagttgccccacatgcangcctngtttgtgtgtggactgtggac

SEQ ID NO: 47625 - DNA, 430 bp, Zea mays
  Clone ID: LIB3066-016-Q1-K1-B6
cggacgcgtgggcggacgcgtgggcgtgccgtcgagcgagcagtctcccaattccacgcaaggactaataacatctcctcgaacgccaggttccttggaccactatatccaggagcgacaaagtgatccacccgccagccatggagatgaagaaggtcctctgcgccgacctcgtcgccgacgactcggccaccgccgtgctggcctcggtcgcctcctaggcgctctctaatgctccagtcgtcactgcctgttgttccttgctcttcaaccattcaccacaaaactgttagtgatacctatcgtactcagctctaataatttggctacagttgccccacatgtagtcttgttttgtgtatttgacttgtggaccttattcttgatcactttttgtatacgttcttaatttactttggttatttttttt

SEQ ID NO: 47626 - DNA, 226 bp, Zea mays
  Clone ID: LIB3066-016-Q1-K1-B7
cccacgcgtccggtctcggtctagaatccatgcacgtttcaagcggcaaaattccgattatgtccctcccgaagccagactatagctggattcttatcaaggttccacatgatcaggcgcctttcttcctcaagagttagagccacatatatgctggacagaatgagtggtcggaattggcctggggacagatactcatcatatggataagtgtctctcatatata

SEQ ID NO: 47627 - DNA, 443 bp, Zea mays
  unsure at all n locations
  Clone ID: LIB3066-016-Q1-K1-B9
cggacgcgtgggctcgtctcctccactccaagagaacaggcgccggcgaaaggcgggagcagcgcgctgcccattcaccgccccctgatttcttgggagttgcggatcggtctccggggcagcgtggaacggctgggcccctcggatcgccggagatgctgccctacgcgacggcggcggaggcggaggcggcgcttggccggcccatgacgcccgccgaggcgctgtggttccggtacaccgcgggggtgtccgactaccacctctactgctgcaacatcctcttcctcttcgtcgtcttcacggtggccccgcttcccatcgcgctcctcgagtcgggccccggccgcggtctcgccgtacanactgcagccgcgggtgcggctctccagggccgagttcgtccggtgctacaaggacgtnctncgcatcttcttnctcgt

SEQ ID NO: 47628 - DNA, 179 bp, Zea mays
  Clone ID: LIB3066-016-Q1-K1-C1
acgcgcttctatgatactgatttgctccgtaagctcccgtttctagccgcagggtttagatcctgattcggtgtctaactttcgagcgtgcgctgtttttctgtagacactgatctagtgaatattgtgactcaccgccttctatccacaggatctttttacaaattctcttttcaata

SEQ ID NO: 47629 - DNA, 425 bp, Zea mays
  Clone ID: LIB3066-016-Q1-K1-C11
atctcggacacggcaaatttaccggcaacgtacagcgaacgccagaggtccgcagccgttgagccgccaagggagaggacgaaatggcactgtccacgacgaacacgaacgcctccgagtcgcagctgcactgctccacctttgcgtcgcgctacgtgcgcaccgcgctgccgaggttcaagatcccggagcagtcgatccccaaggaggcggcgtaccagatcatcaacgacgagctgatgctggacggcaacccgcggctgaacctggcgtcgttcgtgaccacttggatggagcccgagtgcgacaagctcatccagtcctccatcaacatgaatacgtctacatggatgagtaccccgtcactaccgagctccagaaccggtgcgtgaacatgatcgcgcacctgttcaacgccccgatcg

SEQ ID NO: 47630 - DNA, 428 bp, Zea mays
  Clone ID: LIB3066-016-Q1-K1-C12
gcgcgtctcacctcacacatgacacatgtaattgcttgaaaatctatggtttagaaagagggaatgagggaagtgaactagcggtccacgatactccgacgcccactttgctacctcggaaccctagccgccgcccatggatatcgccggagaccggcgccggtagcgatacgcaaaaggagtggtacgttctttgaccttgtttattgctgcgcccgaggcgtgtggcgcggggggagcaggaaggagaggggaagaacagaaggggaaggcgggcggagccgcgatgtcggtgcggatcaaggcggttgtagaccggttcgtgaaggagtcatgaggcgctggacgcggacatccaagaccgtgtcatgaaggagcgcgagatgcagagctacatcgaggagcgcgagcgcgaggtcgccgagcgg

SEQ ID NO: 47631 - DNA, 342 bp, Zea mays
  Clone ID: LIB3066-016-Q1-K1-C3
atagaacgagcgcgtagcgatggctggagcccgggcactgctcatcgtcctcgcggctgccgtcggggtcctggccgcgcggccggcgtctgcaggcggtggagccgcggcggtggcggagatctgcatgaagactccgtcccccgacctgtgcaccaggacggcggcgaagcacgccaacaagtacaaggtggtggacgcggtgacggtgctagagatgcatgtggacgcgttcaagaagcgcgtgaaggcggcgcggaggctcgccaaggaggaggtcaagacggccgcgacgcccgaggcgcggagggcgctgaacctctgcaagacctactacctgga

SEQ ID NO: 47632 - DNA, 462 bp, Zea mays
  unsure at all n locations
  Clone ID: LIB3066-016-Q1-K1-C4
cccacgcgtccggcaagttcctgtacgagggcatcaccatggacaatgtctnctaccccatgatcagcgaccagaaatactgccccaacaacatctgcgtcaagtccggcgcctncaangtggccgtcaacgacgtcgtcttcaagaacatccacggcaccttcaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttgcaaaagagctcgcctgcatctgaaccaatngactaacatgcatatnatatatatataatcactcttcgtaacctctctctttctcacgtactctcaagtctccaccgaatatataatccggttgtttggattttctttcttctttggatca

SEQ ID NO: 47633 - DNA, 300 bp, Zea mays
  Clone ID: LIB3066-016-Q1-K1-C5
cccacgcgtccgcgtacgcgtgggctgacgcttgggcagacgcgtagatacaatcgcgtgggttatattcatacgctcgtcaggatcaaggcgccgtatcctgcgtgtccgcgctcatatggatcaagatatcatcacccacaacttgtatcacgtcatgaattaattaaggccacatgcatacatgcatcatgcatgcatgcttaatctacattccattattaagcttttacaatgcatgcatgcatatattaattaattatcatcaattatcatgtacatacgagacctacttactac

SEQ ID NO: 47634 - DNA, 74 bp, Zea mays
  Clone ID: LIB3066-016-Q1-K1-C6
cccacgcgtccgcccacgcgtccgcccacgcgtccggttctagatcgcgatctagaactaggtctagatcgcga

SEQ ID NO: 47635 - DNA, 463 bp, Zea mays
  unsure at all n locations
  Clone ID: LIB3066-016-Q1-K1-C7
cttcgagaacgtgggtggcagcacactggaagccgtgcttcccaacatgcgtatccatgggcggatccctacctgcggaatgatctcgtagtacaatctggaggagccagagggtgtgcacaacctattcgaaatcatcgctaagcgcctgcgcatggagggtttcatggtcttcgactactacagccagtaccacaagttcgagcaagagatggtcgggtacctcaaggcggggaagatagcctacgtcgaggacattgctgaggggctagagaaggcgccggaggcactcatcgggctcttcaccgggcgcaacgtctgcaagcaactggtcgacattgcgcgggaatgaatgctgggcatncatatctacgttgagaataatgtcgtataaactataaagcatgcgtacgttttcagacgtgttaggaattgatggtttgcagtgcttgcaggcttatgc

SEQ ID NO: 47636 - DNA, 374 bp, Zea mays
  Clone ID: LIB3066-016-Q1-K1-C8
ggacagccttgaccaatgaagcaaactcatcccaccgcaaagaaccactggtatactgatggaccagctcaactataagttttcgatccaacatgattgttttcttgaatcccaggtacctccggtgtccttcgacaactttagccatattgccatcatatgtgggaacaaatatatcactttccagtgataccaagtaatccagtgcagccatttgcgacgaatggttctgaaagaacatgagatcagaaggttccagaagcgtctcctttctcaccacgttagggtaagccaaggtaagagaagccattctgcgttttccaccatatatcttcccagctgcaatgtaaatttgcatacttttgtcgatattc

SEQ ID NO: 47637 - DNA, 454 bp, Zea mays
  Clone ID: LIB3066-016-Q1-K1-C9
gcggtgaaatgctattccaagtaattaatactcatataccatagaacattttctgtcatactagagcctataatacaagtaaccaatcctattgtaggttgctgactgctttctagagtacgaaatccatttttctacagcagtattaagcatgggatgtgctctaggattggcttatccacatactaagttggaccacaattaatcaaaactacatcattgtgctcgataggaaattttgtgctttcctttttacatatagatcatgtctataggtctcagaaaacttcatcaaatgtactcttgtttcacctacatggaaacatgggatgtgattgtatcggagtggtattattacaaggtacatatagtactagcttgaggaactgaagatgttttacatgtgatgtacatcggacttgagagctatgaatcaacaacatacgttttaaac

SEQ ID NO: 47638 - DNA, 214 bp, Zea mays
  Clone ID: LIB3066-016-Q1-K1-D1
aattcccattcgacccacgacctactcttaaccttccacaacaccacttccacaactttctcatccctgctttccaacatccatttccgtcgggttattattacctccggaatcatctacaatcacaatctccatcatccatacattatacacaccctattctaatcatccctaactctcctccacatacaactctttcatcacactcacacta

SEQ ID NO: 47639 - DNA, 447 bp, Zea mays
  Clone ID: LIB3066-016-Q1-K1-B12
ttttctttctaattaaagtaaaaagtacccacggaaatgcccaaattgcaaataaaaaaaatgaaagtaaaggatatattttaacctgaaacggatatctttgtatcttttttctttttgttatttctaactcatatttatgagataataaaatatgacaaaagctataccaaaaataggttcacgtaagaaagtgcgtattggtttgcgtaggaatgcccgttttagtttacggaagagtgcacgtagaataacaaaagggattattcatgttcaagctagtttcaacaataccattataaccgttacagacccacaaggtcgggtcgttttggtcctccgcaggtacttgtggattcaaaagctcaagaaaagcatcaccctatgctggtcaaagaacagcagtagatgctattcgtacagtgggtttgcaacgagcagaagtta

SEQ ID NO: 47640 - DNA, 401 bp, Zea mays
  Clone ID: LIB3066-015-Q1-K1-H7
ggccaaggtgaaggagtcgttcaacgatgggaaggagctcaccagcaacgccctggcgctcgatcgagaaggggtcatcgctcctctccgtgctaaagggcggctcgaaacgacggttgctcgaggaggagggagaaccggcgcaagccgggcctgcactcgacaaggacggcatcccggagtgggtgcccgacagtgagcggagggtgctcaagggcggcggcttcaagagcacactcacgccaaatgtggtggtggcgaaggacggcagcggcaagttcaagaccatcaacgaggcgctcgccgccatgccaaagacctacgacggaagatacgtgatccaagtgaaggagggagtgtacgaggagtacgtgaccatcaccaagactatgaaaaacgtg

SEQ ID NO: 47641 - DNA, 376 bp, Zea mays
  Clone ID: LIB3066-015-Q1-K1-H9
caagaacaaaccattgttggacgcgttcccctcctgcacgcaacctcatctcgtgctccagagcctggatggccgtcctccttgatcctggcctgcaagtgctctcggtaagctacttggtttggattaataaggaaatccgttggcttaaggtaatgcaggctaaaacctgatggctgaattcggcatctaacggcctggaatagagctaggactggaagaaaccaccaaacccgcgttggatcctgtatcgatctggagaaatttctaagtcgtcgtcgtcgtcgtcgttcggttcgaagcggatctgaggcgactatggctgaaggcggcgggatctctgggtctgcagtcctgcttcacctcgatggatgat

SEQ ID NO: 47642 - DNA, 394 bp, Zea mays
  Clone ID: LIB3066-016-Q1-K1-A1
tgctgtcatcaagcctttctatcaaagttttggcatctggttcagtttcagcacaagttctagtgttagcttcgtgggggaaagaaaaaaaagaaggaaaaaaaatccaagaaagttcttgaaaaaagaaagaaaaatagaaaaacaatttgaaaaagcaaaaaaaaaaaagtatacaaaaatggaaaaaaaatagtgatgatgtcataggctaggaattatcccccagggtagccagcagagaatgggtcaggcacattcatggtactgatgtggagtgatatcattagccatttactggcaatagcatgttgactatgcatgcactccagaagaagtgcagcagcatttcaattcttgtggaactgttaacagagtgacaatcctgactgac

SEQ ID NO: 47643 - DNA, 452 bp, Zea mays
  unsure at all n locations
  Clone ID: LIB3066-016-Q1-K1-A10
atcaggcgcagacaaagagaccaccaatgaccaaaactcctaattacctcctgtagggatccctcgatgcgtgtgttttcttctggctgttgtatctgatgctcaaagtagatgctccgtgtgtcttccgctgctgttccgcaaggaaactgactcccccgaccgtcgtcgtgatgctgcccgctcatgctcctagacgggaatgactgccgcagaatgacgaatagggctggtgtgtgttacagtatggtccttttcccctcctttccattaagctctgtgatgtagctgtccgtgctgttgattcatgagatcatgctagagatttttcctgagtgcgtgtaaaactgtcgaactatttgaacgaaagttgtacactgcagtatgtaacaatctcctagatccgncttttgtggcgtcctgctgtaaaaaaaaaacaaatttttattttt

SEQ ID NO: 47644 - DNA, 382 bp, Zea mays
  Clone ID: LIB3066-016-Q1-K1-A11
tcatcttctccgatccatcaacaatcgccgagagcgatcgagagataaataaagatgaagaaaggggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgaccgcagatgaaagtgtgcccagaggcgttcgacaaggactacctggt

SEQ ID NO: 47645 - DNA, 321 bp, Zea mays
  Clone ID: LIB3066-016-Q1-K1-A12
gacggacgcgtcctacgacgactcgtccggcactgcctgctgcctttttcatccgacaaccctagaaccacaaagctgatatctctacactggtgtgcgcgctgcatccgcatgatatcgctaaagtcaacggagttgctgcatatctcagacactgcaacacacctgctcacgttcttcacttcactggaccctcatagctacccaacttcttaaaaagtcttaatcacgatgtcattcctgccggtgtcccaaggaaacctgcgatgactctcgatgacctctttaacatcaacacatgcatcgacaagacacttgttt

SEQ ID NO: 47646 - DNA, 347 bp, Zea mays
  Clone ID: LIB3066-016-Q1-K1-A2
gcgactctgcatagatggataagcagatgcggattcactagcatcaacatgagagttctagacggatgtaacggagctgtcattcgcagctgacagcgctaatagctactcgcgtaacgatcattaacatgtactacatgttgcggcgcatggagactgctacgatgagttctctagagttctagattagagagtgctagtaaagtttgacctgctcagaacatgactgcttataacggatgaatctagctataatgtgtcacgctctcattctatagcaccagatgttgcatgccgatcatatgcaatcgagtcatcatacgtgtcggacttgctcacagctcaca

SEQ ID NO: 47647 - DNA, 406 bp, Zea mays
  unsure at all n locations
  Clone ID: LIB3066-016-Q1-K1-A3
tacgacgtcacgcttgttgtactcacattcccccaggtcaaggacaggtaccactggataaggagtatgaaggatactgtgatgagttcgtgagtggtctaggccgtcgtctcccaatcaactttggttgctggatcgttgtcttcatatgatgtaattatttaactattttgtacagaactccattatatattaaagttgtggcattcgtttctgtaccatgagtcatcatatgtgtgagacttggtcctagcacacttggtgattattttcacgcctgggttttggtgcccctagaacccgggtgtgacagaagtggtatcagagggatgttgactgtangacgaaacctagatagaactggataacccttacctacttatctttgctactctgatttttttct

SEQ ID NO: 47648 - DNA, 358 bp, Zea mays
  Clone ID: LIB3066-016-Q1-K1-A4
cccacgcgtccgcccacgcgtccggtggagccctacaacggcagcttgccgggcctgcgctacaaccgaaactcgtggacaaaggtggcgcatattctttttgtggattcgccagttggtgccgggttttccttctccagagatgccaaaggctacaacgctggagcggtatcaaccacgctacacttggcgaagttcctcaccaagtggttcaacgaccatcccgagtaccatgcaaatcctttctacatcgatggagaatcatacgctggaaaaattgtaccattccttgcacagatgatttcagaaggtattgaagcaggaatgaagtcggcacctcgtctcaagggctatctag

SEQ ID NO: 47649 - DNA, 438 bp, Zea mays
  unsure at all n locations
  Clone ID: LIB3066-016-Q1-K1-A5
cggacattccttctttcacttgttggtcctggacattaggttatgtttcgaccatgggacatgatattccacccatccaccctaaatgcagcgacctacctggaaaacttatgatgttgccatttgtcagtggtgactcgtggattcgtctaacttccacatatgcggtatctagtatgcttgactaaagtattcgtgtttaagtttgtatctgggtttcttgttggaaaattctgtgcgggggcacaacagctgttgttggtcacagtaggcttgacttgtgtctccatgacatcaataatattatgtcatgttcgtgtgtgatcattccactattagagaaagcaccatatgtaccggttgagaattggctttaaagaggagattttagtaccggttcttggtatgagctgatactaaaagttacataaaanaaaa

SEQ ID NO: 47650 - DNA, 236 bp, Zea mays
  Clone ID: LIB3066-016-Q1-K1-A7
tcgcccacgcgtgcgggggccgccctttttttttttttttacacaagcataataatttgattagggggaatagccatctataacattgtaggcatcgtgttcaatgtaatgtatacacaagatcagtaataatactatggggtaccattaacgtgggaggaaagtatacattctattatccagctctagcgaactcagaacgaaaaggtctagtactaaaaacaaccacttgaagg

SEQ ID NO: 47651 - DNA, 349 bp, Zea mays
  Clone ID: LIB3066-016-Q1-K1-A8
ttcagttggcgcacgaggatgctagtcatatcagactgggggaggcggttcatctttggaagggactccagtagcatataaattcaaatctcccgattttgtagttcacctgcgttctagatgctactagtactacttgcatcagttttgctgtcccactatttccgaagcttagcctcgcaaggtttctgataccaaattttgaccttgccaaatgttttgttacctcgtcatgcacactgagtgattcagatgttatatacgtcttatcggatatttgcttttttatgtagggcactatgatttctagctataccgattctaattgtaagtttgagttattctggtc

SEQ ID NO: 47652 - DNA, 445 bp, Zea mays
  Clone ID: LIB3066-016-Q1-K1-A9
cccacgcgtccgctctgcctctcttctctaaaccggcgaccaggagaacttctcctgtcgacgggtagctcggcgtgggggcataaccctgccggcaaccacgggtcaaggctacgatctacgtagccgaggtcctcctaccttgggcaataccgcccttgacatgagctgtccgtcaacttttctctgtagagtgtgccacgggaggaggcatgggatgaggatacgggatgagagaagccgcaggtcatttaccatgcatattcacaaagtttgatagtcgtggctgtaaggagtgctcgctcgtcaggcctcacaacccatatggagctactacatccatgctgtataagctgccgaatacacctactcacggaagtctcatgggccctcatcgagctgacgccagagcttgttagtactgcgtctgcgtcttacactgata

SEQ ID NO: 47653 - DNA, 71 bp, Zea mays
  Clone ID: LIB3066-016-Q1-K1-B1
aacggagtgaaaattggcattttgttgggaaatggatttattttaaggagtacaattttttttgacaatta

SEQ ID NO: 47654 - DNA, 422 bp, Zea mays
  Clone ID: LIB3066-016-Q1-K1-B10
cggacgcgtgggctcgtctcctccactccaattgaacaggcgccggcgaaaggcgggagcggcgggctgcccattcaccgccccctgatttcttgggagttgcggatcggtctccggggcagcgtgcaacggctggacccctcggatcgccggagatgctgccctacgcgacggctgcggatgcagaggcagcgcttggccggcccatgacgcccgccgaggcgctgtggttccggtacaccgcgggggtgtccgactaccacctctactgctgcaacatcctctttctcttcgtcgtcttcacggtggcaccgcttgccatcgcgctcctatcttcaggccccggccgcggtcttgccgtacgaactgcagccgcaggtgccgctctccagggccgagttcgtgctgtgctactaggacgt

SEQ ID NO: 47655 - DNA, 259 bp, Zea mays
  Clone ID: LIB3066-016-Q1-K1-B11
cgatccattgaataattttactaatcaaattcttgttgggatatattcctccaattcccctggtcgtaccaacaaggcaacaacaatctgatccggccgccaaacaaaaccaacataaaaacacactgaacccaataatccgatcccacagaaactattatctcggtccgtacgatcgatcgctgccgcgtcgtttgccagacaccatcaacacccaaaaccatggtctagaacctgactcagtgcgccatcgacgacg

SEQ ID NO: 47656 - DNA, 333 bp, Zea mays
  Clone ID: LIB3066-015-Q1-K1-H6
attcccgtgtgtcgacccactcttcctaaaaaaaataaaaaaaaaaatctataaaaaaacttaaaaaaaaaaaaaaaaaaagggacccttagcgtatctttttccccaagttcgcacactctttctctgctaccttatatcttttctatagtttcatctattttcttttctgtccccgtttttaaacaacgtcccctctgttaaccccctctcttccccttttttaatccttttacttcatatacccttttcctaatctctctttatccctaagagcccctcccttttctctctcccaaacttattctcaccttgtatctaatgtttcaccct

SEQ ID NO: 47657 - DNA, 464 bp, Zea mays
  Clone ID: LIB3066-007-Q1-K1-D3
atagagagagagagagagggggactggatgccctgcagcggcatttcggggaccctcagggcggggcagatcgacgtggtcatcgacacggggaacccgttcctgaaccgcaccgtcgacggcttgctcaagatcggcgctgtcggcgcctgcaaggtggcggccgaggagaccttcgactgcctgcacaggggggatgtttcaaagcgcaaggttgagcatgccctgaagaagatgtgcaaggagggcgcatattgcgggactgttgctggcgtctacgtgggcgtggtgtatggcgtgtagagggtacgtgggcgcagtgactggaagaacgcgatggtcggaggcgccttgtccggcgcgctggtctccgacgccagcagcaaccacggtgacaagatcgtcacggacgccatcaccggcggcgccgtcgcaacggccgttgagttcgccaactacctcac

SEQ ID NO: 47658 - DNA, 459 bp, Zea mays
  Clone ID: LIB3066-007-Q1-K1-D4
cccacgcgtccgcccacgcgtgcgcccacgcgtccgcccacgcgtccgcccacgcgtacggggggcgtacggcagagctccacggggatcaccatctccaactgccacttcaccaaccacaacgacgtcatgctcttcggcgccagcgactcctggccgcaggaccagatcatgcagatcaccgtcgccttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaacggcgccatcttcaat

SEQ ID NO: 47659 - DNA, 326 bp, Zea mays
  Clone ID: LIB3066-007-Q1-K1-D5
cattcacacgctggatgttacgtgcccccaagagtccctgtaacctcgcgttaccaaagagtcgtacagaagtgcctcctccggtgttcataccagatattggatgaatcaacaacagtgaggattctgatggtcccgcctcaaaagaaaattcccacgttgctcacgtggactcttggagggaggaatatctacgttgaaggatcatgggacaactggacatcaaagaaactcgttgagaaatccggaaaagatcacaccattcttttgatgctttcatctggagttcaccgttatagattcattgtagatggagaaagaagatt

SEQ ID NO: 47660 - DNA, 227 bp, Zea mays
  Clone ID: LIB3066-007-Q1-K1-D6
ggcaaatgatttatgttctctgcgtttatttccagaaagagaaggagcatcaaatcacgagtggttctcatgatattgaagatgcattgccctttaaaaatataatagatctcctcattgatcatcatccagactcttcagctaaaactcataactctttccctacattatactttgacatgtaccttgcagtgcattatattctggtcagatcatctctgttcata

SEQ ID NO: 47661 - DNA, 454 bp, Zea mays
  Clone ID: LIB3066-007-Q1-K1-D8
agcacagagacaccaagcgttgaactcgcctaagcagctatcaaccaaccctagaaagctggacaccgtacccatggctcgcgctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacgatgatgactccaccaattgaggccacacacgtcggcccggttaaatttggaacaagacatggaagaaaaatgatagcaatgtctataaaaccatgataatgtgtggtcatccactcatccatggatacatgcttgctctacctctttttctgtctgcatgattgtcaatgtgttatcatgctgttagttaactg

SEQ ID NO: 47662 - DNA, 385 bp, Zea mays
  Clone ID: LIB3066-007-Q1-K1-D9
cccacgcgtccgcccacgcgtccgcggacgcgtgggggaaagcaatcacaggcggacgatccgagcagagaaggggaggtacctgctacgactagctagattccacgcgcgatggcgcccaccaggatccgcgtggccttgctgagcttggcgctggtggggctgctcatctgccacctcgccaccaccgcctccgccggcaagaacagaatccgcatcctcgacagcgtcgacgactcggccggggacaacaacagctccgacgcctcggccggggacaacagcaccgactccgagtcggaaggccgcgtcgtctattccgacatgaagctggctgatgagacgggatctgcgccggctccggcaccggcgccggggccgacga

SEQ ID NO: 47663 - DNA, 384 bp, Zea mays
  Clone ID: LIB3066-007-Q1-K1-E1
cccaagcgtacggttgtagcatcgacctatatctgtaattctgtagctcattgcgtatcatgtgggcgagagatgaacacatatccgcattctttctactgaaacaccagaaatatgcgctcttgctccataattcgttaacacaactgcaatggcggacggtactgccatgaaggccaaggtcctgatctcttgcgaaggcacatactcctcggcgtccatgtaccttggtctgtctccagtgaggacgatacatcgaccacagctaccgggcttcacctagtatccgaacggccaatccttagacacagagatcttgctcctgctcgatccaagcttctttatcggaagtctgaccatcacggacaatctggtccatatctt

SEQ ID NO: 47664 - DNA, 218 bp, Zea mays
  Clone ID: LIB3066-007-Q1-K1-E10
cccacgcgtccgctatctccttgtaaacctacatcagacgatgccccagcgcgtgccggtgatttgatgcaagtatgcggttttaatttgtaaatcagagtcgacccatactacgcgacacccagtatcaattttcacttgtaatgaaaaattacacatgtactcatttgttgtacacaaacaaacaaaaaacgttagaatataagaggatgtttctc

SEQ ID NO: 47665 - DNA, 389 bp, Zea mays
  Clone ID: LIB3066-007-Q1-K1-E11
gaactctcgcattccactattccagtcatcgagagcgcggctgcggcggcgagggaacgcatcctttctcgcatcatggccacctctacggagccggagggcgcgccgtccgcggctaaggggcctaaaggagaggccaacacgaaggggagcaacgaacatggagaggtcggcgcaggcagcggcggcggctcgcagaagcggaagaggaaggaggtcttcatctacggcaactacaggaactactatggctaccggattgatcgcaatgttggtgaagatcctcgccttgaggcgttcaagaaacagtggtttgaaaagaaggattgtctcgatattggatgcaaccaaggtttgggaacgattggcttagccatgaaatttaaatg

SEQ ID NO: 47666 - DNA, 433 bp, Zea mays
  Clone ID: LIB3066-007-Q1-K1-E12
cccacgcgtccgccagatcaacaatgggggctgctggaatgagactaggaacgggaagagtgtgtctgcctgctcaaaccaagaagctaaaggctgcaagtgcccagcaggtttcaagggcgacggagccaacagctgcgaagatgtggatgagtgcaaggagaagcttttctgccagtgcaaggactgcgcttgcgagaacacgtggggaagctacgagtgcagctgcggcggcggcaactcgctgtacatcagagagcatgacacttgcatcagcaaacattccagctcgacgccgagctggggcttcctgtgggtggttttcttgggccttgccttggccggagcaggagcgtacgccgtgtacaaatacaggctacggagctacatggattcaaagatccgcgcgatcatggcccagtacatgcccctg

SEQ ID NO: 47667 - DNA, 284 bp, Zea mays
  Clone ID: LIB3066-007-Q1-K1-E2
cacagttattaagtacgacaactagacacatactcatagtcgaacgcgaatctcgttgcggtacacacggataatcacgtcaaattacatgtactcatgttcactatcacattccaacacatcgataatcttctcttcatcctgaaactggacaccctaatgtctcacacaatacaattcgagatctacagtgagcctaactgtccgcatgccttatcccatacatctgatccaatgaatgcctctcttattcttactgtacttcatgtacatcacctttcgac

SEQ ID NO: 47668 - DNA, 474 bp, Zea mays
  Clone ID: LIB3066-007-Q1-K1-E4
acgataagatggcgtgtctagacaatgcaatgagagcctagatccttatagcgctctactgtggcgggcatggtgagaaggcaaagtcaaaggacaacgatgcaaaagcgtccgggcccggtgggtccttcgacatcaccaagttgggcgcctccggcaatggcaagacggatagcacgaaggctgtgcaagaggcgtgggcatcagcgtgcggaggcaccgggaagcatgacgatcctcatccacaagggcgacttgctcgtcggaccactcaacttcacaggcccatgcaagggcgacgtgaccatgcaggtgaatggcaatctgctggcgaccacggacctaagccagtacaaggatcatggtaattggatcgagattctacgcgtggacaaccttgtcatcaccggcaagggaaagctcgacgggcacgggccagccgtgtggagcaagaactcctgccgtaagaagtac

SEQ ID NO: 47669 - DNA, 439 bp, Zea mays
  Clone ID: LIB3066-007-Q1-K1-E5
ggaacatttgagtggatcatggactgattgttaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgatggtggaggccgcgaacgcgagccctgaggcaagcctgtggaacggcgccatcatcctgtcagtgcggccgagcgccacgaactgactatccgacaagagctacgtgtgctggaagaacggtaagttcgcgcatgacatgatcc

SEQ ID NO: 47670 - DNA, 468 bp, Zea mays
  Clone ID: LIB3066-007-Q1-K1-E6
cccacgcgtccgcccacgcgtccggaaataattgggaataaatagttcgtgaatccctggggcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgttcatgtatgctca

SEQ ID NO: 47671 - DNA, 211 bp, Zea mays
  Clone ID: LIB3066-007-Q1-K1-E7
gaattccctgtcgaccgactcgtactcccacgcgtccgcccactcttccctaaatttttctcaataaatacatcgtcaatcccttagtcatcatatataggttgctggcaatatcaactttatgtactcttcactcaattaccatcctactcatattctgcttatcattctcattctttccatcattactactcatctcaccctaatatct

SEQ ID NO: 47672 - DNA, 472 bp, Zea mays
  Clone ID: LIB3066-007-Q1-K1-D2
gaatcagccctattacctgcttgaggagattctcccttcatctcttgtcctgtacattctggggaggattcctgcaaagctacggatatcccagtatcaccccgtgagcagcagctagagacgaggcattaccatctgctgagccaaaaatggtgactgctgacaagctatgaaaaatcaactgcaacgccctctatataatatttgtattggcagcctctctgcaaaatatatatagggataagacttgcctcggacatttcatttctagaccctactcacatggaagccatccaatatttttccgtaactcacctattgctaaccctgttagttcaatctgctaatgctatgatttttagtgcttgagcataatgaaggaaagcaccattgtaaaactgaactacatgaaaagttgaacatagattactttctctggagatgagtctaacagcgagttaccctttggaat

SEQ ID NO: 47673 - DNA, 426 bp, Zea mays
  Clone ID: LIB3066-007-Q1-K1-C1
cccacgcgtccgcccacgcgtccggcaaattaaagagggatcggattggaactcgatcggaaggaatgtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatcttcagtgctgcgcgcttccacgccaacgtggatgcacgcgcgtatggtcgccgctccaacctgcagctgcaggaggaagaagcagcagctaccgcggtgcgtgtaaccaaagcagaagaac

SEQ ID NO: 47674 - DNA, 435 bp, Zea mays
  Clone ID: LIB3066-007-Q1-K1-C10
cccacgcgtccgcagaaaagcaagattttcttcattgcctggtccccatcggcgatcccgcatacgtgctaagatgctgtactccacgtcgaaggaccgcatcaagtacgagcttgacgggttccactacgaaatccaggcgaccgacccatcggaggtggacatcgaggttctccgggagcgggctcactgaagctggttctccttttgaagggacctgtggagggccgtgaaccttcagccagatgcaaattcaattgtcaacgatgaagctcccgccgtggtgtttgttaataagttcctgtaagcgtatcatttagtcgctatgcatgatactagctggtgaagcgctatctaagctgtaaacgaagcaagatttgcaaacttgttatattgtggtattgatgatactggattactggctgtgggttaaaa

SEQ ID NO: 47675 - DNA, 388 bp, Zea mays
  unsure at all n locations
  Clone ID: LIB3066-007-Q1-K1-C11
gcgcaccgcctccccgtgtcccctccttctcgcccggcaccgtcgagctcgggtgtgggaacagaacaaacccatcaaccatggcgaactcggcgtcggggatggccgtgagcgacgagtgcaagctcaagttccaggagctcaagtcgaagcgaagcttccggttcatcacgttcaagatcaacgagcagacgcagcaggtggtggtggacaggctggggcagccgggcgacacctacgacgacttcaccggctccatgcccgagagcgagtgccgctacgccgtcttcgacttcgacttcaccaccgacgagaactgccagaagagcaagatcttgttcatctcctggtccccggacacctcgagggtcangagcaagatgctgta

SEQ ID NO: 47676 - DNA, 455 bp, Zea mays
  Clone ID: LIB3066-007-Q1-K1-C2
ccgagagcgaaagcaaagagctgagcgggacggagcagctagcgctagggataacgcacacgggccaccatggcgacgcccggagagcagccggcggaggtcgtgtccgtcgagatgcccgcacccgacgggtggaccaagaagtttactcccttgagaggggggagatctgagattgtttttgtttcaccaactggtgaggaaattaagaacaagaggcaattaagtcagtacctaaaggcacaccctggaggccctgctgtttcagagtttgattggggaactggtgataccccaaggcgttctgctcgtattagcgagaaagtcaaggtatttgatagcccagagggcgagaagatcccgaagcgcagcatgaactccagtggtaggaagggtaagcaggggaagaaggaaacccctgagaccgaagaagccaaagatgctgaaactggcaa

SEQ ID NO: 47677 - DNA, 458 bp, Zea mays
  Clone ID: LIB3066-007-Q1-K1-C3
cggacgcgtgggcccaagcaccgcgtcgaacaaagcatcgacatacagacagccagactgcgagggaaaccggctacgccaaaaccaaatactctgtgtgcgtacgcgcggcagtgagcgacgaggcgcggtgcgcgcgcactggccatgagccggggccgcgcacgccggccggttccaggcagtggcacccgcgccggcgcgctcgaggtcctgctgctcctggcgtacgacgtgctgctagcagcgtaccccgccgcggccgtggaggcagaggcaggggacgaggaggcggtggactacggcgcgtcgctgtccaagagcctgctctacttcgaggcgcaacggtcggggcggctgccgcacaaccagcgcgtgccgaggcggtgccactcgggccttaccgacgggctgcagcatggcgtggacctcgtcggcggctactacgacgccgggga

SEQ ID NO: 47678 - DNA, 469 bp, Zea mays
  Clone ID: LIB3066-007-Q1-K1-C4
ggtcgacaggcaccgacacgacccatgtcgtcaatgtggcgcgtttcccgccgcctcctgcgcgccgccgcctcggcctctacctcggcgatcgggcgcggcgccgagccccgccggtgggtcccgccgccgttcgcgctgcagcgctgcggccacgcgtcgcttccggacgcggcgaggagggacggggaggaggaggtgacggcggcggaggcgaggcggctgatgcggctgaccaacgtggatgcgctcaagcggcggctcggggacggggaggtgatcccgtacgcggacctgctgcgcgcgtgccaggactccggcgcggcccggacgcgcgccgaggccgcggcgctcgcgggcgcgctcgacgaggccggcgtcgtcctgctctttcgcgacagggtctacctccagcccgacaagattgctgaccttgtaaggaaagctatgcccctggcactgacacctg

SEQ ID NO: 47679 - DNA, 473 bp, Zea mays
  unsure at all n locations
  Clone ID: LIB3066-007-Q1-K1-C5
gggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattggattcctattaatctggcattntctaagctaattgtttttttt

SEQ ID NO: 47680 - DNA, 451 bp, Zea mays
  unsure at all n locations
  Clone ID: LIB3066-007-Q1-K1-C7
cgtcctcgcaccagtccctcctccttggaagcgagggaggagagtggagggagagggaggagcgaggcaccggtgagctcgggaggcggcgtggggcttgcacgccggccctacccccagctcactcaccacgctcttgtctgaccaactctctctctctcttatctccttccaagattcccccatttttttgttgttgtcccccccattcttgctaggatcattccttgatctttcgctcgctccagtacgcctgttttccagctccggagatcccatctcggccacctcctgcggtctccaagctccaagaggccagattccagcacaaatttgaggtcaatttgcccgctgagctcgaatcaatccgctcggcaacaagtgtcatttgttcccccgatccccgggcttcgattcgatcgaatccgacctaattntattgngtgtgtgt

SEQ ID NO: 47681 - DNA, 436 bp, Zea mays
  unsure at all n locations
  Clone ID: LIB3066-007-Q1-K1-C9
gcgcgcagagcaagcagcaggcgtgcagccgcacgtgcgagtcggaccactggacgagtgacgtacagttaacccgcctcttccatgatcttctgccgctctcaccggcgttaattctttgcgacagcgccgccgttcctgcggtacggcaagtactgcggcatcatgtacagcggctgccccggcgagccgccgtgcgacgcgctggacgcctgctgcatgcaccacgacaactgcgtccaggcaaagagtacgtctgcgttgctccagtcgtcgtcttcagttcctatagctccagtagtgaatcttcagttcctatagctccagtagtgaatcttcagttcgacagcacgcacggacgtgggctgacgacggctgctgcgcgcgtgttgtgtactaccatgtgcagtggactacctgagcacggnctgcaacg

SEQ ID NO: 47682 - DNA, 431 bp, Zea mays
  Clone ID: LIB3066-007-Q1-K1-D10
cccacgcgtccgcccacgcgtccgcggacgcgtgggttcactaatccaagacggaacgtggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacaggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacattac

SEQ ID NO: 47683 - DNA, 425 bp, Zea mays
  Clone ID: LIB3066-007-Q1-K1-D12
cccacgcgtccgcccacgcgtccgcccacgcgtccgcccacgcgtccggccggcggacgtcaaaggggttgccctcatcggcggcagcgccaacagcacggtcgctggggtcattcacttcttcgaggacccctccaccaggtacaccgaggtgaggggcaaggtcacgggcttgactccgggaaggcatggattccacatccacgtcttcggcgacactaccaatggctgcaactcaaccgggccccattttaaccctcataataaaccccatggagctccatttgacgatgaacgacatttgggcgacctgggaaacatagtagccaatgaagatggagatgcagaagtgttcataagagacttacagatttcattgagtgggcctcattccatactgggaagggcagttgttgtacatgctg

SEQ ID NO: 47684 - DNA, 432 bp, Zea mays
  unsure at all n locations
  Clone ID: LIB3066-007-Q1-K1-B9
cccacgcgtccgaccacgcgtccgactctctcccttcgtcaccatcacatcgagccagcgaacaaaaatgttgcgcgtcacagctgccgtgctcttctacatcctcgccgttgctgccctcagcgcggccgacgccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgtctctacacccccttcttccacggacgaggagttgagcccttccccgccagcatccaccgccgcggcgtcccctgcggctganggaccggctgctgatgactccgncggtgctgctgcccttggaagtggaac

SEQ ID NO: 47685 - DNA, 281 bp, Zea mays
  Clone ID: LIB3066-007-Q1-K1-A3
tcaccacgtccgactgccctctccaaactctaaccccgacgtgcctatccaactcgtccagcggcgtcgaccaacgatgcacaaattaccacagaccagccatcgggtacacaactgaccaacttgttgagcacctacagaaactcaagagacattacacgatctacgatcaccctgacatattgacagatgctgtacaggctatacatgtatgacatataggatgtgcactgagcaacaatctactctttatacacaagaagcatgtgttatatgttata

SEQ ID NO: 47686 - DNA, 468 bp, Zea mays
  Clone ID: LIB3066-007-Q1-K1-A4
cccacgcgtccgcagctttagacgaagatggccaatctcctgaaacatatgccaagttgaggaagcataattcatataatgagcttgtagcacaaaagctggtggacatgaagaacagccaggttactataacggtcaatggcgatgaaattcatatggatcagttagggaatgttgatgaccgtaaaaaatctggggttcaggcattgcaaataagatcttgctcccagtgtgccatttcggagtctggtgtgttaaggcagcctatgcggtcaaggggactgcttgctcggccttatattcattcaatgcttgctatagcagcagtctgcgtatgcgtctgtgtattcatgcgagctttgctgcggatcaattctggaaaatccttcaagtgggagaggctggattacggtacaatataattgtggggacacacctgagccttgtggtattattaagttaacaagc

SEQ ID NO: 47687 - DNA, 459 bp, Zea mays
  unsure at all n locations
  Clone ID: LIB3066-007-Q1-K1-A5
cggacgcgtgggcctgcttcctcccgacgaccacgaccccggctggtcgcgccgcttcgacgccgagctcggccccgtgcaccggtacttcggcccggacgcgccgctggacgtgcggcagcggatcgcgtacctgttcgcgatcctcgaccggtcgtccagggacggcggcgtcggcgtcggcgagctggaggcctggctgcgctggcaggccgccgcccggctggacgccgtcacgcggagggagatggctccgcacgacacggaccgcgacggtgccgtcacgctgcgcgagttcttcgcagactggatcaacatgggacatgacaaaatggggtggtggatgcacaagtttgcgagcgcggacagagacggggacggctcgctcaacgccgtcgaattcaacgacttcctgcatnctgaagacagcagccaagagagcgtgatgctgtggctact

SEQ ID NO: 47688 - DNA, 374 bp, Zea mays
  Clone ID: LIB3066-007-Q1-K1-A6
aagtagacgacgacgatataccccaatgcatggcaagaagatatatatatcagcacaacgcgtgctgcatgcgatgctgcttgttgctgcaattgatccactatactatactataggagtattattaattccagttgcagcatgcatgatgatatatatatgtgtctctatatgcatgcgttggtctatacaattcagatatgcatggtgtatacaagtggtagctagtacgcacgtacacatccagtcattaatttgtacgtcttcgcgtgcatttgggctgtcagcttattaattaaagtacatactctttactaaaaaaaaaaaaaataatcaacaagaaatatcaaaaaaaaaaaaataaagaccgaaac

SEQ ID NO: 47689 - DNA, 479 bp, Zea mays
  Clone ID: LIB3066-007-Q1-K1-A7
cgacacacgcgtgcgcactttagctatgaacgattgatatcaaagtccactgacagtgttagtgagataaacaagaggcgcagagagacatatttggtggacagtgaattcgagaccgtatttggcatgactaaggaggagttctacgagcagccaatgtggaagcaggagttgcagaaaaagaaagccgatcttttctgagacaaggctggcttcgaactaataaaagcccttacgtcgcacaggattgtccagcattctcatcatgctcgttacgctgatgatgatcgatcaccagcagctttatccgtgagttgtataggctactcttttatctgcacatggtttgtgagcattatatatatatcccacttgcccgtccattattctgaggtcgttcttgatgttgacctttcacgtgttttctttttttattgtattataaaagatcaaactggtgtaaatggcattactagtga

SEQ ID NO: 47690 - DNA, 475 bp, Zea mays
  Clone ID: LIB3066-007-Q1-K1-A8
cggacgcgtgggtgacgccgccgccgccgcctccgtgcctcgcctgcctcctcaccctggtgctcctcgccgccggggcggcgccaccggccggcgccatctgcgtcccgcgcaatcccggtggccacagcaagccaggagcgccggccaagcccgcgccaccgaaactgaagcccctcacgcccgcggcgccggcgccgccgaagccgacgccgatggccccgggcgccgacatcgtgcggagcctgtgcctgaagaccgactaccccgacctgtgcatgtcggccatcgcgaagcagccgcagccgcagctgccggtcgggaagcggctggacggcgccggcgtgctgcggctggccatgggcgccgtgcgcaccaaggccgtcgaggccaaggccgcggcgggcgcgctcgccaacgacccccggacgcagccgctggcgcgcggcccgctgcacgactgcgtcgagtcgtt

SEQ ID NO: 47691 - DNA, 412 bp, Zea mays
  Clone ID: LIB3066-007-Q1-K1-A9
ctcttcctggtccaagtgatcttgccaagttacgagcagcgagcagagatcagatcatgcatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgccgtggcgggcgtcacgaacacggtgaccggcgcggcggctggtgtcaaggacaccgtgaccggcggc

SEQ ID NO: 47692 - DNA, 379 bp, Zea mays
  Clone ID: LIB3066-007-Q1-K1-B1
ctgcctcgacggacgcgtccgcccacgcgtccggactagttctagatctgctgcattttttatgcaatatttggggaagctcgggtggagccaatggcgttatcagagcccacaaattgccagcctaatcgagaaaagtgcattaggcatttaccaaagcccatgatgcaaattttctcattaacattgggtaaaattcccatcgaaagagattcagtagaattatatggttacatggcggtgcgggatgatcaggatttattgcttaattatattgtcaatcggagcatggatgaagccattttactgcaaaaggattcccttatcgaaatgactggccctaagccaggcatctcaatgacatcctctgtacatgctg

SEQ ID NO: 47693 - DNA, 90 bp, Zea mays
  Clone ID: LIB3066-007-Q1-K1-B10
gcgtattggcctatgagaatcgccagaatatttcactgttggatctgtactatagcctggtgctgaatgtcgtataagggctagttttgc

SEQ ID NO: 47694 - DNA, 229 bp, Zea mays
  Clone ID: LIB3066-007-Q1-K1-B12
ccgcccacgcgtccgcccacgcgtacacgtttacatgaacagacacgtataccgggcaatgtataatttcgaaattttcgaaccaatacctgctaacgttcaagatactaatatacaaatgctactacatacttacttaccaagaacatgactatacttttataaattttatatttttatattatataatttttcttatatatatttatataaattatattatattaat

SEQ ID NO: 47695 - DNA, 472 bp, Zea mays
  Clone ID: LIB3066-007-Q1-K1-B2
cccggtcgacgcgacgcgtgcgcgcccaaccctacacgagtacgagtacctaacatacgagtatacgaccacgagtccacgagcagacgagctcctgcgccaccagtgtcatcgcgtcgccgtcgcgtccgcctcgccctcgtccatggcgtccgtgtccacggcgccgcgcgctccactcccggcggcagcgtcgtcctcgttatccgcgcggcaagtggatccgaaccctagcggcagccactttttcgacgggcggcgcctccgcgtcgtccgccgcctcgccggcgcggccccgtcgcggcgcgctccgttggtctgctgctccgcgcgtagtccggacgcggacgccggcgacgagcgacgccggcggcgttgggacgcgatgcttcacgacgccttcaagggtgccgtgcgacggtggagcgagtacgtcagcaattactggcccccaccgacctctgttaacgag

SEQ ID NO: 47696 - DNA, 461 bp, Zea mays
  Clone ID: LIB3066-007-Q1-K1-B4
cccacgcgtccggaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcatgagctgcctggaggcgggctcctcgtgtaccagagcttctgtgctgctg

SEQ ID NO: 47697 - DNA, 210 bp, Zea mays
  Clone ID: LIB3066-007-Q1-K1-B5
ctagatcgcgagcgccgccctttttttttttttttttttttttttttttttttttttattggtttttttaatatttttttttatttttataaaattttttatttatttatatttttattatttatttttttatttattataatatattttttaaatttatatattttaaatgtattctataattttcatctattttttcatttacaatat

SEQ ID NO: 47698 - DNA, 296 bp, Zea mays
  Clone ID: LIB3066-007-Q1-K1-B6
tcccactcgtcctcccacgcttccgcccactcttccgattcaccaagcggaacacctcatgtgtctctatttaaaacgaacctctgtatcatcagacctatcattcaatatatctactataactcatatcactttcaatccaattcatatttcataaatcctatccatctctatccatattatacaatccatcatatgctccatgacctattcacctatcctatttatcaagttatagcctttcataccactgatctgtatcatgtccaccatctcaacaccatccttcaattctt

SEQ ID NO: 47699 - DNA, 453 bp, Zea mays
  Clone ID: LIB3066-007-Q1-K1-B7
cggacgcgtgggcggacgcgtgggcggacgcgtgggctccccttcccctgctcctcgaccgcctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcacccgga

SEQ ID NO: 47700 - DNA, 472 bp, Zea mays
  Clone ID: LIB3066-007-Q1-K1-B8
cccacgcgtccgatcacaataagatggcgtgtatagacaatgcaatgagagccttgttgcgggttagcgctcttctgtgtcgtgcatggtgagaaggcaaagtcaaaggacaacgatgcaaaagcgtccgggcccggtgggtccttcgacatcaccaagttgggcacctctggcaatggtaagacggatagcacgaacgctatgcaggaggcgtgggcatcagcgtgcggcggtaccggtaagcagacgatgctcatctgcaaaggcgacttactagtcggaccactcaacttcacaggcccatgcatggtcgacgtgaccatccaggtgaatggcaatctgctggcgaccacggacctaagccagtacaaggatcatggtaattggatcgagattctacacgtggacaaccttgtcatcaccggcaagggaaagctcgtccggcagctgccagccttgtggagcaagaact

SEQ ID NO: 47701 - DNA, 358 bp, Zea mays
  Clone ID: LIB3066-007-Q1-K1-A2
tcgtacggccgacgcgtgcgaactcgacgacgacaatcttcccgaatgcacgccaacacgctatatctatcagcacaacgcgggctgcatgcgaggctgcgggccaactaaactgatccactacactatcctatactagtctacttaactacacttgcaggctgcatcatgatgactccatgtctcactctatccatcccttggtctatacactctaccactgcctggcctatacaagtggcagctattccacacttacacacgcagtcattaatgtatacctacttccctgcatttgcgctgtcagctctatatattaaagatcctactctctactcacacgcgctactcagctaca

SEQ ID NO: 47702 - DNA, 352 bp, Zea mays
  unsure at all n locations
  Clone ID: LIB3066-017-Q1-K1-A4
tagatcgcgagcgccccctttttttttgtttttgagacngaacaaacaaataaaaccataggcaatagcacatcagcggagcgaagcaaagcaaagcaaccagtaaaacaaaattgggtaggcagaagaaccagcaatgtttgagaaccaaaccagccaaaatactggaacagcaatatagtctgctcacgaccaaccaaaccttcgactcataacatcctgaacaagcacttcatctctggcctggttatatgatattgctattgttttgttagaactagcctgcagcttgttcattcaaaagcccactgattctccctgctcaatttatcctctatcctcaactctgaaa

SEQ ID NO: 47703 - DNA, 316 bp, Zea mays
  Clone ID: LIB3066-017-Q1-K1-A5
cggacgcgtgggcgtggatgtgcttgggagtccctgtcgtcttctatgcctccgggagaagtgtcataagaattcgtgagcaaagctatcgcgtgagcatcataaaggcggcaatctacccgggaaacgtgctctcactttacatgacgaagccaccaggcttcaagtacaaaagcgggatgtacatgtttgtaaaatgcccagacgtttcgcctttcgaatggcaccccttctccatcacttcggctcctggagatgactactcgagcgtgcatatccgtacgctaagtgattggacatcagaactcaagaatct

SEQ ID NO: 47704 - DNA, 472 bp, Zea mays
  unsure at all n locations
  Clone ID: LIB3066-017-Q1-K1-A6
cccacgcgtccggcgacgcgctcaagacctacgcgcgccggtggctgccggccgttgccaagagcgggtacctggtgctggagcaaaccgacatcagcacagccgagtggaacagccggcttcttgtcgaaaagatggtgagcttgctccccgccgagaggaacgccgtctcctgcagcttctttctcaagcttctcaaggcagccagcgtcctgggcgcctctcccgcgtccaaggcagagctcacgaggagggtggcgctgcagctggaagacgccagcgtgagcgacctcctgataccgtcgtcgtgcgcgggcgagacgctgtacgacgtggacgccgtgacggccatccttgaagagctggcgctgcggcaagcggcggcggcgggggtcccggaggcaagcccgccgcacgcgcgcggacacaggcggtcgcggtccgncgagagctcggagtacgagggagcgcg

SEQ ID NO: 47705 - DNA, 402 bp, Zea mays
  Clone ID: LIB3066-017-Q1-K1-A7
cccacgcgtccgaaaaggcagggaataagccagtcgatagcgagttctactactagtagctggcctgctgatctgttctgttgtttagttcgcaaagccttctgtttcggcgaccatggatgatgagaggaacacccatcagcaccagggcggtgaggcccatcatgactttttcgatcatgttgacttgaaggatagggggctcctggacagccttctctgcaggaagaagcacgactactaccaggagaagaagaagcatacggattagctggcgaccggcatggataaggtcacggtgtccgagcccgataagcacggtcacaaggtggatgagcacgaagtcttctgccagaagaaagagggccttttttccaaacttttccttaccaatttcagctt

SEQ ID NO: 47706 - DNA, 211 bp, Zea mays
  Clone ID: LIB3066-017-Q1-K1-A8
gcagagcgcgctggaggctgagatgaaggatatctttgtccgctacagaggattcgtcaagcgtaatggggtgggtgtcttcgcggtagtgttgtaagaggcagacgtgtccaaggccattctaggttacatcactgcaaacttgatccagagcattgcgctcgtcctttccagcataaatgcattcaccacgaaattcaagaacgcggac

SEQ ID NO: 47707 - DNA, 405 bp, Zea mays
  unsure at all n locations
  Clone ID: LIB3066-017-Q1-K1-A9
cacattcaagcacctcctcttcccccgccgggcaacaactcagccgccgcaaccgccacatgagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgncgtcgagaccacgacgacg

SEQ ID NO: 47708 - DNA, 341 bp, Zea mays
  Clone ID: LIB3066-017-Q1-K1-B1
gacgccacgcgtccgagcagcgtcatgtgagggccaaagctgtcagcacctacttgtccggctcgccaacactggaatctcctattcgagtttcagcatctctctctgggtcccgtggtggttcaggttcctctgaggagactgtacagttcatgatggtttattcacttctgtcggagtcatacgagagttggctccaaacaccgcctgtgtttctacagaggggcatctaccatgcctacatgcaacatatgcacgggcggtcgaccctcaagctgtcatcggactcgtcatcatcagcagttcgggcagacgaaagttcatcctctgatacaagtgac

SEQ ID NO: 47709 - DNA, 392 bp, Zea mays
  Clone ID: LIB3066-017-Q1-K1-B11
ccattcgtttacctgaagcacaagaatagacgcagccgggcatgggcgaagctaagctcaagaacgtgaccgtcctgctggtggccctcctcctcctgagcagtggcgttcaggacgctgccgccatgccaggcacgttgaactacgacgcgattgtcgccgacgagccaaacggaaagaacaaggacctgtaccgtcccgtcgccaacgccaataaatacacccgcgggtgcgagcccatagaacgctgcaggggcgcgcgctgatcaccaagcatatacatatagcacatcgatttcttattattgcatgcacgtttatataagtgctcattgtcttgctgttgtaagtgccagcacaagcatatatacggcgtttatatatactaaaaa

SEQ ID NO: 47710 - DNA, 340 bp, Zea mays
  Clone ID: LIB3066-017-Q1-K1-B12
gatcccgggtcgacccgcctccgcccacgcgtccctgactctggctgcgcttggtaaaacggacttccgttccatgctagcgcgctatctcatcggcctgcactccaccttcccgaaaaatcttaccctttgtgtttctctgtctgtctggcaatctatcgatctccatgacgacttccccgccgcgcacacacctgctcgccatggcactagcgctggcattcacctgcatgctgctcgtcaggtcctcggacaccaccacactctgctgctccgcttacaggtgcaaccctgccacggacaggacgttcagaccctatagcgtctgtgttgtgctatc

SEQ ID NO: 47711 - DNA, 428 bp, Zea mays
  unsure at all n locations
  Clone ID: LIB3066-017-Q1-K1-B4
cccacgcgtccgtctctctcccgtcgccgggatcccgccggtgacaatggtgaggtggttgtcgccgccgccgccagcggacggcgagatacccttcggacacgacgccgtcgccttgtccttcttcgtggcgtgtgtggccgccaccgtcgcgctcgcgtcgtccatgtgctcggcatgcggtcgcaagccgaaggcggccacccgtgcagacccggccgcttcggaccagtccgncgggacgggctcgggctctgtcttcggcagcggcggaagccaggaggctagcgccgaggaggcggaagaggaagtggtgagactgtcaccggagctggcgacgcacggcgccatcgacccggtgacgctgtcgtcgtcgacatcgaagcggcgcctgtccatcagcgtgagccagaagctgagcatgaaca

SEQ ID NO: 47712 - DNA, 290 bp, Zea mays
  Clone ID: LIB3066-017-Q1-K1-B5
agagatgatcctcgacatgctcatcgcacagactgatccacagagggtgtgcagcgaggtgggtctgtgcgtgttcgatggcgctcgatctgtcatctaggggattgaatctgtcatctggatagaaaacctgtgctcagatgtcatgtgctcagcctgtcatatggctgtcatgcggatagagaaccagctacgcgaaatacaagaccaaggagctcatacttcaatacctaactagctatgtgagcgtctgccgagcccctacagatagtcaacaactagctatcatg

SEQ ID NO: 47713 - DNA, 474 bp, Zea mays
  Clone ID: LIB3066-017-Q1-K1-B6
cgacgaaagctatagccagctagtaacaagagcaaaaacaccatcatctcatccgcgcgtcgcaacgccaccccaatggcccagagcacgaggatggtggcgctggccctggtggtcctcctggtggcggcgacggcgtcggtgcccacggccaccgcgtacggctgctacgacgactgctacgagcggtgcgccaacggcaagaaggacgaccccgcctgcaccaagatgtgcaaccaggcgtgcggcagcaccgacaagggcgccgtcgccggcgcgccggcttgatcgacccgggcttcatcggcgcgcgggctcagctcgatatcagcatcatatacaatcgctgctccgtcgctcacgtcagcccatgcatgatctctcgacccggcccattgaatcttctccttctactatagtatatctttgttgcaggtcttcgttctcatacatcgatccactcatctttttttt

SEQ ID NO: 47714 - DNA, 350 bp, Zea mays
  Clone ID: LIB3066-017-Q1-K1-B7
cccacgcgtccggtcgcgccctccgatgcggatttggctcgcgcggcggcgtcgggctccggttgctcgcgccaacgccaatgtcgtcgtccgatggcggccagtcgcgcaagaggctcgtggtcggcgtcctctctgtgtgcctgctcgtcgccatggttatcgggacggtcatgttcttcgtgagcgagaaggccggctacgactcggagctgaggaagcgcatcatgagcaagacgatgcgcagcgtggaactcttctgcgcgcccgcggactaccaaggcacgtgccacgagacgctggagacggcgctgtcgcggacggacccggccaagcacccgcacgccgcc

SEQ ID NO: 47715 - DNA, 456 bp, Zea mays
  Clone ID: LIB3066-017-Q1-K1-B8
ccctggtgtggagcaagaaccagtgccagcattcttacaattgcaagatcctcccgggtagcttggtgctggatggtgtgacgaacgtccagatccgcggcatcacgctgctcaacagcaagttcttccacctcaacatcttcgagtgcaagaacgtgctgatcgacatagtgacggtcaaggcccccggcgacagccccaacacggacagcatccacatcggcgactccagcaacgtcaccatcagcagcaccaccatcggcgtcggcgacgactgcatctacatcggccccgggagcaagatgatccgcatccatggcgtcaagtgcggcccaggccacggcatcagcgtcggcagcctggggcgctacaaggacgagaaggacgtggaagacgtgcatgtgacggagtgcacgatcggcggcaccacgaacggtctgggcatcaagtcgtacg

SEQ ID NO: 47716 - DNA, 451 bp, Zea mays
  Clone ID: LIB3066-017-Q1-K1-B9
cccacgcgtccgggggagatctcttccagcttgagatgctgctgctgctgctgctgctgctgcggctgccaatgcagctgttccggtctctcaagctaacctgacgactgcctgtactagtaacacattcttgagccagccaaagccaagtgatactccgtcactgcctccgaagggaggtcctccatcagaggaggacggtttggaactgactgttgccccaccctcccaacagaacatgacgaacatgtcttcccagaatgcggtaggcgtgatccaagtcatctaagctaatatattttattttattttatttctctctctctctctctttctctctagaagttactgtggctgttgacagttattgaccgaataaatattaacattgtattagcaatactacatgaataagaagagcatgaggtataaacccatcatttgccaaaaa

SEQ ID NO: 47717 - DNA, 429 bp, Zea mays
  unsure at all n locations
  Clone ID: LIB3066-017-Q1-K1-A12
gcgcagctgagagagagaacagaagggaggagagagggcctcgccggcgaccttcgctccgggcttgatgtgggtgcccagttcctcgctgggcagtgccgagcgtacaccgagaaggtcacgctctcgccggtcaagtctggaggacgagctgctcagaatgcgtcgtcggcattgagagaagtcatgggctcctacacaaatgcaatccgccgtcgtctacgtctcgaccaacggtaggaacaatgccctgccgtgcgccgcatctgccactccgatgtgtgcgaacccctgtctccggccggcgtcgcgctgcctaggcgcatgccccagccattaccacgaagacgcctgccctcacttttgcctgcatgccgncatgcatgtactcaatgaagaagaaatatcatgcgtcttcgtgggattgga

SEQ ID NO: 47718 - DNA, 308 bp, Zea mays
  Clone ID: LIB3066-016-Q1-K1-G3
ctcaacacgacgacgattgaagagctcgtcggccgactacgcgttgcggaggacgccgacgcggacgacgccaaggcgaaggaggtctccacggagggcgtcgggcagctgttgctcactgaggcacagtgggaggcgcggcgtcgggaacggaacaagcagcgcaagccccgtgacggtgacaagaggcgcggcaatggcgatcgcggcaacaacggagacgatgagcacagcgacggcgacgacgatgcgagcagcatggcctcgggttcaagccggagaggctggagccgcaacagggccagtgc

SEQ ID NO: 47719 - DNA, 370 bp, Zea mays
  Clone ID: LIB3066-016-Q1-K1-G4
cgatgcgaaagccttcgggcctggtgggtccttcgacatcaccaagttgggcgcctccggcgatggcaagacagacagcacgaaggctgtgcaggaggcatgggcatcggcgtgcggcggcactgggaagcagacaatcctcatacccaagggcgacttccttgtcggacaactcaactttacaggcccttgcaagggcgacatgaccatccaggtggatggcaatctgctggcgaccacggacctaagccagtacaaggaccatggtaattggatcgagattctacgcgtggataacctggtcatcaccggcaagggaaaccttgacgggcaaggcccagtcgtgtggaacaagaacttctgcaccaag

SEQ ID NO: 47720 - DNA, 470 bp, Zea mays
  unsure at all n locations
  Clone ID: LIB3066-016-Q1-K1-G5
ctgatccacgccagcggtttctgcgagaggagcgctttggtctcagtgatgggttctgacggaaccgggtgcttttggtggcgcagtgttggaacggaggtggaggggccggcggcgaaggggacggcatcgcgacggccaccatcatggtgcttggtgacacctgcacgcgcgggtgtcgattctgcgctgtgaagaccagcaacaaaccgccgccgcctgatcccctggagcctctgaacacggctttggctgttgcaagctgggggtatgatctctagtaatcctgcctggctgatcatctgctgattgtgaactgttaggttctcagaactcgtgattgatcgatgcaattgtaaatntgtaattggtgttaggccctggttgtttccatagtgctaagtttagcacaacacttttttagtaaagttcatatatggaaccaaacattcatactaaaagggcagtgc

SEQ ID NO: 47721 - DNA, 272 bp, Zea mays
  Clone ID: LIB3066-016-Q1-K1-G6
tttatccacgccagcggtttctgctttaggatcgctttggtctcagtgatggcttgggacgtaaccttttgcttttgggggcgcagtgttagaacggacgtggacgatccgtcaaccaatgggacggcatcacgactgccaccatcatggtgcttaatgacaccatgacgctcttgtatcgattctgcgctgtgaagaccagcaacaaaccgtcgtcttactgattctttggaacctatgaacactgctttggctgttgcaagctttgggta

SEQ ID NO: 47722 - DNA, 403 bp, Zea mays
  Clone ID: LIB3066-016-Q1-K1-G7
cgcataggacgaactaccgatgcaagctgcgatcgatcagtcaccgcatctccggttccgcgcaggcatggacgacaagtcctgctacgtggccaccggcctctccctggcggccatcctcctcgtcctccaccgcctcgtggtccgtgctggcggcaaggggaacgccgccgcgcggcggctgcctcctagccctcccgccgtcccgttcctcgggcacctgcacctgctagcatcggagtgccctctccactcgtcgctggcccgactcgcggcgcgccacggccccgtgctctcgctgcgcctgggctcccgggccgtcattggtgtgtccgcgtcggaatgcgccgaggcgtgcttcacggagcacgacttggcgttcgccaaccgtcccagactgacc

SEQ ID NO: 47723 - DNA, 199 bp, Zea mays
  Clone ID: LIB3066-016-Q1-K1-H1
agaagctgaagctgccacgagccctttggggtacttttggagtggtttgctagtaacatttggatacgggctaccaagagtacggcgaactgaacttggagcacaagtatctctgtattaagggttgagctgtgccttttttttgttttgaaaaagctgctgtgagttatgtgttatacaatagctgttgtgagttgtg

SEQ ID NO: 47724 - DNA, 422 bp, Zea mays
  Clone ID: LIB3066-016-Q1-K1-H10
ggacgggcgagacaggctagccagccagatggtagctcctgcggacgaggcgatggctggcgccgacgtcgacgtcgggacggagctccggctcggcctgccgggaggaggcgccgcggcggccaataaggacaccatcgacctcaagctgaagctgtccaccggcggcatggatgaggcggctgccgccgccaggccggagccggcagccgagaatgccaagaggccagccgaggcgccggccgccgatgccgagaagccacctgcacgcaaggcacaggccgtgggctggacacgagttcggtcgtaccgcaggaacgccatgacgaccggtccaggcccggaggagcatgaacgaagaggaacctgatgagcagcaacagctcgtttgacgcaacgccttcgtgaagtcagcatggacg

SEQ ID NO: 47725 - DNA, 291 bp, Zea mays
  Clone ID: LIB3066-016-Q1-K1-H11
taagcccgagaacgtgctgatccgtgccgactttcacgtcacgctaaccgacttctacctatgcgggcttgctcactcatacctgccttcgctcctctgcttaacctaaacggacgaacttctatcaagctccaacctgtactggtactgccgctacctcaaccagctaccgtactcgctctactaccgcatcttctaccgcgcagctcatacactttacattatctagattgtcttcgcactcacctagcttcacgccattgtcctcgattaccgggcacataatgactt

SEQ ID NO: 47726 - DNA, 402 bp, Zea mays
  unsure at all n locations
  Clone ID: LIB3066-016-Q1-K1-H12
ggcgagggcaagggccaggtaaggaagcagtgccgcctggtgaacgggcaggagaaggaggagaggcatcagcagccgcaggaggagcaggaggagcagcagccaccggagctggaggaggaggagcagcagcagccgcatcagtcacagcttccatggttcctgcagaggcagcgcccgcccgttcttcttccatggctccggccccatccacggccgcgtcgaccgttccggaaacatccggtggccgacctggttaacggatttttccgtggttttcactgaaggcgagcactatgctcgggacgtagacctncaaaatatgcaatgctactacagtggtaatggacgtaaaccggtgtatccatgagcttaattaacatgaacaatcctgctttgctt

SEQ ID NO: 47727 - DNA, 381 bp, Zea mays
  Clone ID: LIB3066-016-Q1-K1-H2
gtacgcaactcacaacccgagccgagcaaactcgattcaccatagacctatatctgaaccttgctacagggtacggtcactgaaaaggacgatgagctactacagccagcagccctcagtcggcgtaccgccgcagcaaggctacccggggaaggacggctacccgccagcggggtacccgccggccggctaccccccgccgacgcagggctacccgccgcagggctacccgcagcagggttacccacagcagggctacccgccgcagtacgcgcagccgccttcacagcagcagcagagcagcgggccttacttcatggaaggatgcttggctgccctctgctgctgcttgctactggacccctgcttctgactgaacca

SEQ ID NO: 47728 - DNA, 393 bp, Zea mays
  Clone ID: LIB3066-016-Q1-K1-H4
cccacgcgtccgccggtgccaggcctcgccttctcgcggcggtgctccctccctcttcgtgccccagcgacgcaggcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcagggagcagcagatcgaggtggacagggcgaagcaccggcggaagaagcgcgcggcggcgcacgcgctgtccgcacgcagcagggagcaccggcaccagcagcagctgcagcagcaccaccaccagcagcagcaa

SEQ ID NO: 47729 - DNA, 301 bp, Zea mays
  Clone ID: LIB3066-016-Q1-K1-H5
cgccgaaatccacaaaagggacttccgttccgtgctagcgcgcgatcgcgtcggcctgcacgccaccttcccgaaaaagcttaccctttgtgtttgtgtgtctgtctggcaatcgatcgatctccatgacgacgtccccgccgcgcgcacgcctgctcgccatggcgctggcgctggcattcgcctgcgtgctgctcgtcaggtccgcggacgccgccacgcccggcggctccgcgtacgggtgcaacccggccacggacaggacgtgcaggcccgatggcgtcggtgtggtgctgcccga

SEQ ID NO: 47730 - DNA, 89 bp, Zea mays
  Clone ID: LIB3066-016-Q1-K1-H7
cccacgcgtccgcccacgcgtccgagatgtcgtggcaggcgtacgtggactagcacctgatgtgcgagatcgagggccaccacctctcg

SEQ ID NO: 47731 - DNA, 101 bp, Zea mays
  Clone ID: LIB3066-016-Q1-K1-H8
cccacgcgtccggacacgcatcctgtgtggcctgtgtcctgcaggcagcgcggcgaccgagcgtagcttagctagctgcccctgctccagaccaggtgcgg

SEQ ID NO: 47732 - DNA, 365 bp, Zea mays
  Clone ID: LIB3066-017-Q1-K1-A1
attcccgttcgacggacgcgtgacgctctcaccgacgcttcccggcctacgaccctgcacgctcatacagcccgccttcattcacggggatggctgatgaggtgaggcctgctaccgatctcttttcgcgcactaatcccatctatctaccctccaatggccctctacttctatagcgacgaaatcccatgctcgagcctttcacgcgtggtatccatgagcctcaaatagaatgccgaccagcctttgtactggcttgcgacctccattactgcggctcctggacctgactatagctagcgttcatatccgtacgctaggctagagaacatcagatctgaagattctgggagtgaacgattgtg

SEQ ID NO: 47733 - DNA, 354 bp, Zea mays
  unsure at all n locations
  Clone ID: LIB3066-017-Q1-K1-A10
acgcccacgcgtccgcccacgcgtccgcccaggcgtccggagggatcggattggaactcgatcggggggaaggtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaagaaccacggcggcgcgcagatcaatgacctcatctccagtgctgcgcgcttncacgccaacgtggatgcacgcgcgta

SEQ ID NO: 47734 - DNA, 373 bp, Zea mays
  Clone ID: LIB3066-017-Q1-K1-A11
atcaccgccgagttccgcaccttcatcgagatcgtcttcgagaaccccgagaagagcataggctccctccacgtcgatggctacgccttcttcggcgtcgggatgggccccgggaagtggtcgccggaggtgaggaagacgtacaacctgctggacacggtgagccggcacacgatccaggtgtacccgcggttatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacgccctccgctgcggcaaggtcgtggggc

SEQ ID NO: 47735 - DNA, 390 bp, Zea mays
  Clone ID: LIB3066-016-Q1-K1-G2
ggaagaagaggccaaccgatccagcagcgatggcaggcggtggcatgctggggggcgctttctgggcgacgcggtcgctggaggtggtcaagcggaacgattccccgggcctattgtggaagcgcatcaagctcaccaccacccgcaagaacaacgccaagaagcgcctcaagcggctctggcagaatgaggcggttataagagcttgtggtgcatcagcgtctaacgcggcttccacagctgagaaacaacagtagcttggagcacaactggagcagagttggtcctgtgacctacctatgcttgccttgactttgctgtccacccccagtgttttgattttgctgtcctcggattgaatactttctccatccagaggacaacatcatt

SEQ ID NO: 47736 - DNA, 450 bp, Zea mays
  Clone ID: LIB3066-016-Q1-K1-E8
cggactcgtgggaaaaaaaaaaaaaaaaaaaaaaaaaaaaaaaaaaaaaaaaaaaaaaaaagggaaaaaaaaaaaaaaaaataaaaaaaaaaaaaaaaaaaggatgaacatttttaaagtttccttttttacttactcttatttactaacatattaatttttttttaatgtcccttaatttaaattccttgcccttatttttataactttttttctggaaaatccttgtttttcccctttttattttccttgaaacattttcacttttcgccttttggattatttgctaagagtttttgaccattggcttttgccatcatttgcccatttttattgggtatttgtacgcgctatttatagtttttttaatccctttggttttgctttttacccctatttttaccttttcttttgttagttccttatctccttctctttttattttcttcc

SEQ ID NO: 47737 - DNA, 136 bp, Zea mays
  Clone ID: LIB3066-016-Q1-K1-E9
ccattatatactacatcactctcaaacctattacacatataccataacccatactctttccaaccctcaactcttctctacaacatacatctacacactaactttttccaaatacatcccttcattcttactacat

SEQ ID NO: 47738 - DNA, 401 bp, Zea mays
  Clone ID: LIB3066-016-Q1-K1-F1
ggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacccctgttaacttcaaagtctttcacattaacctgtaccggtgccaggacatgcttatca

SEQ ID NO: 47739 - DNA, 418 bp, Zea mays
  unsure at all n locations
  Clone ID: LIB3066-016-Q1-K1-F10
cacgtacgttgaacaaacacccaaggcctgacgagacgagatccggacctccgtcctccaagtagggcgcgcgcgcgacctcggcaccggcggcctcgatccatcgttctctcggatccccgccagtgcatgccctggaacggacggacggaatggcagcgtcgccggaccacctcttcggcctgcgcaacagcttctacgtcggcgcataccacgccgtcatcaccagcagccagtccctccccgcgcacgcgctctcccccgacgacctcgtcgagcgcgacgccctcatgtaccgctcctacatcgccatcggctcctaccagctgcatcggcgagatcgggcccagcgcggccacgccgctccaggccgtcaagctgctcgccgtgtacctctncggcgacggcgggaacaggg

SEQ ID NO: 47740 - DNA, 68 bp, Zea mays
  Clone ID: LIB3066-016-Q1-K1-F11
cccacgcgtccgcaagccgaaggtacaaatgtaatttaaatatcattgatatttactcatgattagat

SEQ ID NO: 47741 - DNA, 411 bp, Zea mays
  Clone ID: LIB3066-016-Q1-K1-F12
gaggatcatggagctcatcgtatgcaaactaatcaagggcgacatcagggccttggaggacctcgcgtatgccaagagaaaggacttcatctcccagcacaaactccccatcgatgagctgccgatcatctccttccacaccgaagccagcaccgcgcccacagcgctcgcgtcgctgacccgtgtcgcccaagccgagctcctcccatggctacccctgccacggttcttcctgtctgcatccgagtttgtcgagtcaatgctcgcctctctgaaggtccccgtggttgcgcctgtgtctgcagccatggcggtgacagccctccacctgcctgcgctatggggagaggagcgacgggctggtgacacggcgcgacgccgaggtgcctgggtcagtggtagttagacccg

SEQ ID NO: 47742 - DNA, 468 bp, Zea mays
  Clone ID: LIB3066-016-Q1-K1-F2
gccgtgcgcgctgcagcgctgcggctacgcgttgctgccggaggcggcgaggagggacggggaggaggaggtgacggcggcagaggcgaggcgcctgatgcggctcgccaacgtagaggcgctcaagcgacgcctcgggaacggggaggtgatcccctacgcagacctgctgcgcgcgtgccaggactccggcgcggcccggacgcgcgccgaggccgcggcgctcgccgccgcgctcgacgaggccggcgtcgtcctgctcttccgcgacagggtctacctccaccccgacaagattgtggatcttgtaaggaaagctatgccccttgcactgacacctgagaatgatccggggaaggaagagctcaagcagctccaagtgcagttggaagacatcaaccagcttgcacacaagcaagtccggcgcatcctctggtctggtctgggtttcttgatcacccaagtggg

SEQ ID NO: 47743 - DNA, 470 bp, Zea mays
  Clone ID: LIB3066-016-Q1-K1-F3
gacttcctcgcctccatcccatcccgccgccgccgtctctacggtcgctaataagcagccggatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaaggtgggggagagacttggctgcgctgcgctgctctgctgctcccgcgcattcccgatgcgtgggcgtgctctgattgggcacggcggtggcagtggcacacctttgtcttccttttggttggttttttttccttcctctttctacctggatttcatttaacgaaatggtatcgctgatgcaccaggttaatttg

SEQ ID NO: 47744 - DNA, 432 bp, Zea mays
  unsure at all n locations
  Clone ID: LIB3066-016-Q1-K1-F4
cccacgcgtgcgcccacgcgtccgcccacgcgtccgcccacgcgtccgcccacgcgtccgcgcacgcgntccgcgaccgcgtggggggctaaccgaggaaggatttccgccttctgctcgggaagatccggtcggtgcacgcggcggtcgcagcgccgatacgggagtccaacctgatcaccgctgcttgcgacaagtggatgagcggccaggttgataggaagatgccgtaccaagagaggcatgtcgcgcagcaggcgtccattgttggaaacatggaggcatttggcttgctgcaaaaaggctagccatgaggtggttgatggngagaatgcngcggtgagtgctcaggcagttgtggagtttggagctggaagagggtacttgactcangttgctgtggactgttatggggatagaaatgtcttcttg

SEQ ID NO: 47745 - DNA, 443 bp, Zea mays
  Clone ID: LIB3066-016-Q1-K1-F5
agaacaagaagacacaacctgtatctctcaggaatacggtggtgggggacatcggaatgcaagctcgtttattttgagtgtgactgagtttgacaggtggaaagtcggatcttctcgaccaaaaggtgcataaccatctggctttcttcattgctctacaagattaatgaagaaacacatgcagagggaacaaaaccccaaacttgggggtgtgggacatgagaaacatcatagctgcatatcagacaattctcgacacttacgcaacattctgctatcatgccatatcttaccctatggcacttattcataggctgctgtgtgggcacttagttttacaaaatctgctgaaatctaattggagaactctacatgtctcacgtactagcttagacactgaatatattagtccttaaatgcgtctttttacattttatttatgc

SEQ ID NO: 47746 - DNA, 440 bp, Zea mays
  Clone ID: LIB3066-016-Q1-K1-F6
ctgcccaaagtacacgcatgttatatgtcatgaataccgtgatcacctacatctgggggcgagctcgtttattttgagtgtgactgagtttgacaggtggaaagtcggatcttctcgaccaaaaggtgcataaccatctggctttcttcattgctctacaagattaatgaacaaacacatgcatatggaacaaaaccccaaacttggaggtgtgggacatgataaacatcatagctgcatatcagacaattctcgacacttacgcatcattctgctatcatgccatatcttaccctatggcacttattcataggctgctgtgtgggcacttaattttacaaaatcttctgaaatctaattggagaactctacatgtctcacgtactatcttatacactgaatatattaatccttaaatgcgtctttttacattttattta

SEQ ID NO: 47747 - DNA, 461 bp, Zea mays
  unsure at all n locations
  Clone ID: LIB3066-016-Q1-K1-F7
cccacgcgtccggttacagcaataaggaatttgtctcttcttccacctccagcctcataagcctgcggttaggggggcataaccccaaccggagaggacggccgacggctacgagctacgtagccgtggtccggcgagtcggggattccaggtccttgacaatgacccactggaaaaggcaaatgcatccattaggagcagaactctcatgaacaagcttgttctgcctttacttttggttgaacttgtgataaccaacccaaactgccaaaaaatctggtgttgctacatttgtatcaatctttacctgagcttgtgtttttgtaagcttatgcatgtacctncacatgtatagatatgctacctacattttctttctgtggtcatatgatatgttgacaaggtcacagatatactctcagtatatgatgacgcttctatgaaaaaaaaaaaaaanaaaa

SEQ ID NO: 47748 - DNA, 436 bp, Zea mays
  Clone ID: LIB3066-016-Q1-K1-F8
cccacgcgtccgcgcccggggagaaggagggctccgccgctcccggggaagagcgcgccattgccgccgccgcgctgactggggaagatggttgtccaggagttcacagttgatctcaacaagccccttgttttccaggttggccatcttgaggaacggtaccaggaatgggttcaccaaccgatcgtcagcaaggagggtccacgctttttcggaaatgatgtcctggagttcttgactcgcacgaagtggtgggctgtgccaactatatggctgcctgttgtctgctgcctgctcgtgaaatctattctgatgggtcatactgttcaggacgtagctatgatggctctgtttgggatatttatttggacgctgatcgaatacactttgcaccgcttcctgttccacatcgagaccaagacctactggtggaaca

SEQ ID NO: 47749 - DNA, 376 bp, Zea mays
  Clone ID: LIB3066-016-Q1-K1-F9
gccacgcgtccggccacgcgtccgctcgtattctagcaccacagcaaacaggatcgaaggagaagaaactaatagttaccgtccaggtggtcgatcgaacgaagctcctgctgcataccggccgtgcgcacatgaccatgacacggacgatgtgcctagacctgctccttctactactggcggacgcgtctacagccacggtgcatttgactattcaccgatgtggatgactacctctccaagcgcacgcagtactaccgccacaagaacaacgatctcgcggccatatatgaccttaactccaaagcgcaacgcttccacatccactgacatgcacgctcctatggccctatatacgacctgcatgacgaggcaa

SEQ ID NO: 47750 - DNA, 264 bp, Zea mays
  Clone ID: LIB3066-016-Q1-K1-G1
gcaaaccgagaggtgaaccagcagcctccaataaaagccagcacatccaaataaaaccgagagaccggagccctcaggcaagccgaccgccgacgtaccaccgcgccaacccgagagaaagatggagatgatcaagaggatcctcatcgacgcgctcctcgtagtcgacgtgtcggccaccgcagtgcttgcctgcaccgaggacgacgtcgacagcgccgcagccggatccgagtaatcctcgtacaacagatttagccgttg

SEQ ID NO: 47751 - DNA, 52 bp, Zea mays
  Clone ID: LIB3066-016-Q1-K1-G12
aaaaaaggaaaaaaaaaaaaaaaaaaaaaatattaaaaaaaaagaaaaaaaa

SEQ ID NO: 47752 - DNA, 448 bp, Zea mays
  unsure at all n locations
  Clone ID: LIB3066-016-Q1-K1-E6
cccacgcgtccgcccacgcgtccgatcgatcacgacaagatggcgtgcacaaacaatgcggggagagccttgttcctcctggtcctcttctgcatcgtgcatggtgagaaggaagagtcaaagggcatcgatgcgaaagcgtccaggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggntaatggatcgagattctacgtgtggataacctggtcatcaccggcaagggaa

SEQ ID NO: 47753 - DNA, 454 bp, Zea mays
  unsure at all n locations
  Clone ID: LIB3066-001-Q1-K1-H6
aaaatggcaaaggctctcctaggtggcctatcggcgatcctcgtcgtggcggtggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaggactgcaagaagctcctggaggacgccgncgacgacctgaggggcatgctcgagatggccggcggcgacatcaaggtgctgttcagccggtccgacg

SEQ ID NO: 47754 - DNA, 459 bp, Zea mays
  Clone ID: LIB3066-001-Q1-K1-H7
tctagtgctcttcataccatcagaactatgcaggctatgcttttgtctactttgaggatgaacgtgatggcaatgatgccatacgggctcttgatggttatccatttggccctggcagacgcaggctttcagtagagtggtcacggggtgatcaagctggtagacgtgatggcaacaaaccagaagcaaatactaagccaacaaggacactgtttgtcattaactttgatccaatgaacacaagagtcagtgacatcgaaaggcacttcacaccatttgggaacatatcaagtgttcggataaggaagaactttgcttttgttcagtttgaaactatggaagaagccagaaaggctcttgaagctactcatgctaccacccttttggacagggtgatttctgttgagtacgccttcagggatgatagtgaagtgagtgataggtacggcagcccaagaa

SEQ ID NO: 47755 - DNA, 52 bp, Zea mays
  Clone ID: LIB3066-001-Q1-K1-H8
cggacgcgtgggcggacgcgtgggcggagcgtgggctagttctagatcgcga

SEQ ID NO: 47756 - DNA, 423 bp, Zea mays
  Clone ID: LIB3066-001-Q1-K1-H9
cccacgcgtccgaaagcaaaaattttcttcagtgctgcagttgaagcctgggatgcagaattttatgtcaaagttgaagataacattaatcttgacttagctgggttaattgagatgctcgaaggccgtcgaggtagccaaggattgtacatgggttgtatgaaatcagggatggtcataagtgaagagggccaacaatggtatgaacctgagtggtggaaatttggagattcaaaaacgtattttcgacacgcttctggttctttgtttatcctctcaaaaaatttggctcgctacatcaacataaatagtgcgtcactgcagagttatgcacacgatgatatatcagtaggttcatggatgatgggactgaatgcaacttacgtggatgatgaccggttgtgctgcagcagttccagacaa

SEQ ID NO: 47757 - DNA, 353 bp, Zea mays
  Clone ID: LIB3066-002-Q1-K1-A1
cccacgcgtccggcatctgcaaattcggcgccaactgtaaatttgatcatcctacaatggctgctccaatgggagtttatgcatatggtttctctgggtctgcttctgtcgcacccgcttcaactaatgcacctatgacgcgacatcttcttggatttccatcaggttctggatatatgtcttaggtgtctttttttcagttgacctactttgatgtataaaatccacggcatcgcctcaggcgctgtgaatgtttctcctaacttcccgccgggatgaagttctgtaaattgagttgctgccggagatgtacagccccccttccccaattaatccagaactttgggaataac

SEQ ID NO: 47758 - DNA, 416 bp, Zea mays
  Clone ID: LIB3066-002-Q1-K1-A10
cggacgcgtgggcggacgcgtgggctggaccccggcgaggccaaggttgatgaggacgtcactatgactacgactacaccagcagcacctccacatcaagcgccacttccttcattagctgggccaatcactcgggcccgtgccagagatcttaacttcgtcatgctactgaagaatgagggcccagaagaatagacgaccaacccaactgcggcccatagtggacgacctagggatggccgcccctaggggttgcgccccctctctatttatcaaggagctacgcctcatttgttcttggagttttgttttacgttagctttagctactctcgaacacgcgcaaatcagcgttgtcttcgtgtattcagaactccaccctcgagtaatagattagattgatcgcatcttgttctt

SEQ ID NO: 47759 - DNA, 99 bp, Zea mays
  Clone ID: LIB3066-002-Q1-K1-A11
cagacgcatcaggacctctgggtctacgtaccagggatgcttgagcagattcgaggacgtttttgtcttttgaaaggcaatactggttcttagggaccc

SEQ ID NO: 47760 - DNA, 324 bp, Zea mays
  Clone ID: LIB3066-002-Q1-K1-A2
ctccgacggccgcctcgtcgtcgatttcatcgcgcaggagttgggcctcccgctgccgccgccgtccaaggccaagaacgccagcttcgcgcagggcgccaacttcgccatcaccggcgccaccgcgctcgacaccgacttcttccggaagcgagggctcggcagcaccgtgtggaactccggctccctccgcacgcaaatccagtggctgcgagacctcaagccatcgctctgcagctccgcgcaaggcacacgatgcaaggagttcttcgccgagtgcctgttcgtcgtaggcgaattcggtgggaacgactacaacgcccc

SEQ ID NO: 47761 - DNA, 371 bp, Zea mays
  Clone ID: LIB3066-002-Q1-K1-A3
acggactggttatagatcgtaggacatacacctttcacacttagaccctgcgtatgaactgtattcgcgcagagacaacttgcttatcaggaagatcacggagctacaatagactgcatcatgggccgaccccatgctgctgatgctcagaaagcatattaatgaactgtacaagcacaaaaagggctacccttacaacctgatcatcgcatgactgcaatgtaacgagacctgcggaaacaggcttgctagagcctttaataaggctcctgaccggacttttttccattaaactggtgccaacagctcttacaacactgtcgttccttgtggacgtacttgtacatgaaactgcgatgatagccaacctt

SEQ ID NO: 47762 - DNA, 414 bp, Zea mays
  Clone ID: LIB3066-002-Q1-K1-A4
ttcttgtttgggggtttgccatcagactctagtgcagcagaaactacagttgctcttgcgaagactgtttcatcttgtgtgcatcacatggaacttggtgctcttagtgcctgccttgctgctgttgtttgttcgtctgaacagccacctctgcgccctcttggtagctctgctggtgatggggcttctcttgttattaaatcagtactggaccgagcaactgagttactgactgatcgccatgctgcagccagctacactgtgccaaaccgtgctctctggcaggcatcatttgatgctttctttgggcttctaacaaaatactgtgtcagtaagtttgaaagtatccaacagatgtttgtcacacagacaccgagctcaggaatcggacctgaggcttccaaagctactagt

SEQ ID NO: 47763 - DNA, 118 bp, Zea mays
  Clone ID: LIB3066-002-Q1-K1-A5
aaaaaaaaacaaaaaaaaaaaataaaaaaaaaaaaaaaacataaaaaaaaaacggaatggaaaaaaaagaaaagaggcatatcaaaaaggcttaccaatttaaaagggccctcctttt

SEQ ID NO: 47764 - DNA, 190 bp, Zea mays
  Clone ID: LIB3066-002-Q1-K1-A6
caaggaccttcggcgcccgttcaggatccacatcttcccgagcgagttcttggttgagctcttcctcttcggaccacctccaaggctcttggtgtagcttgccactctcaccaatcaagttttcatgtctgatctcgacattcagatcccaactgccttcgatcccttcgctgaggccaatgctggggac

SEQ ID NO: 47765 - DNA, 54 bp, Zea mays
  Clone ID: LIB3066-002-Q1-K1-A7
agccttccgcgacacccttggggcccggcttaaacgacaagattcgccattgcg

SEQ ID NO: 47766 - DNA, 423 bp, Zea mays
  unsure at all n locations
  Clone ID: LIB3066-002-Q1-K1-A8
gaggtgttgcccaggaatacagcttggaagccggcaaaaatttgtgattttggtgcttctactgtcatttgttgttatgcttgcctttgccatcctcatatgggttggtagaggagacaatcctatcgattcttctctactgaaaagggtttatttggatgtattttcagtagtagttattgtacttggtggtgctctggcatgttacggtgcagtgttattctcgaagatgagcaaagttcgttctgaaactgtatcaactgagaagtggaaggttgccagtttagctgctgtctcgctgatctgtttctcgtcttctgctatacttgcacttgtgactaatgttccagtgcttttgtattggtattcaacagatgtggacatcatcaacaatgctgntattatgtttatatattacttcat

SEQ ID NO: 47767 - DNA, 408 bp, Zea mays
  Clone ID: LIB3066-002-Q1-K1-A9
tcgcccacgcgtccgcggacgcgtgggcagaggattgctgcctaatggcatagagattgctgtaaaacaatgaaactggaaaccggcaatggaaagcgtgagttccaggctgaggttgagattatcagccgagtacatcacaaacatcttgtgtctttggttggctattgcatttctggaggcaagaggttgcttgtctatgagttcgtccccaacaacacattggaattccacttacatgggaacgatcgaccaacaatggagtggcccactagattaaagatcgctctgggtgctgccaagggtttagcttatcttcatgaagactgccatccaaagatcatccaccgcgacattaacgcatctaacattcttcttgacttcaaatttgaagctatggttgctgac

SEQ ID NO: 47768 - DNA, 410 bp, Zea mays
  Clone ID: LIB3066-002-Q1-K1-B10
agatcaccggccgtcgagcgagcagtctcccaattccacccaataactaataacatgggctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgtcgccgccgtgcccgccgccggggcgctcgtcgcctccttcctcgcctactacctccactgagcgacgacgcgcggtgcggcaacgttgggatgcatcgtgtttggttcatccgattaattaattgttttttttatttac

SEQ ID NO: 47769 - DNA, 416 bp, Zea mays
  Clone ID: LIB3066-002-Q1-K1-B11
cggacgcgtgggcagaaaccggcgtcggcgatagtgtcaaagctggagcagatcgctggagacagagcgcttcatggtgaagaaacaggacggtctggtgaagctgcaggggtccaagcaagggaggaaggggctgctcgcgatcgacgccgagatcttcgaggtgactccggcctttcacgtcatctaggtgaagaagtcggcaggcgacacgctggagtatgagatgttctgcagcatgggcctaagaccttcactcagcgacatctgctggagcatccgatctgaggagaacatggctccttcagtggttcagccatcacaattggagccattctattagaccgtctacgacagttgactcacccctcttagtcgattgatattcaagtgcagtctcttcggagatgcaatta

SEQ ID NO: 47770 - DNA, 394 bp, Zea mays
  Clone ID: LIB3066-002-Q1-K1-B2
tcacaacaagatggcatgtatagacaatgcaatgagagccttgttccttctagcgctcttctgcaccgtgcatggtgagaaggcaaagtcaaaggacaacgattcaaaagcgtccgggcccggtgggtccttcgacatcaccaagttgggcgcctctggcaatggcaagacggatagcacgaaggctgtgcaggaggcgtgggcatcggcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggac

SEQ ID NO: 47771 - DNA, 78 bp, Zea mays
  Clone ID: LIB3066-002-Q1-K1-B3
cccacgcgtgcgcccacgcgtccgcccacgcgtccgcatagactccctccacgtcgatggctacgccttcttcggcgt

SEQ ID NO: 47772 - DNA, 414 bp, Zea mays
  Clone ID: LIB3066-002-Q1-K1-B4
cggacgcgtgggcggacgcgtgggtcaacgtcaagtcctaggagacgacatcaggcactctgtggcggatctttaattaatttcttctttatttttcattctggtgaataaataggtcccaaagagagagataaaaggagaaggaaaggagacgtggcagcatggccacgttagtgattttttgttcggtgatttttttttgtaagctatatatagatagagagtagtcatttttaagttattaattatatagttgcaaatgcgcacgttaatggtatgctgggacgccgacgccgaattgtcgacggtcatggtttgaacagcagcggctttcaaagatagaatttctccatgtatgtatgtatgatccgaaagttgggtggcagtttcagtgaatggacagtgatatttttt

SEQ ID NO: 47773 - DNA, 369 bp, Zea mays
  Clone ID: LIB3066-001-Q1-K1-G10
gcagttgtgggaaatatcagcagcaaaaacattcaggagccaaaaggaaaagcagctctcatatggatgttgggagaatattcacaggacatgcatgatgctccatacatccgtctaaagtcttgagtgaaactgatatgaaaagcactttactgaggttcgcttgcatctgctgactcagagatgaaatgtgtctttaaaagaccctcagagacacataatgcactaggctatacattatcagttggtctatctgacacccatcaagatgttcatgacagagacactatgtactataggctgactcaatacagccctaatgtagcagatcatgtatataacgctctgaaacaagctggctctttattt

SEQ ID NO: 47774 - DNA, 423 bp, Zea mays
  Clone ID: LIB3066-001-Q1-K1-G11
cgaggcgcgagaaccgacttgccaccggctgctcgccgtctctctctctccctcggggcgcgcgcgcgcgggagacaggccaaccgatcgccaggccggcagccatgggcaagcacggcaagtgcagccacgacgtggaggcgtgctacccgccgggggcagcgggcggcggcaagtacccgtacatgacggagaacccgcagctgcggtgggccttcatccgcaaggtgtacgtgatcgtgtgcctgcagctgctgctgacggtggccgtcgccgcgacggtgaacctggtgcgcgccatcggggacttcttcctctcccgcaccatgggcgccatgttcgccatcatcggcgtcatcatcgcccccatcctcgtgatgatcccgatgatcatttaccggaagcggcacccggtgaacctcg

SEQ ID NO: 47775 - DNA, 395 bp, Zea mays
  unsure at all n locations
  Clone ID: LIB3066-001-Q1-K1-G12
cccacgcgtacgcccacgcgtccgcccacgcgtccgaagatgctaagttggctccgacgcttccctaacgatgtgatccataggaaggggggcagctcgggccggaggacctgctcctccacctcctggaggaacaagagcagcagcagcttcaccgcgcggatcatccgttgtgcgtcctccgtcgttgacacacaccaccagcaccgtggtgatgatgatgacgacgatggcgatgaagacgacgagtacgacgactgtcgtctaccgtcgtcgcctcctaacaacaacgctagaagaaacaccaccaccactgctgtcatctcggcccgagccttctccttccgcgagctagccgatgccgcaggaaacttccgncaggacaacctcatcgg

SEQ ID NO: 47776 - DNA, 459 bp, Zea mays
  Clone ID: LIB3066-001-Q1-K1-G2
cccacgcgtccgttctctttcactaaaggatagatgtggcctcacgaccagatgaagcggccgtgatgaagactatgcccgtcggagatcaagcgaagccactacgtccccggctcgctgatgaagactcttcggtcttcccctcagagatcaagagaagccactaggtgaactgtgctgagaagcaaagtcaaacaagaaataaggagaaactggctcattcacaagacatggagttctgtctatgaagactgtgtagacactacacagaaccatatagcatgaaatggaaagcaaataactgaaccacctttaaatggaaaaactattataatcaaactagtcaagggtgttttagactttgggtatgccattatgaaggtgacgacctctataaatatcccctaaatatattgctcatagatattgaatcaatacccaatagagcttattcttgca

SEQ ID NO: 47777 - DNA, 463 bp, Zea mays
  unsure at all n locations
  Clone ID: LIB3066-001-Q1-K1-G4
tgcaaatccatttcttgccttgccggcacagctctgcatagctcctcccaagctttaggattaggatttggatttggatttggatttggatcgggtgtgtttcctgcgtaaccatgagcgagatcatgaagctaaagcgtgggatcagcaccaaaccaggagaccacctcgtccaaaatggccaacaacatccatgtcacgaatgggaggagcaacagcgctactggccctcgccgcgggcgccgccggcgagcccgacggagtcgcccaggaccccaggcgggagccagaagaaggcggttctgggcaaggtgaagagcaaggccaagaaatggatgcacatgctgcatcacangaagaaacccgcgccaccggaggagatgatgtggacccccagggccgggcctggacccagcgcggcacangacagcatgcccagcagggaggagcgacacgccgtcga

SEQ ID NO: 47778 - DNA, 460 bp, Zea mays
  unsure at all n locations
  Clone ID: LIB3066-001-Q1-K1-G5
aacgtgctgatcgacaaagtgacggtcaaggcccccggcgacagccccaacacggacggcatccacatcggcgactccagcaacgtgaccatcagcagcaccaccatcggcgtcggcgacgactgcatctccatcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtcaagtccggcgcctncaaggtggccgtcaacgacgtcgtct

SEQ ID NO: 47779 - DNA, 461 bp, Zea mays
  Clone ID: LIB3066-001-Q1-K1-G6
cccacgcgtccgcccacgcgtccgcccacgcgtccggtggctgagccccagggtctgacgccgccggcgcgttgcggtgctggccgtaggacgcgagcggctttttgatcatctgctgagcgcggaggacctgcaggccgaggacgcctcgcctccggacggtgggtgatgacgcggtctggtctggtaggctgcggaccgagggagagcgggtgtgccttctcgcccccttggtgtgctgaactgctgatacgatacgaggagcaggacaggagtacggagaactactactacctacggctatgggcgatggctttactcgcgcctcccggtgtgtcccgagattttttttcggggacacgtacgaattatgtaacggagttcgtttcgccgtgccacacgcacgagcggtgtccgatacacctatagaaaacgactttccatattgcgagttgtgtgat

SEQ ID NO: 47780 - DNA, 453 bp, Zea mays
  Clone ID: LIB3066-001-Q1-K1-G7
cccacgcgtccggcaacggcaagaagaccgggtacgcggtgcggaggcaggccacggacgacgacctcgctgtgatggagacgctgcgggcggtctccatgggcgccggcgtgctccccgggagggccgccccttcgtcggcgcccgaggcggctgcggctgcggcagcggacgacgaggtgccctacatgcgcggctgcttcgaccacttcgtcgggtcccgggactcggagtcgctgtacatgatcgcgccgcagggcggcggcacgggcccggagctggccgtcttcttcgtcaggctctgacctccgatccgatccgccccgcgccttgcctctagctatctcctcgcccccatgcatgcgaagacggcccaaccgcccaagggcatccattaaccgccacgacgccacgtacataaacatcgtcagcattcattggatggtgcaacct

SEQ ID NO: 47781 - DNA, 399 bp, Zea mays
  Clone ID: LIB3066-001-Q1-K1-G9
attcactaacccaagacaaaacatggatgtgaatgtgagaaccatgtggtcgtcgatgcgggcacaggttgcgatggctgtggtgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacgga

SEQ ID NO: 47782 - DNA, 205 bp, Zea mays
  Clone ID: LIB3066-001-Q1-K1-H1
cgacaagctagcgaagaactgttgaagctgtatcccggtggataggggacctccgcgaccgttaccctgagtcgagttgtcacagtctgtatctatcgctcctgaaacctgaggggcctgtattgtttgtcaagcactttgtttcttctcttctgtttgtagcctactatatccactgaaatctaaggggcctgtattgtttgtc

SEQ ID NO: 47783 - DNA, 350 bp, Zea mays
  Clone ID: LIB3066-001-Q1-K1-H11
agctcgagccagcccgcccgcctgcgcgcatctctatacactactactgcttgatagtctcgtagagagatcccgcgcggcccaataaaaacccgactcgctagctacgctacacactcgcagatggccggcctcaggatgaagttcgtcgccgtcgacgtcatggccgccgcgctcgtggcgtccgccgcagccgccgaggcccacgccccggcccccgacttcgacgccgcggacgtcgggccccttgccgcggccctactcgtcgtcggcgtcttcagctacctcttctgctagaaccgcgctggacgcgtggtttgtgcttgatttgtgattcgactggcgcgagt

SEQ ID NO: 47784 - DNA, 209 bp, Zea mays
  Clone ID: LIB3066-001-Q1-K1-H12
cgtccgagcacgcgttagctgacgcgtttgctctcacatctatacactcgtactgaggcataggctcatatatagagcctgagcggtcaaataaaaacccgattctatagcaactctacacactcgaacatggccggtctaaggattaacaacgaaatcgtcatcgtaataggcaactaactactaatataaatgggatgcatttaaat

SEQ ID NO: 47785 - DNA, 460 bp, Zea mays
  Clone ID: LIB3066-001-Q1-K1-H2
cccacgcgtccgattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcaggtttcagctgtctcaaggttgaaacatgagaatgttgtccaactcgtcggatactgcgccgaagggagcacccgcgttcttgcttatgagtatgcaactaggggatcattgcatgatatcctccatggtaaaaagggtgtcaaaggagcccagccagggccagtcctgtcatggatgcagcgagctaggattgccgtatgtgctgctcgaggtctcgagtttctccacgagaaggccgatcctcgagtggtccaccgagacatcaagtcaagcaacatactgctctttgaccatgatgttgcga

SEQ ID NO: 47786 - DNA, 374 bp, Zea mays
  unsure at all n locations
  Clone ID: LIB3066-001-Q1-K1-H4
cccacgcgtccgctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaaggggagcaacatcgccatccagctggatggcaacctgctgggatcaaacgacctggacaagtacacggcgagctggatcgaattgtctcacgttaacaacatcgggatcaccggctcgggcacgctggacggccaggggaccgncgtttatagcaggagcaagaccgacaacgtgaaggcgatgcccaacacactggttgctgttcacgtgat

SEQ ID NO: 47787 - DNA, 340 bp, Zea mays
  Clone ID: LIB3066-001-Q1-K1-F9
caaataaaggcacatctcttgcctcctctttcgcgctgtccggagaggaggggcaggaggaggccgcaccaaatctatctggggatcggagcgcgggcgacaagatgccacgcggcggcaagcccgcggcttcgtcgaagccgaacccgttcgactcggactcggactcggagtccagcaataagccggcgaacaagtccggggcgtcgtcgtaccaggcccccgccgacgccaagaagcggtacaaggacgggttccgggactcgggcgggctggagaaccagtcggtgcaagagctggagcactacgcggcgtacaaggccgaagagaccacggacgc

SEQ ID NO: 47788 - DNA, 257 bp, Zea mays
  Clone ID: LIB3066-001-Q1-K1-E4
cgcggagttaccggtgatctcgtacgatcccagccgtatacctcgttccattcaaaggcgcccctggcctaggtgactaccagaagcgatccatacttcattctcgacaacgtcaactagcgacacgtctgatctgaattacagacacacagaccattcaattttcccccaccgcgaacgctgcgtctgcaaagcacttcaactacaacgaacacatgtgtcttcgatcgaactactataagactagaacagcgccg

SEQ ID NO: 47789 - DNA, 461 bp, Zea mays
  unsure at all n locations
  Clone ID: LIB3066-001-Q1-K1-E6
cccacgcgtccgcaaagatagcatagcagcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctnctctaatttctcgaccccgtcgaatntttttcctttctattcttctactatactactactatct

SEQ ID NO: 47790 - DNA, 464 bp, Zea mays
  Clone ID: LIB3066-001-Q1-K1-E7
gagccacgcgtcacgcgtgcggcatgcatattaagaggaagaagaagaagatggtccttaaggagcacgctctaggagaagctatcgctcctcagggacagctgccacacgtgcggaccgaggactgcaccggcactcgcttagacgcatgctcagcaataggaggtagtgcacaggccaaacgactgcttggccacagatgtgagatctatatagcacgtaaatactcgacgacctggatgacatccaagcctacacgtagaccttgtcccttcatcatgacacagagtcggtttctggcggtgcattatacgggagcattgctaaggagctcgggaacctagtcagtctcatgatgctcgttgagatggactatgtagtgtcatgacctatgcgatgagacatatacatttacgcaagacgtgtgctcaatttaactgacgtgcatgtacatatcagatcta

SEQ ID NO: 47791 - DNA, 459 bp, Zea mays
  unsure at all n locations
  Clone ID: LIB3066-001-Q1-K1-E8
atccatcgcagctggattgacgaagtctgtgacgccgaacgatctccctacttcctccttgtcagggttgagatcaacgccgatgatcttggatgcgccacacattttcgcgccttggaccaccgcagctggacaagcgttccgtcgtagaggtgatcgttgagatgaccggcggcggcgtggactacagcttcgagtgcatcggcgtgccgtcggtgatgaccgacgccttcagatgcaccaagatggggaagggcaagacgatcgtgctggggctggggagggacagcgacgaggtgtgcctgccgtcgctggagctgctgttcgggaggtgcgtcatggggtcgctcttcggcgggctgaagcccaagacccacattcncgtcctcgccaagaaatgcatggacaaggagctgcagctggacgcgctggtcacgcatgagctgggactgcangaca

SEQ ID NO: 47792 - DNA, 414 bp, Zea mays
  Clone ID: LIB3066-001-Q1-K1-E9
cccacgcgtccgcccacgcgtccgcggacgcgtgggcttcccctaggccaccacgcactccgcctacaacgactcctcttccacgtccatggttgggggcaccttctcctgcccgtgttcctcgtcctccacggctcggagcaccccctcgtactcctgttcttccgtctcctcgagtaggtgctccatctcccgcacctcctcctgttcgtcctccacagttgggagctccccttcctacccctgttgctcctactcctcagttggaggatccctctagaggtcctattcttcctcgaccgcctctcaagggtgttccaccttctactcctccacttgtggcaccacggttaggggcacccctcccatcccctcctgttccttcagctcggaaaggcacttcaacttcttcaa

SEQ ID NO: 47793 - DNA, 463 bp, Zea mays
  Clone ID: LIB3066-001-Q1-K1-F1
caatgtttcatgcatcatcataacccatttgaaatttgcttatttttttaccaagctaatttatgttattactacttgaccatacctgtccgtatgttgtttcaggaatttacagagaattacttagcagggccttcgccatcgttccttgttccttggagaattgactgctttgcaacagatgtgagatagatttaaaacttaaattactccatgatctggataacatcgaaacctaaacctaattcttctcccttcatcaacacacaaggtcggtttctggcaatgcattatcaggaagtattgctaaggagctggggaaccttgtcaatctcataatcctgtaagaaatggactatgtagtgtcatgacctatctgataagaaatatagatttacaaaaaacgtgtcctcaatttaactcacgtgcatgtacatatcacaactattcaggtgtgtaatca

SEQ ID NO: 47794 - DNA, 215 bp, Zea mays
  Clone ID: LIB3066-001-Q1-K1-F10
cacacacagcacatacgctgtctcctattccacgctgaccggagaggaggggcaggaggaggccgtaccaggtctatctggcgatcggagcgcggacgacaagatgccactcggcggcaagcccgcggcttcgtcgaagccgaacccgttcgactcggactcggactcggagtccagcaataagccggcgaacaagtccggggcgtcatcatacc

SEQ ID NO: 47795 - DNA, 385 bp, Zea mays
  Clone ID: LIB3066-001-Q1-K1-F11
cccacgcgtccggcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtg

SEQ ID NO: 47796 - DNA, 422 bp, Zea mays
  Clone ID: LIB3066-001-Q1-K1-F12
cccacgcgtccgcggacgcgtgggctaaatagaagctatactgatggcccagaacatgatgattgtggcggttctcctccttgccacctttcttgtgctggcaagatcgttgtgggttccagaagaaccctcaaatgccgatgacataagaggtgcttgcatataggagtgcaccaaagaaaatacggctcctggcgacaagaatacatgcgaagtgttgcgcaccaagctcacaaaaaagcctagcgaagaaggcacacatgattgatgaagtaccactgcgataatatataccctagtgtgatcaatggtcatctttgtagccatgtctgccacacgatggactcgactatattgtctgatcgttcagatgatggtgtacactagcatgctaattccttgctcatataacctaatttcac

SEQ ID NO: 47797 - DNA, 457 bp, Zea mays
  Clone ID: LIB3066-001-Q1-K1-F2
gaccaacgttgcatctagcctcacgtctcgagaagttaagaggggttgtcctccacagcggcatactctctggcatacgggttctgtatccagtgaaagtgacgctttggttcgacatcttcaagaacatcgacaaaataaagcaggtggactgccctgtgttagtcatacatggcacagccgacgacatcgtggacttggctcacggcaagcggctgtgggagctagccaaggacaagtatgagccgctgtggatcaaaggcggtgggcactgcaacctgcagacgtacccggagtacatcaggcacacgcgcaagttcataagcgccatggagaagctggccaaggacagcagcaaggcggcccaggcgccgccgccgtcgagcatggccgccgaagaaagacacaccaagtgcttgagattcgggaagagatgagatgccggcgacctggacct

SEQ ID NO: 47798 - DNA, 463 bp, Zea mays
  unsure at all n locations
  Clone ID: LIB3066-001-Q1-K1-F3
cccacgcgtccgcccacgcgtccgcccacgcgtccggttccgttgcgcccgctaacgatcacgcgtttccggtgggagagagagtaggtagggagaggacgggacaggatgctcgggttcaggcagatgtcgtggtcgtcggcggaggcgcaggcgccgtcggagcagctgtgcgaaggggtggcggccgtcgtggcggcgcgccaggggatggagacgccgctgacggcggtggccgaggcgttcgaggagctggtgcgcgggatggacgccgacggcggcgagctccgcgtcgcgcccttcagcgacacctgtgccctcgtctccgtgctcttcagcagcctcgggatggccttcaggttcgccgagatggagtacgtcaccaaagtgaacgatctcatcggtgccggcaagtcgtaccgtacgctgagcgacatnctcgacaaggacatccagaacgact

SEQ ID NO: 47799 - DNA, 459 bp, Zea mays
  unsure at all n locations
  Clone ID: LIB3066-001-Q1-K1-F4
cccacgcgtccgggggatgttcccacgatcacctcggccgcaagcaacgaggaggaggcgttgttcagtgtcggagaatccaccaaggacgatggccatcgcttgacgatggaatgctccactcccgtctcctccagtagcccttccactcgcaagaagcgcggggcgttcagcctcttcagggcgatgttcctgtccttcggccggagcgacgacagcatgaagaagacagacgacgacaccacgagccccaagaagagagccatcgcggctgctgatgacgattgcaagcctgccggtgacgagtcaacgtcgtggaagcgcctcgtggacggtatgcgcccgctccgcctccgcgggcagctggagtactacccgccgncaccgncgtcaccgtcgcttggccacgccgatgtgtaccatgacgtgantcctccggcgccgtcgcaggcacggttc

SEQ ID NO: 47800 - DNA, 405 bp, Zea mays
  Clone ID: LIB3066-001-Q1-K1-F5
aggtaattgcaaatagggcatctgagatccttggacacaagcgcggtgagaagtttgtgcacccaaatgaccatgtgaataggtcacaatcttcaaatgatacatttcccactgtaatgcatatagcgacggccgttgagatacattcgaggtttatcccaagtttgcaacagttgcatgattcacttcattcgaaaactattgagtttaaagacataattaaaattggacgtacacatacccaagatgccaccccattgactcttggccaagaattcagtggctacactacacaggtcaaatatggaattgaccgcattaattgtacattacctcggatgtaccagcttgcttaaggtggaactgcagttggaactggcttgaacacctataaaggattttatg

SEQ ID NO: 47801 - DNA, 447 bp, Zea mays
  Clone ID: LIB3066-001-Q1-K1-F7
cgcgcgacagggtccagtcgagggccggggaatcgccggagaatggaggtgggcagggctccgcgacgacggctgtgcccagcggcggcggctgtgccttcgctgcttctgttcgccgttctattcgcgggccgggcggcggcggcgttcggccacctgcaaggcgccggcgccggcgcgacggcgctgtacaagcacgcgtcgttcttcgaccgcgacggcgacggcgtcgtctccttctcggagacgtacggcgcgtttcgggcactcgggtttggattcggcctgtccagcgtcagcgctgcgctcatcaacggcgctcttggtagcaagtgcagacctcaaaatgcaacgtcatcgaagttggatatctacatagaggacatccagaaagggaaacatggaagcgattcagggtcatacgacgccgaaggaaggtttgttcct

SEQ ID NO: 47802 - DNA, 462 bp, Zea mays
  Clone ID: LIB3066-001-Q1-K1-F8
cttgcttgggaacaggctctatcctcttgttgagaggcatcagcccgaactcgcgagcaaaatcactgggatgctcttggagctcgacaactctgaagtggtcacgttgctttgctcgtcggagatgttgtcggtcaaggtcgacgagtgtgtccagctgttgcaggcaaccaagcctaaggctgaggatcatgaggcgctgcacccaggattcatgctggagcctcggcctcctactgtaaatgccagttgatgaggttctgattgcgcggatgagcttctggatgcgcttgtgtttagggatatggtaacaagctagtcgctagctgctgtgttcgttctctccttctagtttgcgaagttttggtgtttggattaatctactgagccgttattgctttctatatatagaacttaatagtaataaggactatatatattcaggtagaaattttttatctg

SEQ ID NO: 47803 - DNA, 461 bp, Zea mays
  Clone ID: LIB3066-001-Q1-K1-E3
cccacgcgttcgactaggcgtacatcgagagctgcgcgaccttgtgtgcgaagagaccccagggagtcgatcgttcaagaaaaataccagcttaccaacaacagcagcagcaagcccacccgttcgacgacatggcccgtctcggcgccggcgccgtgttggcgctactagtggcggtcgcggcggaggccgcgttcctagcggtgccggcctctgcgaagtccggcgagctgagcgcgatggggttgctggcggcgaatggcggcagcggcgcgggcccgcagaagtgctcgggcgcagagggcgagtgcgacgtggacgaggcggacgagctcgggctgagcggcggcagcctcggctccgacgacgctgtgcggcggacgctggcgcagcggaagccgaccaaccggtacatcagctacgcggcgctgcgcgcggaccatgtgccgtgcaacaagcgc

SEQ ID NO: 47804 - DNA, 343 bp, Zea mays
  Clone ID: LIB3066-034-Q1-K1-C9
cccacgcgtccgcccacgcgtccggtttcttccttccttggccgcttctgcgctcgccggccttctcctcccccatcctctcccttgtggttctagatccactcctccccgtgctcactgctcatccgcgaacaggttgagcggggacgccgtggaggggcgagggggagccagattgagccatggcctcctgctgggttcttgccctggttcttgcgctgtcggcaggcgcaagcctggcgcgtggctccgagccgtggtggaacgagacgcacgtgtacgccaccaccgacaactccggtggcggcaacggcgtcttcgtcggcctcacgctcatccagtc

SEQ ID NO: 47805 - DNA, 306 bp, Zea mays
  Clone ID: LIB3066-034-Q1-K1-D1
acgcgatcaagcttgcatacagctagtacgttgaacctatgagtgcttgtagaaagctattgcattggttaaacctggagttcggatccgagaggtctgtgaaatcataaatagacatgcttcgatgtcaggtttatctgtagggaaatcctattgcggccatggcataggggaactgcttcactgtgccccaaacattcctgattattcaaaaaacactgctgaatgtatcatgaaggctgggcagacatttacaattgaaccagtgtataatgcattctcaatcatcacgccacagacgatcat

SEQ ID NO: 47806 - DNA, 321 bp, Zea mays
  Clone ID: LIB3066-034-Q1-K1-D10
cccacgcgtccgcccacgcgtccgcccacgcgtccgcgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaaaggtgacttccttgtcggacaactcaacttcac

SEQ ID NO: 47807 - DNA, 349 bp, Zea mays
  Clone ID: LIB3066-034-Q1-K1-D12
caattactatgtacgagatacaatgagtggaacatgaaaagcacgttctccgtgggaatttggatatggttgaacttccacggacaacgatttccttggaatcgccaccggcaagacgaatccacagattgcattcatccgaggggcgattaaaatcaaggggagcatcagtgcggcgcagaagttcacccctgacatcttccccaagcctgccaagctgtagaacgttagattgtattacttggtcgaggtgaataataatgtttgcaagcttcaattactatgtacgagatacaatgagtggaacatgaaaagcacgttcttcgtgggaatttggatatggttgaac

SEQ ID NO: 47808 - DNA, 485 bp, Zea mays
  unsure at all n locations
  Clone ID: LIB3066-034-Q1-K1-D2
ggaatttcccgggntcgactccacgtcgtctcgacatgcctcggcttcgtttgggatccccgcgtgtgagccttctagttccgccaagccgtgcgtactcggcgtcgcggatctcgggactcgaagatgactgtgagtccctggtgccggaacaaggccggggatggccagcatcaaggagatgccggtggtgcaggacgggccgccgccgggcggtttcgcgcccgtgcgcttcgcccgccggatccccacctcggggcccagcgccaccgccatcttcctcaccaccttcggtgctttcgcatatggcatgtaccaggtcggtcaggggaacaaggtccgtcgggcgctcaaagaagagaaaattgctgctcgcagtgctatactgccgatgctccaagcagaagaggatgaaagatttgtcatagagtggaagaagtatcttgaggaagatgctaggatcatgaaagatgttcagggtggaa

SEQ ID NO: 47809 - DNA, 349 bp, Zea mays
  unsure at all n locations
  Clone ID: LIB3066-034-Q1-K1-D4
cccacgcgtccgcccacgcgtccgatcatttcttcggtataattgcaattgtacaatatattgtgataccttgtattttacttgatcaattgacaattatacttcactatgtatacagatgaaattttagattttacgtgatatatcaatatgtaattgatgggcctatgaaattctgagaattcagagaagtgttgatttgttgccggacacatcactcagccattgaattgttgccggacttgcttcttttgtttccttgttgaattctgttatatatggcagggattaaccgaatgaatattttgaggcanggattaaaccatagagggattaaacccccaaggga

SEQ ID NO: 47810 - DNA, 348 bp, Zea mays
  Clone ID: LIB3066-034-Q1-K1-D5
gtggtccaccatggcgcagcgagcggtggccacgatgacgactaataagccccttctggtcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaagtcacgtacgtggtggaccccagcggcaagggcgactacaccaaacataccgcggcgctggaggatatcccggtgagcaacaccaaacgcgtgatcctggacctcaa

SEQ ID NO: 47811 - DNA, 339 bp, Zea mays
  Clone ID: LIB3066-034-Q1-K1-D6
gccagaaatgctagtcctttttatgctagattcagttactccccctcctaggatatactgaaacatagttcttattaacatatttcgttcgaatgaatgaaaatgaatcatacataaagaccacatttatagatttactaatgtatgtttagtctaaaaatactattttaagaccgagggggtactattttccgtggacgaattgaatgccagaaatacagcggaaagttttcgagatattgtctccaattatcagcaactagcgtctaattagacagtgattagtttctagagattaaattttagtttctccattttattttattctagttcctaaat

SEQ ID NO: 47812 - DNA, 408 bp, Zea mays
  Clone ID: LIB3066-034-Q1-K1-D7
aattaaaattgttcattaggattaatctattctaagcactaaataatttcggaaattcgtaacttaataatcgtagctccgaatttagtggttcttatttataggatctcgttatgcagcgtagaatattattatatagtttattcctatgtttggtgtaatgttaattttgcctataccatgtttgtctgtattgctacgtttagcagtgaggacacatgtcatctgaagagcaagttggtacctggaatctcaagtgctaggcaagttgtgcccttgatcacttttttttacccagtcatgttctgattaatcataatgatctgcataggttaattttgatgggacccaacaagttaccctaatttggatatctttataccttgacttcactaaactttttgggta

SEQ ID NO: 47813 - DNA, 400 bp, Zea mays
  Clone ID: LIB3066-034-Q1-K1-D8
cccacgcgtccggtggcaaacttcccgtcctgcatggggttgtaagctgtctctaaattgcacggcaagtcgtgtgcctgaaccttcatcttaagttgttgtcgtatcccttcgtcttgtttcggttgcaccccgtgatggtatggattggttgctgaccacttgatctatctattctgcattttcctttgaaatgtacccttgtgcatttggatgcttctagtgtactgttcttgcatggttactcatatgaccgagcagttgagtacagcgtgactgggcttctgaagcggccaaatgatcaagaaaccgttctggcgatgcctggagagtggcccttaaaaagtattcaggcaagccttggggatggaggttaaatagacctggttaaaaattatct

SEQ ID NO: 47814 - DNA, 238 bp, Zea mays
  Clone ID: LIB3066-034-Q1-K1-D9
cccacgcgtccgctgacacatttccctttatgtaaatcaacaccaggtgtatgaccctgtcacaagtattacatgcgattgacacttaaagtcaaggtgatctctgatcccaaggcctacgcgatcacgcaattactcaccccctcaatattactatctagaaacacatcatgtctttaacaacaccgtctgaacataacgcttccgatgtacaaattataacccttgctcacgataa

SEQ ID NO: 47815 - DNA, 388 bp, Zea mays
  Clone ID: LIB3066-034-Q1-K1-E1
gctcgaggatgctatctcgaagaagagaaggcgccgcatcgaccagggacatgaagctggtagcatgggcactggttctagcctggagcaagggccacagggagtgtttgaaccgcaggagccggtggaatcagtcgccaacggtgtgccatctgatctggagagttcgtctgttgaggcgaagggattggaggttcgacagggtgtttcttcaggtggttctgagcatctgaatggcaggccaagcggagagttaaatgatgatttctgggaggaccttctgcatgaggtgggactcggcgcaaatgcaggcaatgctgttggtcaggatgatatgaacatggacatggacccagatgttagcctgccttaactgatacaacatgga

SEQ ID NO: 47816 - DNA, 395 bp, Zea mays
  Clone ID: LIB3066-034-Q1-K1-E10
atcctctccctctccgtcccccaagcaaagaaaagaagctagctagctaggcgtagaacgaatgacgacgcagggcggcaacaggtcgacgacgacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaggtggtgtgccggcacttcggcgcgtccaaagagacgctcaaggcggaggcgacgacggacgacagcgggtggtacaagctggagatcgaccaggaccaccaggaagagatctgcgaggtggtgc

SEQ ID NO: 47817 - DNA, 440 bp, Zea mays
  unsure at all n locations
  Clone ID: LIB3066-034-Q1-K1-E12
gaggagaagctgcgcaaggcgggcatcatcgacatgcagttccgaagggttaagtgcaagtacgactccaaggtcaccttccaccttgaaaaggggtgcggccccaactacctggcactgttggtcaagtacgtcgacggcgacggtgacattgtggcagtggacgtcaaggagaagggctccgacacgtacgagcccctgaagcactcctggggcgccatctggaggaaggacagcgacaaaccgcttaagggacccctcaccgtccgcctcactaccgagggaggcaccaagtccgtctacgacgatgtcatccctgccaactggaaggccaacaccgnctacaccgtcaaataattaactttagtgctgacaatactttaagctgacctatgctagctatactagattgggttggatcccaagcaatgcattacaca

SEQ ID NO: 47818 - DNA, 348 bp, Zea mays
  Clone ID: LIB3066-034-Q1-K1-E2
attcactaatccaagacaaaacatggctgtgaatgtgagaaccatgtggtcgtcgatgcgggcacatgttgcgatggctgtggcgttggtgttcttggtgagcggcgcatggtgcggtccttccaaagtccccccaggcaagaacatcacggccacctatggcaaggactggttggacgctaaagcgacatggtatggcaagccgacgggtgccggtcccgacgacaacggtggcggctgctggtacaaggacgtgaacaagccccccttcaatagcatgggcgcatgcggcaacattcccatttttaaagatggtctgggttgtgggttctgcttcgagatcaagtg

SEQ ID NO: 47819 - DNA, 240 bp, Zea mays
  Clone ID: LIB3066-034-Q1-K1-E3
tccacgcgttcgaagagattcgatgatttaaaaacccacacgacatgcatacgctggtgtagacatggattctctctgaagcgcgctggacactgtttaatcctgcaccgtgaggattagtctgtgtgagcatggctgccgtccgtatcgccgttactgctcccagcgtcgtctcccatgagttgctactcgatatcagatcttcttctctattctttcttaccattctctccaatagat

SEQ ID NO: 47820 - DNA, 388 bp, Zea mays
  Clone ID: LIB3066-034-Q1-K1-E5
cgactcgcgatcgaatccgccccgagtcgattccgccgcggaccgcccggttcacttgccttttctcccgagatctcgactctcgagcaagtatgggtgaggcgaaggacaacgaggtgtacgaggaggacctagtcgactatgaggaggaggtggagaatgtcattgatggcgcccccaccaacggctcctcagatgtcgtcaagaaggggtacgtagggatccacagctcggggttcagagacttcctgctcaagccagagcttcttcgcgccatttcagaatgcggggttgagcatccttctgaagtgcaacatgagtgcatccctcaggctattcttggaaagggatgcatctgtcaagcagaatctggaatgggtaagactgc

SEQ ID NO: 47821 - DNA, 377 bp, Zea mays
  Clone ID: LIB3066-034-Q1-K1-C8
cgcgctcctcggcctcccgctcccgtgcacctgcgcgcgcccgcacctgccctgcctgctctccttcctggcgcgctacccgtccctcgccgccggatccctccacgccgccctccgcgcccgcttcccattcgtcggccccaccgaggacgaggaccaccgtcaggagggggccgaggaggagggggaggagcaggccgtcgatgcgcggaaggaggaacgggaccttcgtcaccgcgaggaggcgcgcaccgagctacggcgggagctggagaaagagcgcagcgccgcggcgtcggcgaccgaggaggccatgtccatgatcctgcgcctgcagaagagaagtcggcgctggagatcgaggtgcgacagcagcg

SEQ ID NO: 47822 - DNA, 362 bp, Zea mays
  unsure at all n locations
  Clone ID: LIB3066-034-Q1-K1-B2
gaccaggagctcgagaatgccaagagcagctcaatctgtggagaagagctacgagctgcctgatggtcaggtgatcaccattggggcagagagggttcaagatgcccctgaggggtcctctttccagcccttccttcattggtatggaagctcctggcatccatgagaccacctacaactccatcatgaagtgcgatgtcgacatcaggaaggacttgtatggtaacattgtgctcagtggtggcacgaccatgttccctggtattgcggaccgtatgagcaaggagatcactgcccttgcgccgagcagcatgaaaatcaangtggtggcaccgnctgagaagaaatacagtgtctggata

SEQ ID NO: 47823 - DNA, 230 bp, Zea mays
  Clone ID: LIB3066-034-Q1-K1-B3
cctgcgctggcggccacccgtcagcgtactctcttctgcgcgtctacggcgctcgtgctctgcggaccacaatctgctcatcaagcactgctcgcttgcatgctcgcgtctccatgggtctactgtcaaacaggattgcgaaggctagcctctgagccggggatcatatctactcctggacggcagcgtgagcatacacacctcactggatacatgcatgccaccataag

SEQ ID NO: 47824 - DNA, 380 bp, Zea mays
  unsure at all n locations
  Clone ID: LIB3066-034-Q1-K1-B4
cccacgcgtccgctctctcgcgcgcgcattacttgcacgtacgagctcagaaggaaggcagaggcanaagcagccatggcgaactcgtcgtacggccttgcggtgaacgacgagtgcaaggtgaagttccaggagctgaagtcgcggcggagcttccggttcatcgtgttcaggatcgacgacacggacatggagatcaaggtggaccgtctcggcggaccgaaccagggctacggcgacttcaccgacagcctncccgccaacgagtgccgctacgcgatctacgacctcgacttcaccaccatcgagaactgccagaagagcaagatcttcttcttctcctggtcccctgacactgcacgcaccaggagcaagatgct

SEQ ID NO: 47825 - DNA, 409 bp, Zea mays
  Clone ID: LIB3066-034-Q1-K1-B5
cgcacgggcagctggcgctctcggaggacggcgtggagatgaccttcgccaccaactgcctgggccacttcctgctgacgaagctgctggtggagcggatggcggagacggcggcggccacgggcgtgcagggccgcatcgtgaacgtgtcgtccagcgtgcacggctggttcgccggcgactgggccgagtacctgcacctcgtcacccgccgcaagataccctacgacgcgacgcaggcgtacgcggtgtccaagctcgccaacgtgctgcacacccgcgagctcgccgcgcgcctgcaggaaatgggcgccaacgtgacggccaactgcgtacacccgggcatcgtcaggacgcgccttaaccgcgaccgtgacggcgtcctaaccggagagggaactgacagcgc

SEQ ID NO: 47826 - DNA, 364 bp, Zea mays
  unsure at all n locations
  Clone ID: LIB3066-034-Q1-K1-B6
cccacgcgtccgaaccctgaaattctgaacatcgatcgagtggcccagccaattccccgaggcatggcacgccgtcgtcttcaccatggcctccaactcgtgtgcctcgtcgccgtcgtgttgacggccgccccagctgcccatgcaatcttccatttcgacatccgtttcgacgccggcagcccgttcttcggcggcggccactccaggcatgacatgtggcgccgcgccgacctcgagagcaacgccaggctgtccaggagactcgccagggccctcggcaacaagcagagcggggccgncgccgacgccatcgtggaacccgacgtgacccttttccagtacacccagcaaggccactccc

SEQ ID NO: 47827 - DNA, 419 bp, Zea mays
  unsure at all n locations
  Clone ID: LIB3066-034-Q1-K1-B8
cccacgcgtccgaaaatggcaaaggctctcctaggtggcctatcggcgatcctcgtcgtggcggtggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactacatgaccgagagcgcgcgcgaggactgcaagaagctcctggaagacgccgncgacgacctgaggggcatgct

SEQ ID NO: 47828 - DNA, 427 bp, Zea mays
  Clone ID: LIB3066-034-Q1-K1-B9
acgcagacaatggcgcgcaacctgtctgtcacattgttcattctgacggcctatgtcgccgggacggcggcaccgaccgtctgtgcggtcaaatctccggcgagcacaacgaccacaaggaaacacgaagcagccaaagaagagacggatgcgcctgccaaggcaccagctgctgcagccaccgacgggcctgctgcgtgagcgcccatgacatggccggatggcgggcctgagttcgtcaagatggtcatcaagaacccgttctttaaaagcgcacctccatctggtagcgaagacggcctacccattgaccccactacagaaggcagcatgaactaaactaaataccaattacgagaccgaccagatatgcatggagcatgcaagaatgctgtcgaacgaatatatgctatgaatggttacatgt

SEQ ID NO: 47829 - DNA, 270 bp, Zea mays
  Clone ID: LIB3066-034-Q1-K1-C1
ggaccttccctccccgcgtcctcctcctctccgtcgtcctcctcgctgcccccgccggcggcggcggcactggttcggagttcgacgacggcacctcgcccaagttccccggatgcgacaacacgctgcagaaagtgaaagtgacgtactgggtggacggcgacgagcggagcagccttacggggatcagcgcgaggttcggcgcggtcctgccggacgctgcgcccgacgacgagaagcatcgggccgtcgggcccagccccgagagcg

SEQ ID NO: 47830 - DNA, 379 bp, Zea mays
  Clone ID: LIB3066-034-Q1-K1-C10
cccacgcgtccgaataaagcatcgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcacgaggcatgggcatcggcatgcggcggcactgggaagcagacaatcctcatacccaaaggtgacttccttgtcggacaactcaacttcacaggcccttgcaagggcgacgtgaccattcaggtggatggcaatctgctggcgaccacggacctaagccagta

SEQ ID NO: 47831 - DNA, 428 bp, Zea mays
  Clone ID: LIB3066-034-Q1-K1-C11
gttgacttctctttgtgcaattgctgttgctgtggataaacagactgaagattggagggaaaaagaattagatgaggatgcacggtgtttccaaaggccacctgcttgcatcataaaatacagtgatattttgaatcatgcagcaaaggtttatacacatagaatctacaaactgtttgagacagattttcttgatgggtgtggagccacaaaattcaaagagcttccgtgtcaagataacaatacatatcaatttgagatgactatgcaagggcgaggatcaagagtttgcacagttcatttcaatatgtctatgatgcaattaagttgcagctgcagtaagtttgagacaatgggtttactttgcccacatgctttgaaagctcttagtataaaaaatatatgcaaaattccagaaagctacatac

SEQ ID NO: 47832 - DNA, 425 bp, Zea mays
  unsure at all n locations
  Clone ID: LIB3066-034-Q1-K1-C12
cccacgcgtccgcggacgcgtgggcgcccgtggtcaaggagacgcccggatctggcgcccccgcccccgctaggaagccgcccgtgcacacatctgccgcctccggcggcggcgggtgggacgactgggacgacgattttcggccggacatgaggcggaatcagtcggttggatcgttcgccgccgcgggtgcgcagtcagggaggcagccgccgaggtccaaatcaacacaggacatgtacacgaggcagcaactggaggcgtcggcggctaataaggaggactttttcgccaggaggatggcggagaacgagtccaagcctgacgggatcccgccatcccagggcggcaagtacgttgggttcggatccagcccaccgncgtcggctaacaggaacggccgtgcttgccagggcgatgtcatg

SEQ ID NO: 47833 - DNA, 393 bp, Zea mays
  Clone ID: LIB3066-034-Q1-K1-C2
catatttgaaacagttaagaattcatatataagagtgcatatatatatatataattctgccaagacaaaggtaatggagtcgtcacgcatgttccagccggccatcatcctgcttctcctgctcattgtgaccaccgatgtggcgcatgcggcgagggaatgcgagaaggacagcgagcgattccttggggcatgcatggcgtcggacaactgcgccaacgtgtgccgcggtgagggcttctccggcggcaggtgcagcaccttccgccgacgctgcatctgcactaagccgtgctaaattaacctactcccggcagttcgatggtggacgtttattctatttattggcttacttgatttttttttcccctaacaataagaaaaacgcacgtg

SEQ ID NO: 47834 - DNA, 302 bp, Zea mays
  Clone ID: LIB3066-034-Q1-K1-C3
acgcccacgcgtacggaaaccaaaaataaactgcaggcagagggggaaggagagcggcaggagggtcattaaataaatctacttttctgtttcagggtaggaaatgatgtccgagagtgaagagcatggctcgctcctagacaagatcaacgacaagatcaacgagaagatccatgagtataagcactcgtcgtcgtgctcctcctcttcggactcagactatgacaagaagcccaagaagtctaagaagaagaagctttttggaagataacatccattgcatcatgtcctctgaggaggca

SEQ ID NO: 47835 - DNA, 338 bp, Zea mays
  unsure at all n locations
  Clone ID: LIB3066-034-Q1-K1-C4
ggtgctcagctgcatccgccaccccaacatggtgctcctcctcggcgcatgcccggagtacggctgtctcgtgtacgagtacatggaccacggcagcctcgaggaccggctgttccgtcggggcggcacgccgccgctcgcgtgggcccagcggttccggatcgcggcggagatcgcgacggcgctgctgttcctgcaccaaacgaagccggagccgctggtgcaccgggacctgaagccggtcaacatcctgctggaccgcaactacgtgagcaagatcagcgacgtcgggctggcacgcctggtgccgncgtcngtggcggacaacgtgacgcagt

SEQ ID NO: 47836 - DNA, 337 bp, Zea mays
  Clone ID: LIB3066-034-Q1-K1-C5
cccacgcgtccgcggacgcgtgggcggtcgcgtgggatcgaagctcagcttggtgacggatgcatcttccctcagaaactcggaaccccttttccacaaaatttcaaggaagttgtgaagacaatctttaagcgacttttccgtgtttatgctcatatttaccactcacattttcaaaagattgtcagccttaaggaggaagcacatcttaacacttgcttcaagcattttacattgttcacttgggaattcacgttgattgacaaggctgagcttgcaacacttattgatctaattgaattcattgtgtcagtttgttggcatgacatcaatgatt

SEQ ID NO: 47837 - DNA, 343 bp, Zea mays
  Clone ID: LIB3066-034-Q1-K1-C6
cggacgcgtgggcggacgcgtgggcggtacgcgtgggcggacgcgtgggcgaatctgcggtcctctccaacacgaagatggcgttcatcagcaatgtcgcagtgaaggcggcggccgtggccgcgctgctgctggtcgcagcggtgtcgcctgccgcgcgcgcggcggcggtggcggtggcgggaggggcgccgtcggtgccggcgggtccgctggacatcgcgcagctgggcgccaagggcgacggcaagtcggacagcaccccgatgatccttaatgcgtggaagaacgcgtgcgaagcgacgggggtacagaagatcgtcattccgccgggcaactacct

SEQ ID NO: 47838 - DNA, 200 bp, Zea mays
  Clone ID: LIB3066-034-Q1-K1-C7
gcgcccacgcgttcgcccacgcgttcgagcttctgctcttattccgccgggcaacagctcaggcgccgcaaccgccacatcagccatgggcgcctgcgcaaccaagcccaagacgcttgagggggcaggccccagctgaggccgtcggtttcacacccaaggttgcgcccgatgccacttcaatctccgttgaaggtgcg

SEQ ID NO: 47839 - DNA, 412 bp, Zea mays
  Clone ID: LIB3066-034-Q1-K1-B12
aggaaactggagagcttagaggctctaaagaagactttcaagaaactagaccacgatgtaaatattcaagactttctaggctcgcgggttcagacagtcgaggagctatcagcagagcttgtctcgttgcagggtcaggtggcggagcttcaaaagcgtgtcagtgattggagcgatcctgagaaagttgacaatatcgacaatataagagcaatggagcaatctctcaaagaaactattaatcatatccaaatccataaggggaacttcggaaagcaacatctaatcgggctacagtatgctgctacccagttccagaccgacatgcagttgcctctaggactgcccggcgagtcaggcccttcgtcgtggttccaaaacggcggcactgatgggcaacaagccatgatgc

SEQ ID NO: 47840 - DNA, 180 bp, Zea mays
  Clone ID: LIB3066-033-Q1-K1-H8
aatccacatgtgttggagtggtttggtataaaatttaaactaaatgtcacacgggacgagtccaactgtccaacacacatatactaagatggatacgtggatatccaaacaagttaggtgtctagtgtctaggtttttgtttgtggtaatctgcaatataactttgagatcctttgtgtg

SEQ ID NO: 47841 - DNA, 420 bp, Zea mays
  Clone ID: LIB3066-033-Q1-K1-H9
tgtgttttctctagagtcttccggcacaccattttaagaaagtttggccttcacagctgagcgcctcagcatggtgacactaattttctgcaatggtgggaaagagtttcagctattgtagtgaggaaaggattggactctctcattatcctgggagcatggatgatctggaagcataggaacgaagtgatgttcaaaggagtttctcctaatctcactcttctcctggagtctgctaatgaggaaagggagaaatggcaagttgcaagagccaacggtttatcctttttggctgctcctagtcgtaatgtttagggacagtggttggggttttttattttttgatgtcttttatggacatttttgtgtatgcctgtttctggtctccgtaaggagtgccttgtacccggggtcttctct

SEQ ID NO: 47842 - DNA, 394 bp, Zea mays
  Clone ID: LIB3066-034-Q1-K1-A1
caataagatggcgtgtatagacaatgcaatgagagccttgttccttttagcgctcttctgtgtcgtgcatggtgagaaggcaaagtcaaaggacaacgatgcaaaagcgtccgggcccggtgggtccttcgacatcaccaagttgggcgcctccggcaatggcaagacggatagcacgaaggctgtgcaggaggcgtgggcatcagcgtgcggcggcaccgggaagcagacgatcctcatccccaagggcgacttcctcgtcggaccactcaacttcacaggcccatgcaagggcgacgtgaccattcaagtgaatggcaatctgctggcgaccacggacctaagccagtacaaggatcatggtaattggatcgagattctacgcgtggacaac

SEQ ID NO: 47843 - DNA, 436 bp, Zea mays
  Clone ID: LIB3066-034-Q1-K1-A10
cccacgcgtccgcccacgcgtccgcccacgcgtccgcccacgcgtccgcccacgcgtgcgcagggaacaagctgcgattggcaggagtactggacagatggataacgtgatatcacaagctcaggcaacacttggttctctcatgacccaacggtcaacattcggtggcatcactacaaagataagcaacgtcagcagccagcttccaacaattaaccacgtcctctcatcgatcagaaggaagaaatccatggataccatcattctttcgctcgttgcatctgtctgcacgtttctcatcttcatctactggctgtcgaagtaggtttaccagagcaaagatattacagtgttgtaagcttgggaccacaccaccagtaccggtacagatagtcttcattggtgtttgtacaatattattggttgattgaatgct

SEQ ID NO: 47844 - DNA, 352 bp, Zea mays
  Clone ID: LIB3066-034-Q1-K1-A11
ccggttatcccccggcctccacctgaccgctaccaccacccgggacgtcttgcatggcctcctcatagaataagctctatctcaccgcaacaactcctcattacaatccttcaagagagcagcactacactacactacattagagagaggtcgagcgcccctcctccgatccgccggcccgccgagagctagctgctgatcggtcgaggagagtcatggcgacgtcgacgatgcgcgttgccgccggcgtgctgctggtcgtgtcggcgctggcgaccttggcccgggccgaggacccctacctgttcttcgagtggaaggtgacgtacgggaccaggtccctgctgggagt

SEQ ID NO: 47845 - DNA, 430 bp, Zea mays
  Clone ID: LIB3066-034-Q1-K1-A12
cccacgcgtccggggggacattctggaggagaagcgtgacgggaaggacagcgaagacctgagcagcacaggcgacaaggcttgtgtcgggctcgggagcagtgatataaacatcccgatggaagaagcggttgatgaacctgttaaaccggcggaagctgtggacgaagctgggctgaagagagatgtctgctgttcaccagctgagccaaacgaagccgttggtcagaacgagctcaatgaggctgctgtcgtcggtgaaacgacgactgaaccgaaggaggctgaggatgaagccaagataataaagcaagtcgactgcgaaactgcatcaaaagaagttgctagtactggggccgagtcaagggacgatgccgctactatggaacgcgagccgctggtagcagcagcagcagcaccacaagaagag

SEQ ID NO: 47846 - DNA, 387 bp, Zea mays
  Clone ID: LIB3066-034-Q1-K1-A2
attatttatttattttgttcagaactcctattgcataataaagttgtgacattcgttgctataccactattcatcatatgtgtgagacttggtcccagcacacctggtgtttatgtttgcgctcggatctctaaaacccgagtgtgacagaagtggtatcagaggaatgttgactgtaggacaaaacctagatagaactggacaaataatactgtcgaagaggaaatctccggccgggtggcggaatgcacccgccctaaatcctaagatgaggagatgcctaaacgttttgcctgttaggtggaaacgagaagaacacaagaacacacaaggatttagagtggttcgggccgccggagcataatacactactccactatgtgatgt

SEQ ID NO: 47847 - DNA, 407 bp, Zea mays
  unsure at all n locations
  Clone ID: LIB3066-034-Q1-K1-A3
cttccaccaccgcctcctcccccgccctctcctcgtccgcgtccgtccccagtctccggcgggcgaacccgaagccgacgctggtgacgaagcgtgccgccatgagcgcggcgaagctggtgccgagcgacatggcgagcgcgccggccatgaggaaggcgttggcgagcacgatggtgcggcggcggcccaggtggtcggccacccagccggcggcgaggatggacgcgaccatgaacacgttcatggaccccgccagcacctcgacctcgccgtcagtgagccccacgtnctcccgcatgaacagctccgcgtcgctcatcagcgtcaggtctgcagggcacgtatatggatcggtcggaagcatgagtttagcacatcgatctctcttcgtgattaattggatg

SEQ ID NO: 47848 - DNA, 268 bp, Zea mays
  Clone ID: LIB3066-034-Q1-K1-A4
ggacaatcgcgtccaaccgccgctgcacaagactaggaagaggttcccggtaccggggccgccgctatgtcgtcgatgatgaacgccctgtaaaactggctggtgaacccgcgccgcaacccgttcgggcgcctccacatgaccgccgcttcttggggcttaaggaattccggcttgaggtccaagaccctgtccaaccctattttgaaccggacattaaggaagcgcttgggaaggttgctatggaggtggtcgacgcccgcattca

SEQ ID NO: 47849 - DNA, 368 bp, Zea mays
  unsure at all n locations
  Clone ID: LIB3066-034-Q1-K1-A5
ccgcaacttctccctcggtgccctccgcgacaaggacgctcagcacggcggctccagggagcagtccatcaaggaggagaacgagcaagagggggatggtgaccatggggcgcgagtcggcggcgaggatccgggcttggtgggagggggatgcggcgagccggacctcgcctccttgtcggtggaggtggacgcgttcctcgcgggtcaggacgaggacgcggcgccggtgagcatcacggagacgacgctggagaggttcgcctncgncgtcgagctgctggtcgccaggtacgaaggagtcgaggacaggtgggcgtcggaggccggcagcgagccgactgcgctgctggccgcgataacgcgca

SEQ ID NO: 47850 - DNA, 394 bp, Zea mays
  Clone ID: LIB3066-034-Q1-K1-A6
cccacgcgtccgcccacgcgtccggttctagatcgcgagcggccgcggccgccgagcgggccgtccccgcctcccccaccgggcacgacgagaagcgctgcagcttcatcacgccctactcagaccccctgtatgtcgcgtatcacgacgaggagtggggagtgcccgtgcacgacgacgagttgctattcgagatgctcacactgtctggcgtgcaagtcggggccgactggacttccatcctcaagaaaagacacgtgtacagggaggcgttctccggcttcaacgtggatgcggtcgccaagtacaccgagaagcagatggcgtcgctgagcgccgactacgggctggaattgggcaccgtcagaggaaccggcaacaacgcctggcggat

SEQ ID NO: 47851 - DNA, 365 bp, Zea mays
  Clone ID: LIB3066-034-Q1-K1-A8
gtggtatgcgtcaaagaagcattggcttgcaaacaatgtcctgggattggctttctgtattcaggggattgagatgctgtcattgggatcatttaaaactggagccattctcttgggtggactttttgtgtatgacattttctgggtgttcttcactccagttatggtcagtgtggctaaatctttcgatgctccaataaagcttctgtttccaactgcagacgctgaacggtcattctccatgcttggccttggtgacattgtaatacctggtatattcgtcgcacttgccttgcgttttgatgtctcaagaggtaccaagaagcgttacttcaacagtgcattttttggatacgctgggggta

SEQ ID NO: 47852 - DNA, 388 bp, Zea mays
  unsure at all n locations
  Clone ID: LIB3066-034-Q1-K1-A9
gcgacgcctgcgacggcaaggactcgggctccgtccccatggactccacctggcccaacgacatggacgggagctacttcggcctggtgctggagaagaagatgcccctcaccatcgaccgcctgctggggatggacaagacgaccgagcccatagtcaaggccatgtcggacaagactaccgacttcgtccccatcttcgccaaggccatggagaagctcagcgccctcaaggttctcacggggaaggacggcgagatcaggaagacgtgctccgagttcaacaacccgcagaacaccagcggcagcacgtcggtgatacggatcagctccatcgacgccgaccagatggccggnctgtcgcagccagggtcgacgtccaggaaagt

SEQ ID NO: 47853 - DNA, 364 bp, Zea mays
  Clone ID: LIB3066-034-Q1-K1-B1
gttctcaaaccaacctaggcaattcgccgcagcctctcaccctcgcgagtcccgacctgccgcagccgccgcacagatggcacccaaggcggagaagaagccggtggccaagaagcccgcggaggaggagcccgcgacagagaaggtggagaaggctccggcggggaagaagtccaaggccgagaagcgcctcccggcgggcaagtccaaggagggcggcgagggcaagaaggggaaaaagaaggcgaagaagtccgtggagacctacaagatctacatcttcaaggtgctgaagcaggtgcaccccgacatcggcatctcgtccaaggccatgtccatcatgaactccttcatcaacgacatc

SEQ ID NO: 47854 - DNA, 348 bp, Zea mays
  Clone ID: LIB3066-034-Q1-K1-B10
tgcctttcagcagcatgatccaggagatgaagggcaagatcggcgccatctggttgcgcggcgtgctacggttccggccggggggccacgccggggccgggcgagcgccggcagccgagccggacgaggcgtcgcgggagggctgctgggcgcagttgcctttcgagcttctacgtatggtgctggtcagggtcgaggaccaggagtcacggtggccggcccgcagcgccatcgtggtgtgcgcctgcgtctgccgctgctggagggccgccgtcaagattgtgcgcgtgccggaggcttctgggaaactcaccttccccatctctcaagcagccttggccaagggat

SEQ ID NO: 47855 - DNA, 379 bp, Zea mays
  Clone ID: LIB3066-034-Q1-K1-B11
gaaggacgtcacggacatcaacgtcaaggattgcactcttaagaagacgatgttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaaccagaccatggctatatgcacgaac

SEQ ID NO: 47856 - DNA, 125 bp, Zea mays
  Clone ID: LIB3066-033-Q1-K1-H7
agcagggcggcgccatcgacgactacgtcatcgccaaggtcactgaccaccacgtgtacctcgtctacgacgcctacatgcagacacatcgaccattgccagattgactctcgcactgaggtctc

SEQ ID NO: 47857 - DNA, 436 bp, Zea mays
  Clone ID: LIB3066-028-Q1-K1-H11
atcctcggttgcagccggagttcttgacgacggtgcccaacgaggaatagaaaggaaagaagaaaaaaacgcgtctctgaattccacacggccggcgaagacacttgaacagtcttgctggcaatgggaaacaagggaccagtgccaacacaggaatcgacgaatgatgacgccgaggcaccgtcgtctacgtctgctgcgagcaatactaagagcaagacagacgtggagcgagagcagctgttcgaaggatcaagcgacgacgacgcccacacgccacggaagagaagcacccaggagatcctcaccaaatacaagttcaaaggggacgccgcggctgccgcggctcacgcgaagcagaagctcatggagcggcaggagaaactcgcgagaatcacggagcagtccgcggagctggagagcgaggccgagaact

SEQ ID NO: 47858 - DNA, 416 bp, Zea mays
  Clone ID: LIB3066-028-Q1-K1-H12
cccacgcgtccgacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggcccttcggcttcctggcaaagcccgggctcaacgacaagattcgccactgcggcatcatggacgtcgagttcagaagggtgcgatgc

SEQ ID NO: 47859 - DNA, 340 bp, Zea mays
  Clone ID: LIB3066-028-Q1-K1-H2
gcgcgagcgccggcgcctacgccaggtgcccaggcctccgtcggtcatttcgccaggcattcgtcgcgggctcttcgccggcgacgagcacacccaccaaacagattctcgtgacagtgcctccctggttgcctttcgctgaagttactgaatctgaaatctgaccatcatgaaccaggttgagggttggtcctttacgagcatgttataatgggagagaacggagttcagctgacactgacctccactttgaagagcacaggcaagccacggatcaatgcggacgggctgaataatggatcacatactaccaaagagaagcatgaacacggtggcactt

SEQ ID NO: 47860 - DNA, 377 bp, Zea mays
  unsure at all n locations
  Clone ID: LIB3066-028-Q1-K1-H3
cggacgcgtgggcgccatcgccgctattcccattcgccctcccctcctcttctccaccccgcgcaaaaccctagccgccgacccctccaatcccctaccagcgcccgattgccggccccaatcgagctagggctcgccaatttctggccgagctcgttgaaatttcggccggtcttttctggtgaatcctttggtttatcctgaggggatattttgatttctgcggcgcacgatggggagcagaagggaggaggagaggaacgagaagatcatccgcgggctcatgaagttgccgnccaaccgcaagtgcatcaattgcaacagtgtggggccacagtatgtgggtaccaatttctggaccttcatttgcctgtcat

SEQ ID NO: 47861 - DNA, 88 bp, Zea mays
  Clone ID: LIB3066-028-Q1-K1-H4
cccacgcgtccgcggacgcgtggggttgtgcgtagcttctctctatatatatacccgtatgtaaatggtcgacaaaatttgtttgacc

SEQ ID NO: 47862 - DNA, 398 bp, Zea mays
  Clone ID: LIB3066-028-Q1-K1-H5
gccgccgcttcgccgctgcccgtttcttcgaaccactccgaagctgccccgccatggacagctccgccactgacggcgcgaggctaccgccgccaagggccgggagtcgcctctgcgtcaggtgcggcgagaggaaggccgcgctgaagcggcccaaaaccctagaacagatctgtagggaatgcttctatatcatctttgaggacgaaattcatcaaactattgtccagaattctctgtttaaagctggtgagcgtgtggcaatcggagcttctggtggaaaagattcaaccgtgcttgcatatgtgttatcggagttaaaccgtcagcataactatgggcttgatttgtgccttttatctgtcgatgaaggaatcacaggatatagagatgactca

SEQ ID NO: 47863 - DNA, 304 bp, Zea mays
  Clone ID: LIB3066-028-Q1-K1-H6
gagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagcaactcctcagctcggggttccgcctgaagaagcatgagctgcagtagctgcggaatcttctactggtacatggacaactgtttggactgatggacttaccagtcttgatcgttacaaaggacgatgctatcacatcgagcccg

SEQ ID NO: 47864 - DNA, 477 bp, Zea mays
  Clone ID: LIB3066-028-Q1-K1-H7
cccacgcgtccgcccacgcgtccgctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtgggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcggcaccggcgtcgagaccacgacgacggtggaggcgaagaagaacgccgaggatgccgtgaaggagaagctggcgcagcaaagctgatcg

SEQ ID NO: 47865 - DNA, 435 bp, Zea mays
  unsure at all n locations
  Clone ID: LIB3066-028-Q1-K1-H8
cccacgcgtccgcccacgcgtccgcgccatcattgtttggaaataccaatccaactcctggtacatcatcattatttgccacatcagtgacaaataatccaagtccattcggcactggctcattattcgctaacactcaatcagccccattatttccctcagcatttgctcaaccgacatcaagtacaccggctttctcctctggcagcctatttggctcaactaatccgggcagtctgtttagcagcagcggtccttcacttttttcaacaccaacatttcaaccatcggcccctgctcaaacttcgaacttattctccttccaacctgcaattcaaccagcttctacaggtgggattcccctgtttttccaatactacaaaccaagccttgatgggacagncggatgatcttttgctacttttcaaatgcaca

SEQ ID NO: 47866 - DNA, 406 bp, Zea mays
  unsure at all n locations
  Clone ID: LIB3066-028-Q1-K1-H9
cccacgcgtccgggtccatggcatccgccgatgcaccggaggcggcggccgatgctcccgctcctagccccgactccgcctcatccccagactcatcgtcagaggcgccctccagcagcagctcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgtttatttctttatttattatatgtctctctcggttgttttttatttttcttaatgcatgtaatataatttgttatacccaatatagacaatgtgtgctatgcgctntaattctatggtgacgatggcaccgttttctca

SEQ ID NO: 47867 - DNA, 429 bp, Zea mays
  Clone ID: LIB3066-029-Q1-K1-A1
ggggcggcgcgttggggatccttgtgcgccggtaccgccatggggtgattcatgaaaggtggcgtcgagtccccgatgggtggtcagggagagtcgctggtgctaaccacgcgccattggggtctttccagatgagaatattcaccgggggcacacaaattgctcgtcggagtggacgcttcgccttggatcagcggtaagctgtgggcagacgacatcacggcccggatagcttcgcgaggttacgagtcacttgaagagcaagttggtacctggaatctcaagtcccaggtcaagaacaggtaccgtaagatgaggcgcataaaggatattgtgatgagttcgtgagaggtctaggccgtcatctcccagtcaactttaggttgctggatcggtgtcttcatatgatggaattatttaattaatttg

SEQ ID NO: 47868 - DNA, 427 bp, Zea mays
  Clone ID: LIB3066-029-Q1-K1-A10
cccacgcgtccgcccacgcgtccgatcgcccccaacctcgcgaacgagatccgcagatggagaggccttcaccaattgatttctgcgcgcctcgggcccggggaggcgatggcacggtgctgggcgacctgccggagaactgcgtcgtggaggtgctgctcaggctggacccgctggagatctgctggatggcgcggctcagccgcacgttccacgacgccgcgtccggggacggtgtctgggagtccaagctgctgacgaactacgtgcgccttctcgccgtcgctgcggccggcgatggggaagcggggcaggccgccgggtctgcgccggaggcggagccgctgcccaagaaggaactgtacgcgcggctttgccgtaggaaccgtttcgacggcggcaaaagagttctggctggacaagggtg

SEQ ID NO: 47869 - DNA, 431 bp, Zea mays
  Clone ID: LIB3066-029-Q1-K1-A11
cccacgcgtccgcccacgcgtccgcccacgcgtccgccagataccaaggcacggagggccatgaccatagcagcaatgacatggctgtggtgatggggctccggcgagcaattcccattacccagccacatctcccgttgaattgagagttgttgaactacaacatgcgctcaaaaacctattagccccttcccctgagcccgaacaacgccgagggcgtgatacattggcggcgacaacctctctttctctcactacctctgacctatctgcatgcatcaagcgggatgctcatgggtttcatcaggtgaccatggtttgagggcaatggatggaggggcctcgagttttatactcccagaccaggtggataaggatttaaccggtgatcgatctccgatgattgaaggagggttaggtgcgattcggat

SEQ ID NO: 47870 - DNA, 359 bp, Zea mays
  unsure at all n locations
  Clone ID: LIB3066-029-Q1-K1-A3
gtgcgtcctctcctcaacctcaacccccaccccgccctacctacaaccctattaaatggcggcttccgacccgtagacctgattgatccccgcatcgaatccggcggatcgggagcgggagagaccactcccaaatcgcgtcgcgtcgcgtcgagagcgagagcggaagaggtgcgcgcgggggaaccgagccgactgatggagccgacggcggcgcccgccgcctgcgagatcgcgcgcctgccggatgacctcctgtcggcggcgctcggccggacggggccgctggacgcctgccgcgccgncgcggtctcgccggcctttcgcgccgcggccgacgccgacgccgtctggtccag

SEQ ID NO: 47871 - DNA, 434 bp, Zea mays
  Clone ID: LIB3066-029-Q1-K1-A4
gggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgtcctgctcaccaggaacgttg

SEQ ID NO: 47872 - DNA, 375 bp, Zea mays
  Clone ID: LIB3066-028-Q1-K1-H10
cggacgcgtgggcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcattcggcgaggacctgcacg

SEQ ID NO: 47873 - DNA, 474 bp, Zea mays
  unsure at all n locations
  Clone ID: LIB3066-028-Q1-K1-F6
atcggctccggcgccgcctccgtcgtgccttccgatccgctctactccgtctacgccgctaccaaagcgtatgttgaccaattctcaagatgcctctatgttgagtacaagagcaagggtattgatgtgcaatgccaggtgcccttatacgtggcgacaaagatggcatccatcaggaagtcttccttcatggtcccatctgctgacacctatgctcgtgctgccgttcgtcacattggatacgagcctaggtgcacaccatactggccacactctgtcgtgtggttcttgatctccattcttcccgagtcccttatcgacagcgtgcgcctgggcatgtgcattaagatccgcaagaaggggctggccaaggacgccaagaagaaggcgctgtgattgatgtttcagaatgcatgttcagattcgcacatttnctcatcacctgtagtagacacgtgccttgcttgagtcact

SEQ ID NO: 47874 - DNA, 300 bp, Zea mays
  Clone ID: LIB3066-028-Q1-K1-F7
cccacgcgtccgcctcgtccagtcgccggttgcgtacgtgtatcgaccaacgacctgtagtgtgtagaacagattgaggacacatggacatgacggaggaggcggcggcaggagcaggaggcttatcgtcatcatcggggaagccggtgatggtggtgggcattgacgacagcgaccacagctactacgcgctgaactggacgctgcagcacttcttcgtcgccgggcaaccgcagcagtaccagctggtggtgctcaccgtcaagccctcggcatcgtccgtcatcggcatcgccggcg

SEQ ID NO: 47875 - DNA, 454 bp, Zea mays
  Clone ID: LIB3066-028-Q1-K1-F8
cccacgcgtccgagccggcgcacgccgacgggcacagtagcgaccgcgagcgagccagagcatgggtgacactggcgcgaacatggcccactggggcgggctctacggccggggcggcgcgccggcgacgacggaggcggtgacgacggcaggaggcggcgggtcggtgtcgagccctacgtcgggcgggtcgggcggtagcccgagccgcgcgcagctgcagcccggggtcggggtggagggcgggcgcgtgggcaagcccgcgcggcggcggtcgcgcgcgtcccgccgcgcgcccgtcacgctgctcaacaccgacaccttcaacttccgcgccatggtgcagcagttcaccggcgtcccgcccgggccctacggccccggccccggcggcggcggggggcccgtcatcagcttcggcgccgagtacggcggcgcgcagctggtgcgcccg

SEQ ID NO: 47876 - DNA, 421 bp, Zea mays
  Clone ID: LIB3066-028-Q1-K1-F9
gctgatcaacgctgtcgattactgccataggcgacgcgtgtaccagcgagagatccagggtgaaaatgacatggttgatgctatcggcaagttcaacggtctctattgtggactgagcgcactatctaaaacagtcgcagaggatactgtgctacgcacaacctgtggaactagcaattatgttgctgcctaggttataaacaataacggctctcatgtacctaacgctgatctggtggaatgtggactcattctctatgccctgctggcggggtacctcgcatttgaacattcgaacctgatgctgctctacaagaagatcttcaaagcggatctcaggtgcacgagctgactctccacaagcgcagagaatatcatcacgaacatacttgaacctaatgctaacaatagaataactatt

SEQ ID NO: 47877 - DNA, 399 bp, Zea mays
  Clone ID: LIB3066-028-Q1-K1-G1
cccacgcgtccggcgggaacccgtgccctgtacctcctcgtcgcggctgtcgcggcgctcgtagccacgcctgcggccgtggacgcggccacgctggcggagatctgcaggggaaccgcgttccccgacatctgcaccagcacggtggggagcgaggcgcagagcgccggggtgttggacgccatggcggtgttgcggatgcaggtggacgcgttcaacaagcgcaccgaggcggcgagggcgcacgtcaaggaggccgccgtgacggcgtcccccaaagcgcggacggtgctggacctgtgcaacaacctgtacctggacgtggaggacaacctgggagcctgccgtcgggccatcggcttcaaggacgccgtcaccatccgcgccaccatgggcatg

SEQ ID NO: 47878 - DNA, 281 bp, Zea mays
  Clone ID: LIB3066-028-Q1-K1-G10
cgagaaggcaagccgaggcggagccggaacgggaaggcgccgaagcgttcgcggtcgcggcttcgcgatttcggcaggaggatcgcctttgagagcttgcgctgggtggtggtggtggagcggcggcgaagatgactgcgccgcgcggtggcggagatgagccgccggcgttttcggctgcggcggtgcacgcctcggggaacgagccaatgacgccgacttccgcgctcgagtcgggacttaaccgacccggttcgaggggtgcgggcatggccaccttt

SEQ ID NO: 47879 - DNA, 435 bp, Zea mays
  Clone ID: LIB3066-028-Q1-K1-G11
gtgggaattgatcggactttcttctcaacgcctcaacccaacccaccgaccagcccgaccggggggcggggggcgatggaagcggcgggcaacgaccggagggaggcggcgctaggcgccctctccgtgctccctgacgaggtgctctgcgccgtcgtcgacatcctctcgcccgctgacatcggacgcctcgcgtgcgtcagcagtgtcatgtacatactttgtaatgaagaacctctctggatgagcaaatgtctttcaatcgggggtcctcttgaatacaaagtttcctggaagaagacggcactatgtaggcttggtctatgttcagaaaataaggagatttggcagaagcctcgtcagttcgatggctttaattctttgtatctataccggagatggtatagatgttttactactttgaatagtttttcg

SEQ ID NO: 47880 - DNA, 383 bp, Zea mays
  Clone ID: LIB3066-028-Q1-K1-G12
ccgccccccgcaggagcacggagcggtacccgtcgcggctgtccagcgggtcggacggcgtggaccagcagcagcagcacagcttcgaggcgtcgcgcacgcccagccggtggggcgactcgttcggcaacgacagcacgtcgcactcccagaccagcacctcctcatggtgctcgcagcctccggacgagatggaggcggagatgaagcggctgcggctggagctgaagcagaccatggacatgtacagcacggcgtgcaaggaggcgctgagcgcgaagcagaaggcgctggagctgcagcgctggaagatggacgaggagcagcggtcgcaagagacgcggctgacggaggagtcggccatggcgctcatcgagcaggag

SEQ ID NO: 47881 - DNA, 216 bp, Zea mays
  Clone ID: LIB3066-028-Q1-K1-G2
cggacgcgtgggcggacgcgtggggactatgtcgagtaaattacagtttcaaatcgacatggcttagtcatttgagcagtgttgaatggaatctgaccacagaaatatatctgactagatataataacagttgtagacatggtacaaaacacacgaaccactgttcccgactgtttaaatatcccaaataatacgaaccactggacactcgcgttt

SEQ ID NO: 47882 - DNA, 377 bp, Zea mays
  Clone ID: LIB3066-028-Q1-K1-G3
cactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgtcgtcgacaacgacctccccgactacgtcatccagggccgcgtctactgcgacacctgccgcgccgggttcgtgaccaatgtcaccgagtacatcgcgggcgccaaggtgaagctggagtgcaagcacttcggcaccggcaagctcgagcgctccatcgacggggtgaccgacgcgaacggcacgtacacgatccagctcaaggacagccacgaggaggaca

SEQ ID NO: 47883 - DNA, 447 bp, Zea mays
  unsure at all n locations
  Clone ID: LIB3066-028-Q1-K1-G5
cccacgcgtccgcccacgcgtccgcccacgcgtccgctttgttcttttgagtcacagggattgaccattgttgatatctcagcaaattcgtttcctcaaacattagattggcttcacagctatcttcttcagtgcatcgagcgaggtcttttggctgcgtgtttagaaagctgcaatcaaggtcaatgacactcttggatgtaacctgtccaaccacacctcagtgggcattatatgctggcaatggacactaagaatatcattgtaaaggattacgcatgagtctggatatcatctncaaccaagaccgatgtgaaaataccatcgtgatgttgtcaataccagccataagcgtgggtctgtctgattggggttactcgcattaatattgtactggatggtattagaggntatgccgcatactcataatctgaatangataacaaa

SEQ ID NO: 47884 - DNA, 450 bp, Zea mays
  Clone ID: LIB3066-028-Q1-K1-G6
cccacgcgtccgcccccttgcaagtatagtctcggcggctctagaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcatgatcttcggcctcgtctactgcaccgtcggcatctcggggggccacatcaacctcgccggcaccttcggcctctcgctggcgcgcagggtctccctggtgcgcgcgctgctctaca

SEQ ID NO: 47885 - DNA, 467 bp, Zea mays
  unsure at all n locations
  Clone ID: LIB3066-028-Q1-K1-G8
atgagtactgggtgatatcgccgccggcgctgctgcaccagccggcgtccaccatcgtcgtggccatcgaccgggaccggaacagccaactggccgtgaagtgggtggtggaccacctcctctccggcgcctctcaaatcgtcctcctccacgtggccgtccattaccacacgacccatgggttcgccatggttgagaccacgcagggtgcgctggaggctgaaatgaaggagatctttgtcccctacagaggattcttcaaccggaatggggtaaatgtggaagtatccgaggtagtattggaagaagcagacgtgtccaaagccattctaggttacatcactgcanacaagatccagagcattgcgctcggcggagccaacagaaatgcgttcaccaagaaattcaagaacgcggacgtgccgtcgaccctgattgagtgcgcttcagactactgcaacatctac

SEQ ID NO: 47886 - DNA, 434 bp, Zea mays
  Clone ID: LIB3066-028-Q1-K1-G9
gtttgagctttcatcgtcactaaattctttttccccttgctcttgcacttagtgaggtggtggcttcgaaatttgaatgcctcatttttattcttctcatcttctctgtctttctcatccctttccacatgtgtgactactgactacatcacctaatacttaggttgaggttactccttttagccctgcctctcacaatgattgtgactagagtgtcaaatcttggaggcaagcaccttaagaacccagcatattttgctctcttgtgtgttctctagaaacatttggtggcaggtgtggtgtaaagtggggctgcattacctggcacctgggcctgagaacatgattttccaagattggtggagcaatgccgaaggccaggtttttaaagagaagagaaaaggttttaacacgttggtaatcctcgtggcttg

SEQ ID NO: 47887 - DNA, 402 bp, Zea mays
  Clone ID: LIB3066-028-Q1-K1-H1
gcgtacattaagcagagaggctatgacctttacgacgtgaaggcttatggacagatgctggaggatgctggttttcataatgtcatcgcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcatgagggctcttcggaataagaatggatgtggctcttactctgctgctagaccagtgatgggtcagcttagaagcaggggatcttcatcatcagaataaaacgtgtgtt

SEQ ID NO: 47888 - DNA, 283 bp, Zea mays
  Clone ID: LIB3066-028-Q1-K1-F5
aggacgcgtgggcggactcgtgggcggactcgtgggcggacgcgtgggcggacgcgtgggcggactcttgggcagacgcgtgggcatcagccaagtgtaaagagtgcgaagaagcagtagcaaaaggattccattctcgagttcttggagtggtacatcgatcgagctgcgtgaaagatagagagagagagcttgctatggttacagcaggtaaggtgatcaagtgcagagccagtgtggcataggacgccggcaaaccgctgtccatcgaggaggtcgaggt

SEQ ID NO: 47889 - DNA, 358 bp, Zea mays
  Clone ID: LIB3066-028-Q1-K1-D8
cccgaaacaaaagaagctattttgacaccacacacacacacacagaggagagacgataagagaacgaggggcagggcagccagcgccgctagctgaagcaaggcagggcaagagaatccgtacgtcgaggtgcaggtcgtaggtaggatggacgcggaccagcagggcgtggttgcggcggcggtgaagccggcgctggccaaggggacgccgtcggcgtcgttccggctacgcaacgggagcctgaacgcggtgcgcctgcgacgagtgttcgacctgttcgaccgcaacggggacggcgagatcaccgtggactagctgtcgcaggcgctggatgcgctgggcctggacgccgacc

SEQ ID NO: 47890 - DNA, 343 bp, Zea mays
  Clone ID: LIB3066-028-Q1-K1-E1
cgatccatcttgggcgggcgccgcgcgtcttgggccagccaaagcttgccatggcggccgggcggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgtccggtgccggggctgccgccttctcagcgctgcgaaagctaccttcacatcagggagca

SEQ ID NO: 47891 - DNA, 433 bp, Zea mays
  Clone ID: LIB3066-028-Q1-K1-E11
ggaccgatcaccgcacgccggtgtgcgcgtgcgtctggcgcacggccggcgtcctcctcccaacgcgccggaaataggcaggcggtgcatgcatgagcaggaagaggagagaaggaggcggcggcggaagaggcgctgggccggtggaccatcacggcggcggcaaggggtcggaggccggcgctgccgccaccgatgccgtgtccatggacggcggcctccgcgaggtgtctgtccccgtcgtcttctcggtttggtgcctcctcttcctcctgcgatcccagttcctccacagccaggccgacgacgacccttcgtcagagttctacgaggagcacggcatgcgcgacagctactgcaaggtgaggccgttggaggcctacgtgctcccctaccataacgactcgtgtcagtcctcctactcgcactcaca

SEQ ID NO: 47892 - DNA, 376 bp, Zea mays
  Clone ID: LIB3066-028-Q1-K1-E2
cccacgcgtccgcaccactctcgcagggctgtaccggtaccgtctaggggacgtggtgcaggtggccgggttctacaactcgacgccgaagctcaagttcgtgtgccggcggaacctgttgctgagcattaacatcgacaagagcagcgagcaggacctgcagctggcggtggacagcgcggccaaggtcctggcggcggagaagctggaggtggtggactacagcagccacgcggaggtgtcgcgcgacccgggccactacgtggtgttctgggagctgaacgccgacgccggcgacgacgtgctgcagagctgctgcgacgagctggaccgcgccttcgcggacccgggctacgtcgggtcgcggagggcgcgc

SEQ ID NO: 47893 - DNA, 277 bp, Zea mays
  Clone ID: LIB3066-028-Q1-K1-E3
gggggtgtaggcgggggcggcggccttggtacaggtggaggaggtggctttggaggtgggaaaggtggtggacttggcggaggtggtggccttggcagtggaggtggtgcaggcgtaggcggtggtcttggagggggtgccggtggaggcggcgaccttggaggtgggaaaggtggtggccttggtggagggggtggcctcggctgcgcgcgcgctcctctcttcggcgctctcgtaccgcctcgtcgcgtccaagccctactctttcttccccacg

SEQ ID NO: 47894 - DNA, 392 bp, Zea mays
  Clone ID: LIB3066-028-Q1-K1-E4
gtccctgtcgtcctcgcccggtttccccggtttttgagaggggaaagaggaggcggaggagagggatggggagggacgagaggttcccggtgtgggaggccgcgctcggcgccggagtcgccgccgccttcgccgctggactcgtcggtgtctacctttccatgccggactccgactacagcttcctcaagttgccacgtaatctcgaggaactccaaatcctcactggccatcttgagaactatactagtgactacaccctacaggtgttggtaggttattgcgctgtgtacatcttcatgcagaccttcatgatcccaggggcaatattcatgtcactgcttgctggggctctatttgggcaactgcgtggccttgcactggtgggtctt

SEQ ID NO: 47895 - DNA, 384 bp, Zea mays
  Clone ID: LIB3066-028-Q1-K1-E5
gattcaactgatgatttagtgaacgttgattttatatcacctgcctttcctattggtggtgtaacagaatcatcaattagcaattcagttgctgagaattcttcaattaatggcactccaaggttagtttctgcaatgaaaggaactcgtgcgaagaagggaatcaaaacaaagctgagcgtttcatgggccactgatgtatatgacccacctattacttcagactcgcacattgtgaaagggcaccgtaagagttcaactaagggtaactacaaatacaagtgttccaagagcagcagtagcagtaaccacagtaccactggaagcaaaaaggacaagaagcattctaggcaccgtagcaacaatgagggtggcaacaaaagg

SEQ ID NO: 47896 - DNA, 379 bp, Zea mays
  Clone ID: LIB3066-028-Q1-K1-E6
ggattccatccacaccgtcgtgcaccacttttccccgcacccaccacgcggcgccgcccgagcacgaccatggcgtcgccgtccatccccgccgctctccgccacccgcacctccccgccgatggaggacttcttttccactcgtccggcgacccaaccgcgcgctcctcgctctcgttcaggataggagacatgacaatgagaaggtgtcagacaggtcctggtcctgttttggctgcaaggagtcctggtttgggcaacgttgacaatctccatgagagttcaagcttatctaggagctgggatttgaacagacagattgatgatgaccgtgatgtactcatagaatgtagagatgtccataagtcatttggagaga

SEQ ID NO: 47897 - DNA, 301 bp, Zea mays
  Clone ID: LIB3066-028-Q1-K1-E7
cccacgcgtccgcggacgcgtggtgccccttctctcaccgccacatccgtcctgaggcgaggccacctacccggcgtccactcgttggccggtcgccggcagccggggcgggaccgcgtctcggtgctttctccagcgatcccgccgccccgcgtttcatggcgtaagtcctccagtctgatctaaaagacccccaatcttatgctgctgtactgcgtgaattacatattggcgatatcgcctttgtgtcaagagaacagtgcttgggttttggggttcaacaatggagcagggatctgga

SEQ ID NO: 47898 - DNA, 446 bp, Zea mays
  Clone ID: LIB3066-028-Q1-K1-E8
attccaatcaatcggaccgacaccggctaaccctagcttctgtttggctgttgccttgcgggtggcggctgctttggtgcgctgcgcagtgcgctccgtccgtccgtcgaccggaaggccgtcccctggcccctgctcgtcgtcttcctcgggcgctcgtcttcctccgaacgcgcgcgggccgccgacctgcttgttctcctggaggagcgcgcccggcgggcaggcgacgcagtccagcggcgggttgaggaagaaggcgagcgaccggtggatccccgtccagccgtcccctgctcctcttcctcgggtcgggcgctcgtcatccactcttcctccagccctccatctgatccccgtacgaccgtgccctgctcgtcttcctggtgctcgggtgctccagtgctcggcccctgctgcagtgctgctcggacgcgtcggcacct

SEQ ID NO: 47899 - DNA, 439 bp, Zea mays
  Clone ID: LIB3066-028-Q1-K1-E9
cccacgcgtccgcccacgcgtccgcccacgcgtccgatcactacgttctgcaaaacggtgttctagaagagcaccagctagggagcagaataatgaacatactcagagtgagcagcttcatggttctgcaagtgagcagcaagctagagagcaacttcatggttctgtaagtaaacagcaaactgaagttcttcgctccaatgtcagcagtggcgatgcctcaaaatgtcattttggccctatagttactcagaagctgaaggaacattttgaaaaagatccatatccttgccgtgcaacaaaagagggtctggcacaagagctaggactgacatttaatcagatcagtaagtggttctctgccacccatcattattcaagagatgctgttgccaagaaccaaaaatacccaggagaaaatactactgagaataatagt

SEQ ID NO: 47900 - DNA, 436 bp, Zea mays
  Clone ID: LIB3066-028-Q1-K1-F10
gttctagatcgcgagcggccgctcgcgccacgtacgtacggtggtcacatcgctgtcgaccgcgcgcgttgggagcgcatccggccgtgtgcattagccgcccatggacgacacggagagagaaaaggagaaggagaaggagaaggagaaggagaagcacgactgcgggacggacgtcgaggacgaagaagaggacgaggaaggcaacaagcgcgtcgtcgtgcttggcccccaggtccccctcaaggaacagctcgagctcgacaaggacgatgagagcctgaggaggtggaaggagcagctccttgggcaggtcgacaccgagcagctaggagaaactgcggagccagaggtcacggtgctggacctgacgatcctgtcgccgggcaagccggacctggtccttcccatcccgttccaggcggacgacaagggc

SEQ ID NO: 47901 - DNA, 434 bp, Zea mays
  Clone ID: LIB3066-028-Q1-K1-F11
cccacgcgtccgcccacgcgtccggcatcgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtc

SEQ ID NO: 47902 - DNA, 435 bp, Zea mays
  Clone ID: LIB3066-028-Q1-K1-F12
acgccgccgtccacagagctgtcagcagcagtcggcgtgagatgcgggagaggccgaggaagcacaagaagaggggcccgtgccgggcgacgaaccctatcgacaagtgctggcgctgccgcagagactgggcgacggaccggcagcgcctggcccgttgcgccagaggcttcgggcacgcgaccaccggcggcctcggcggcaagatctacgtggtgaccgaccccaccgacctcgacgtggtgaacccgcgccccggcacgctgcgctggggcgtcatccagcccggcccgctgtggatcatcttcgcgcggtccatgatcatccagctctcgcaagagctgctcatgagcagcgacaagaccatcgacgggcgcggcgcgcaagtgcacatcgccaacggcgccgggatcacggtgcagctggcgcaaaacg

SEQ ID NO: 47903 - DNA, 391 bp, Zea mays
  Clone ID: LIB3066-028-Q1-K1-F2
ctccctctccgtcccccaagcaaagaaaagaagctagctagctaggcgtagaacgaatgacgacgcagggcggcaacaggtcgacgacgacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaggtggtgtgccggcacttcggcgcgtccaaggagacgctcaaggcggaggcgacgacggacgacagcgggtggtacaagctggagatcgaccaggaccaccaggaggagatctgcgaggtggtgct

SEQ ID NO: 47904 - DNA, 356 bp, Zea mays
  Clone ID: LIB3066-028-Q1-K1-F3
caagacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggtcacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagccctgtgagtgc

SEQ ID NO: 47905 - DNA, 107 bp, Zea mays
  Clone ID: LIB3066-028-Q1-K1-D7
gtagcaaaccaatcaaaaagaattgctacttctgtgaatgatttctgggcactagtggagcttttgaatggcaacttcccagggactacctttgtgagtccccactg

SEQ ID NO: 47906 - DNA, 425 bp, Zea mays
  Clone ID: LIB3066-013-Q1-K1-C10
ggattcttgccagtggtgtgcatgttgttgtgggcacaccatgacgtgtgtttgatatggtgcgcaagcagtctctgcgtcccgacaacatcaagatgttcgtgttggatgaggctgatgagatgctctcccgtggattcaaggatcatatctatgatatcttccagcttcttccatccaagattcaggtcggagtcttctcagctaccatgccccctgaggcccttgagatcacgcgcaagttcatgaacaaacctgtgaggattctcgtcaagagagatgagctcacccttgagggtatcaagcaattctatgtcaatatctacaagaacattggaagctcgacactctgtgtgacctgtatgagaccctggcaatcacccagagtgtcatctttgtgaacacacgccgcatggtggactggc

SEQ ID NO: 47907 - DNA, 421 bp, Zea mays
  Clone ID: LIB3066-013-Q1-K1-C12
agctcgtttgattctgattgccagtacttattttaacagtaaaacctttgtctattgagcggttcaaccttcgtattcggaatctcgacctgtcacataaattaccacaacaatatctggctatcctctatcaagcctttattgtgacgatgctttctcatccttatatatctacttttactattattgttatccataactcatctactgttacatttgtcacccaccaatttagaaccaaatctccgtatacacctttgtcacacatgttagatttacattactgctcacctgaccctgatagttatagcgcttaatactccaggatatcgacgcgaacggcacgtacacgatcgagctcaaggacagccacgaggaggacatctgcgaggtggtcttggtggaaagcccgcgcaaggac

SEQ ID NO: 47908 - DNA, 281 bp, Zea mays
  Clone ID: LIB3066-013-Q1-K1-C2
cccacgcgtccgctaagatgaagaagggtgttcgcattataaatgttgcacgtggtggcgtaattgatgaagaagctctagtcagggcacttgattcaggggtagtagcacaggctgctcttgatgttttcactaaagaacccccagcagctgacaacaagttggtactgcacgggaatgttactgtcacacctgaccttggtgccagcacagtggaagcacaagaaggggtggctattgagatagctgaagctgtcattggagctctgaaaggggagctt

SEQ ID NO: 47909 - DNA, 58 bp, Zea mays
  Clone ID: LIB3066-013-Q1-K1-C3
aatcaaaaaaaaataaaataaaaaaaaaaataaaattaaaaaaaagacacacgtaata

SEQ ID NO: 47910 - DNA, 333 bp, Zea mays
  unsure at all n locations
  Clone ID: LIB3066-013-Q1-K1-C4
cgtagctaagcacttcacaggttatggcgcagcctccactgggaccaggttctgggcaagcgctgttctgatcaatgccatctttcgagctgtacctgtcgcaccggaatcagtatggctagaaggtgcaggcctnctggagaaactgcatgccacagagattttgaagaggttctatcagcaggcggcatcggtctatcccttctccttcaagctgtggcacgcccatctgaattactgcaaagccagtgggagcaacactgagagcatcctggaaagtgcgaagcaacgtggcatcgagcctaatctgacaccaacataatgggtcccttg

SEQ ID NO: 47911 - DNA, 370 bp, Zea mays
  Clone ID: LIB3066-013-Q1-K1-C5
gcggcagagagcgctccgccgcacctgctcctgatatgcttcccggggcagggccacgtgaacccgatgctccgcctggccaagcgcatcgcggccaagggcctcctggtgaccttctcctcgatctccagagtcggggcgatgctcgccgcgtccgtgggcgtgtcggccggcggtgacggcgtgcctgtgggccggggccgcgtccggttcgagttcatggacgatgaagaccccgggcctgacctggacgacctcttgcggcacctcgcgaaagacggcccgccggcgtttgccgagctgctggaacggcaagcggacgccgggcggcctgtggcgtgcgtggtggtaaacccgttcatgccgtggg

SEQ ID NO: 47912 - DNA, 290 bp, Zea mays
  Clone ID: LIB3066-013-Q1-K1-C6
cccacgcgtacgactaatcaaattcttgttgggatatattcctccaattcccctcctgctggcaacatggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgtcgcggcgaccgtcgcgccccgcacccctagccctgctgcg

SEQ ID NO: 47913 - DNA, 372 bp, Zea mays
  Clone ID: LIB3066-013-Q1-K1-C7
cccacgcgtccggcgcaacgtgtgtggaagatggcacggtaaaccaggaaccgatggccggttcgaccgccattgccgatcggaggatgaacaccagcacctaagaagatgtgagagaccgagggagagagaataagaacgccctgtgcggatctccctcaaacgcgagacgctgggatggatgacctcggggccgcgccgctcgcaaattttggcccgcgccttgggaatttctcgccatcgaagttaaatccgccgtagatccgttttcgccgtggccagaggattccgcgccgctaagcttgagaacgagttggtcgaagaacccgaagaactcgcaagagaagcccctgagcagcaatcggttggtgg

SEQ ID NO: 47914 - DNA, 309 bp, Zea mays
  Clone ID: LIB3066-013-Q1-K1-C9
gccacgcgtgcggccacgcgtgcggttgcattctagcagcatagcaaagaggatcggatcagaagaaaagaatagttgcggtcccggaggtcgatcgaacgaagctgctgctgcataccggccggccggtacatgacgatgacacggacgatgtgcctaggcctgctgcttctactactggcggccgcgtccacagccacggtgcatgtgacggtcggcgatgtggatgagtacgtgtccaagcgcacgcaggagtccagccacaagaacaacggtcgcgcggccatcgatgacctcatctccagtgcg

SEQ ID NO: 47915 - DNA, 351 bp, Zea mays
  Clone ID: LIB3066-013-Q1-K1-D10
gtagctgagaaggtggtggtggaggagccggctgcggcggccgacgttgagcatcagaggggtaatgaggtgctcgctccagaggcggccgtcgccgagcccgaccacaaggaggaggaagccgtggagaagaccgtcttcgaggacgagaagccagcggcagcagcccatgcagaggaaaaggtcgccaccgccgccgagaccacgactacggtggaggcgaagaagaacgccgaggaggccgcgaaggagaagctggcgcagcaaagctgatcgactgtccgtgcatgcgtgccaattaatataattggctgatgatgcctgatgttcaagtgatactattatcgatca

SEQ ID NO: 47916 - DNA, 460 bp, Zea mays
  Clone ID: LIB3066-013-Q1-K1-D11
cacccagcctagctgcgccacgctggcacgctccatgccaaggacagcagctaggctgggtggtcggcccgtcgtgctctgcttcgcgctcgtcatcacccacgtctccgcggccctgttcgcctagccaacggctaccggcgcggaaaccccaagaggggcaacggacccgcgatttaatccaggggtcgggatatccttcctactaattagagcatttattaaattaaagtgaccaatcagttaatctctggcctggaccttagagctaagacactatattttggtcaggatccatgcctggatttttttacacatttaatccttagacactttaaaacataacttaagacactcattatacatgccctaaatggacgccataaatggacgccatctacgtgtacctcggtatactataccgctacgccatataaacgtatacctgccgtctcactac

SEQ ID NO: 47917 - DNA, 87 bp, Zea mays
  Clone ID: LIB3066-013-Q1-K1-D12
gccagacgagtgccccgctgacacgcttgatgcattatagcagctctctgggggggatgacgagctgctgtgcatgcgcacgtcatg

SEQ ID NO: 47918 - DNA, 341 bp, Zea mays
  Clone ID: LIB3066-013-Q1-K1-D2
cccacgcgtccgcccacgcgtccgcccacgcgtccggacaaaatcagagattttgcagaatgtagcggagttccagttttcttgtgtcctgtacaatggtgccctagagaatgcatgcagtgagcttggagcccgtatgtctgccatggacagctctagcagaaatgctggcgatatgcttgatcgtctcactcttacttacaacaggacacgccaagcatccatcaccacagagcttactgagaatatatctggtgcatcggcccttgaggggtagtgaaaaaactgcggacttcttccttttgccggatgtgtttcttttccatgaaagctttttccct

SEQ ID NO: 47919 - DNA, 150 bp, Zea mays
  Clone ID: LIB3066-013-Q1-K1-D3
gcgaggacgcgccgccagttgttgcggagaccgctgacgccaccaccaccactgaggtcgaggtggacgtggagtcctgcaagaaaggagctgcgccggtgccatagcccatcgatgcttgcgacgcagaggacgacctggtggcggaca

SEQ ID NO: 47920 - DNA, 313 bp, Zea mays
  Clone ID: LIB3066-013-Q1-K1-D4
ggcggcaggcgtcaaggacacggtggcgggcgcggcggttggcgtcacgaacacggtggcgggcgtggcggcgggcgtcacgaacacggtcacgggcgccgtggcgggcgtcacgaacacggtgaccggcgcggcggcgggtgtcaaggacaccgtgaccggcggccactgatcgacgacccaagaatgcttcatgcatggccaagtgttgagggtttgaggccaaagatggcttgaatttccgtccttttttgctttattttttgacattattgttttaacatgtttcattcacccgtctctgattgggatt

SEQ ID NO: 47921 - DNA, 320 bp, Zea mays
  unsure at all n locations
  Clone ID: LIB3066-013-Q1-K1-C1
gngctcgactcgggaganggngncagccacacngtccccancnacgaggganacgcccncccccgcgccanccaacgncncgaccnggctggccgcgaccacaccgactaccgcaagaagagccagacagaacgctgttactccttcaccaccactgctgagcgggaaattgtcagggacatgaaggagaagctcgcctacattgccctggactgcgaccaggagatggagactgccaagaccagctcttctgttgagaagagctacgagctgcctgacggacaggtcatcaccattggtgctgagcgctttcgctgccc

SEQ ID NO: 47922 - DNA, 391 bp, Zea mays
  Clone ID: LIB3066-013-Q1-K1-D6
ccacgcgtccgtctcgctccgttccggcgctctcggtcgggcgaaggctccaccttcctcggacaagatggcggggaagggagccaaggccacggccgccaagtcggcggacaaggacaaggggaagaagaccggcggccccgtctcgcgctcctcccgcgccgcaccccaggagaagtcagctccgaagaaagatgtttatcaattgttcgctgagaaggtcagggataacaaacaactggaatcaagatgggcgatcatgcaagaaacccgcgtggagtatttccgtggaaaagatttcaataccttcgtcaagaatcatccagaagtcagggaaattttggggccagataaggatttataggtggaagacattggtaacactttgctg

SEQ ID NO: 47923 - DNA, 397 bp, Zea mays
  unsure at all n locations
  Clone ID: LIB3066-013-Q1-K1-D8
ctgactcgnctccctgctcgtctacagcgacggcgaaggcgaagcggaggagcgggagcgggaacagaagaggcagccatggccgtgatggagaagctcaagatcttcgttgtgaaggagcctgttgtcgcagcttcctgtctcatcgccggattcggtctctttcttccagcagttgtccggccaatcctggattcatgggagaccgcagaaaaagttcctacaccacctctaaatgatgtggttgcgggtgtcaccggcaagaaaaagtagtgaacttgcattggtttctcatgtcgatgctggcccacattttcttacccatgttttttctggcgtttaatattggaaaggtcttcaaaggcacggttttcaaagtgacacattggttgaattt

SEQ ID NO: 47924 - DNA, 388 bp, Zea mays
  Clone ID: LIB3066-013-Q1-K1-D9
gtcctgcgtcaccctccattaaccgtagcggcagcagcgctcgtttgatccccgcggcgggggggcgtccgggtcggggagcgaggatgacggagtccctggtgcggaacaagccggggatggccagcatcaatgagatgccggtgctgcatgacgggccgccgacgggcggtttcgcgcacgtgcgctacgcgcgccggattcccacctagggccccagcgccactgccatcttcctcacggtcttcggcgccttcacgtatggcatgtactcatgtcggtcaagggaacaaggtgcgccggacactcaaagaagagaaaattgctgctcgatgctatactgccgatgctccaagctgaagaggatgaaagatctgtcaaagagtgg

SEQ ID NO: 47925 - DNA, 367 bp, Zea mays
  Clone ID: LIB3066-013-Q1-K1-A12
cccacgcgtccgcccacgcgtccgcccactcgtccgcccacgcgttcgcgcacgcgtggggggtgctgagctctccaagctcgctcgcaacgcgttcctggcacataagatctcctctgtgaacgccatctccagccctctgcgacgccaccggcgcgaatgtgactgacgtggcttacgccgagggcaaggacactaggattggccccaatttcctgaacaccagtgtcgggttcggtgggtcttgcttccagaatgacatcctgaacctgaagtacatctgctagttcaatggcctgcccgacgtggccaactactgcaagcaggtgatcgatcaaccactaccataacagcctcttcaataacc

SEQ ID NO: 47926 - DNA, 342 bp, Zea mays
  Clone ID: LIB3066-013-Q1-K1-A2
cggacgcgtgggcggacgcgtgggtagagctggtgttgaaataagaactcttttgaacatacgagtcacataatattgtagggtctttgcaaaaatcttgatgtggtgtggcagctcagtttccttggtacacgctctgatacatagaaagacagtcataagaatccttatgatccatctcacagattgctccaggtatgccagtgggatggataatacaatttggctgacagctatttcatcggaacagtccgatatcctccgaaagaagaacaaaagaacaaaaggcattgctcaattttatagagtagtcaatccattcagttctatcaagagaattag

SEQ ID NO: 47927 - DNA, 322 bp, Zea mays
  Clone ID: LIB3066-013-Q1-K1-A5
cggacgcgtgggcgagagaggaacgcgaacaaccaacgatcgcctcatcgccatggctcggtctgtccccatcgccgtcgccgtcgcgcctctgctcctgctcctcctcgtctccactgcgtccgctgcacggaccgtgggcgacaccgtgcaggacgcgtgcagcaagacacaattccccaagatctgcgtggacagcctcgccgcaaagccagagagccagaaggcgaccccgcgccggctggcggagctgttcgtgaacatcgcggccgagaagggatccgggatggccacgttcgtgcacgggaagtacaacaacgcc

SEQ ID NO: 47928 - DNA, 161 bp, Zea mays
  Clone ID: LIB3066-013-Q1-K1-A6
cggacgcgtgggttgtggctgaattccttggtcctaggacacggtgatgacaaagtgtgcgagaagttcatagtgtaccagtctgtgctttggagttattggtctcttgtatcttcgggatgtcgcagacccaaaggttctttggatggggtatgagccct

SEQ ID NO: 47929 - DNA, 395 bp, Zea mays
  Clone ID: LIB3066-013-Q1-K1-A7
tccatttccggctttccgccaccaccccccctctctctctctcttcttcttcttcaatcctgcctcctcgcgctggagttggagggagaggggacaagctttccggcgccgacgccgacgcggacccggcgccgacacgatccggtggatcaagtgcatcacacctttagggaggccccttggacagcagtttgtgctgcaaattctatatagctctgtcgcagcatggcctcggtgggcgtggcacgctcttctttgggatttcagaatggcacaagttctagcagtgacccagatcgtcttcccaacgagttgggcagtatgagcataagggacgacaaggacgttgaagatattgtagtcaatggcaatggggcggaacctggtcatatcat

SEQ ID NO: 47930 - DNA, 350 bp, Zea mays
  Clone ID: LIB3066-013-Q1-K1-A8
cgcaacaaaggatgggacaggggttcgtgattatattcatgtggttgaccttgctgaaggagatcttttcgcattaaagaagctttttgaaagctcatctaacataggatgtgaggcgtacaaccttggaactggaaaaggaacatcagtgttggagatagtcaatgcatttgagaaggcttctggaaagaaaatccctttggtcatgggtcaacggcgtcctggtgatgctgaggttcttttttcatcgccggcaaaagcggagagagagctgcactggaaagcaaaatatggcatcacagaaatgtgcagagacctgtggaactgggctagcaagaacccttattgat

SEQ ID NO: 47931 - DNA, 444 bp, Zea mays
  Clone ID: LIB3066-013-Q1-K1-A9
gttgtccctagagaggaagcaaaggcacatgaccgtcgtctccgggtgggacgacgagtccggactgctctatgcgatggtcgttgaggccacgcccgtctgtgagtcccgtcgcacgaggcgagcctccacctgctccaacaatgacggcgccggatccaacaccaaatacggtgatacggttgacagaccaccaaggatccaccttcctacaatggtgtggtgcagatacaacaacatggtctacacagcagtgcctgtaacgcacggaacgacaaaggcagacgccacagagtatcattgacgaaatcatgtctctgttattaaatggttcccgcacatctgctttgagctgatcaccacgccttgtggacacaggcactgtgttcgaggagcctattatatgcacaaacattccaagacttgttctaggatggactaata

SEQ ID NO: 47932 - DNA, 406 bp, Zea mays
  Clone ID: LIB3066-013-Q1-K1-B1
cccacgcgtccgggggtgcgcgacgttctgggtcggggaggaaggggaggccccgcggcgggtggcggtgcccgtggcgcgcctgggccacccgcgaatgctggagctgctcggggaggccagggaggagtacggcttcgcgcaccagggcgccgtcgtcgtcccgtgcgccgtcgagcggttcatgcgggcggtggaagcctcggcgtcggcggggaacaggcacgagcaccaccgtcacggacaccatcaccaccactttcgcctgcctcatattcacatcgcccggtgctttagaccgtcgcacgtcgttgcttaggattcacgtcgagcgcgcgcgagtagcaaaaaaatttcattttcctttttgtttggaagtggcaagaattctggttttttttcttct

SEQ ID NO: 47933 - DNA, 430 bp, Zea mays
  Clone ID: LIB3066-013-Q1-K1-B10
ggggcgggtgcgggtgaggggcaggtcgatgtcctcaagaaggcggaaacccgcatcgatgagctcaagcagcgtgcccaccgtcaaggactcgcaggccatctgcgacctcgtctactcgctcttcgtctccgaggaggtggacaaggtggagctgctctactccaagttcgtgtcgctggtgcgctccgaccccatcatccagacgctgctccccatgtcgcccaagggcgagatctgcgacgtcaacggcgtctgcgtggacgccacggaggacgagctcttccgcttcaccaccaaggaggggaagctcaccgtggagcgcgagaaggaagatcgagacgcagcccttctcccccgtggtgcagttcgagcaggaccccgtgcagatcctggacgcgctgctcccgctctacctcaacagccagat

SEQ ID NO: 47934 - DNA, 392 bp, Zea mays
  Clone ID: LIB3066-013-Q1-K1-B11
cccacgcgtccggagccagcccatgcttcggagtcaccagcagagtctcctggcccggccgctgaccacgagagcggcagcccgagcatgggcaccggtgtcgtcctggccatgctggccgccgctgccaccgtgatgcttcctttctagatgaccatggtggctttgagctaacatcatagtcacagagcagcaattcttctgggaatctgtgttctcatggtcatgcatgggaatgggagtcgatatgactacgcttattaggagtttatgaatttctcctcaagatatctaggcctttgtttcatcctttgggactggttggttaacttttgcatgtttttcttcgtttgtaatttgaatgacaatcaatgaatttattgtgtagttgt

SEQ ID NO: 47935 - DNA, 437 bp, Zea mays
  Clone ID: LIB3066-013-Q1-K1-B12
ctcaagccagacatcacggcgccgggggtgaacgtcatcgcggcgtggagtggcgcgacggcgcccacggacaagtcgttcgacaagcggcgagtggcgttcaacatcctctccggcacgtccatgtcgtgcccgcacgtctccggcgtcgctggcctgatcaagaccctccacccggactggagccccgccgcgatcaagtcggcgatcatgacaagcgcgacggtgctggacgcggagatgaagccgatcctgaactcgtcctacgccccggcgacgccgttcagctacggcgccggccacgtgttcccgagccgcgcgctggacccagctcgtgtacgacatgaggacgatgaacaggggatcgttcgtgtgcccgaccacccccatgagcctacacgacctcaattacccatcaatcactgcgcacggtcttt

SEQ ID NO: 47936 - DNA, 276 bp, Zea mays
  Clone ID: LIB3066-013-Q1-K1-B2
cgcacagcgatgcacaagcacgagataccagccaccatgcgcctgtccctcctcctcgtcgtcgtggccgccctctcggcgcgcaccgcggcgcagctgccgctggcgggcggcggctgctgcgccctgaagccggacttctatagccagtcgtgcccgcgcgcggagcggatcattgcggaggtgatgcagactaagcagatggcgaacccgacgactgccgctggcctgcttcgcgtttcttacacgactgcttcgtcagccggtgcgactcgt

SEQ ID NO: 47937 - DNA, 350 bp, Zea mays
  Clone ID: LIB3066-013-Q1-K1-B3
cctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggatgcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaatggcatcac

SEQ ID NO: 47938 - DNA, 236 bp, Zea mays
  Clone ID: LIB3066-013-Q1-K1-B4
cggacgcgtgggcggacgcgtgggttcagctgtctcaaggttgaaacatgagaatgttgtccaagtcgtcggatactgcgccgaatggagcacccgcgttcttgcttatgagtatgcaactaggggatcattgcatgatatcctccatggtaaaaagggtgtcaaaggagcccagccagggccagtcctgtcatggatgcaacgagctaggattgccgtatgtgctgctcgaggtc

SEQ ID NO: 47939 - DNA, 288 bp, Zea mays
  Clone ID: LIB3066-013-Q1-K1-B6
ggaacagtgaatgatttacaaagccgctgcgttccttattggacccgtccagttcgatcggttcgtccacgctaccttgtttctttgcgccatggaggccacgaggaagcccgcggtgtgccgtgcccttcttgtgctgctcatcgtcgtctccagcgcggcggtgtcgactgcccaggacgagagctgctggaaggacgacgaccaccaccctatctgcttgcccgaggactgcgtggcgacctgccgggatcacggccacgcggacggccgcttcaactgggcatg

SEQ ID NO: 47940 - DNA, 374 bp, Zea mays
  unsure at all n locations
  Clone ID: LIB3066-013-Q1-K1-B7
caaagcaggncaatcacattatatattgttccaggtttacaaatcgtaagacaaccaaacgtgctttggggtcgaatcacaaaattatttgccaaaacgatacaataaaattatataaacaagggggaaaaaatgccgaacgaaggatgggtggtgtttaacggagcggccacgcacaatcccagggcatggagactactaattaattaatgttggcgttggtgtcgttgttcggatgcattcaatcacaggccttgctctacgaggtagtcaccgagcctctcaaccaccatgttgcactgtccaggggtcatgggctcgtcgtagatgccgatcaccagcgcctgtccggtcttcttcacaggtatgccttc

SEQ ID NO: 47941 - DNA, 235 bp, Zea mays
  Clone ID: LIB3066-013-Q1-K1-B8
cacagaccgacaacgccctaggcaagcagcaagcgcacacgtaaacgtacacctacctcggcgagcaaaagggaaaacgctgatcggagcaacgaagcccgcagccatgccgacggcgacggccacggccacggcagctcctcgccacgcggcgctcttcctgcccctgctgctgctcctgctcggcctccacgccacgtccgccggcggcgcgcgcgcgggcgtcgccgtggac

SEQ ID NO: 47942 - DNA, 467 bp, Zea mays
  Clone ID: LIB3066-013-Q1-K1-A11
cccacgcgtccgcccacgcgtccgcccacgcgtccgcccacgcgtccgcggacgcgtggggtctgctgagctctccaagctcgctgccaacgcgttcctggcacagaggatctcctctgtgaacgccatctccgccctctgcgaggccaccggcgcgaatgtgactgaggtggcttacgccgtgggcaaggacacgaggattggccccaagttcctgaacgccagtgttgggttcggtgggtcttgcttccagaaggacatcctgaacctggtgtacatctgcgagtgcaatggcctgcccgaggtggccaactactggaagcaggtgatcaatcaacgactaccagaagagccggttcgtgaaccgcgtcgtgtcgtccatgttcaacaccgttgccggcaagaagatcgccgtcctcggcttcgccttcaagaaggacaccggcgacaccagggaagaccccggc

SEQ ID NO: 47943 - DNA, 347 bp, Zea mays
  Clone ID: LIB3066-013-Q1-K1-B9
gccacgcgtccggccacgcatcggtctggctcgaatcggctgcacgctgagccgagatacgcggacccaccaaacatctaaccgtagctgcagtgccactaccggccgcttgcccggtctccggagaggaagccgatccaagcaacgatgccagccggatcatagactcaatttcggtacacgcagacgccgtccaaggtgctgtacctagagaacatgccttggcaatgcaccgaggaggagctcgtcgagctctgaaaaccattcatgcgggtcgtaaacaccatgtgcagcgacggcgataaccgaaaccaggcaaccggcgagtgagcagatgaaccaggcaa

SEQ ID NO: 47944 - DNA, 408 bp, Zea mays
  Clone ID: LIB3066-012-Q1-K1-G8
gcagcggcgatggctcggcgaccggatgacctagcgttggccgccatcacctttgggatcgtcgccttgtgcgcgcggtatgcatcggccgtgggcactacaccccagtcaaccttcagctacaaggagggtgaccctaccgggcctacaaaatgggccacattgcagaaggactgggatgtctgtgacagcggcaccgagcagtccccgatcgacgtcgccaaggtggaggtctctgaggatttagacccgctgcagcagacctacgagcctggctactccgtcatgcacaaccggctccacgatttcatgctgaactggacaggaaggaacggcggcctgacaatcgaagggaagaagtacaagctgaagcaggtgcactggcacgttccctctgagcacaccgtc

SEQ ID NO: 47945 - DNA, 373 bp, Zea mays
  Clone ID: LIB3066-012-Q1-K1-G9
tcttcctcacactcattctaacactcttaatctttaaacaaatcacacttaaacctaatcaaatgcaatcttacacaattggctcacttttacaataaactataaatccatccaaccattatatacttaaatctacatatatcataattcacaaataaattctataatcctaccaaataaattttatactattcctcaacataaactctcatattgcatcttccatatacgtataatctataaaaactcttctatcaccatttatatattcaatcaacttattcaattctatttctttaatttcatttcctaaaatataacatcatatacatatcatcattacaaaaagtttcatttcatacaaaatttcttt

SEQ ID NO: 47946 - DNA, 377 bp, Zea mays
  Clone ID: LIB3066-012-Q1-K1-H1
ctggagcatgcgtgcacacaagcgcgatggctcccaagatcctaggcatgcttgcggggcgcgacagggcctcaccggctgctctggccggcttcgatgtgatagagatgctggccgacaagcccacgtactacacgttcctgaagctcctgcgagacaccaaggtcgcgggcgaagcgaatcatctccggtcggcgacgctactggtcgtgcccgacgaacttgccaagcctatggcgtcactgcccgcccataaggtgccgctggcggcggataaccacgtacttctcaagtactacgaccccatcaagctggacgagatgaagacacgaaccgacattctgcccacgctgctctacgtaaccgacaagaaacta

SEQ ID NO: 47947 - DNA, 145 bp, Zea mays
  Clone ID: LIB3066-012-Q1-K1-H10
gcgctcacgcgttcgctctcctattcggacatcaccatgctccatcggatcgtcacgtgtatcgtgctatccgttggcactctcgtagacaccttgctagcctagatgaaccggatgcaaccggacagggacaccgtcggcgaac

SEQ ID NO: 47948 - DNA, 419 bp, Zea mays
  Clone ID: LIB3066-012-Q1-K1-H11
cccacgcgtccgcccacgcgtccgcccacgcgtccgcccacgcgtccgcgacaagagtgcgtgcacaaacaatgcgatgagagccttgttcctgctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaacgctgtgcaggaggcatgggcatcggcgtgcggcggcactgggaagcagacaatcctcatacccaagggcgacttccttgtcggacaactcaactttacaggcccttgcaagggcgacgtgaccatccaggcggatggcaatctgctggcgaccacggacctaagccagtacaaggaccatggttattgga

SEQ ID NO: 47949 - DNA, 374 bp, Zea mays
  Clone ID: LIB3066-012-Q1-K1-H12
cggacgcgtgcgccggacggaaccaaacgccgaacgccgctgcgctctctctcgtgctcgttctgaccccccagagcgagagggaggggcacccagaggagcctgtcgatgtgatcggcgtctctctgcccccgttcccgcgaggagagaacaacctggagaaaatggcgccgatctccggagccacggccgtacttgtgatggccgtcgtcaacacgctcgccgccgcggttaacgccctggctcacgccccagcacctgctaccagtgacggtacaagtgtagaccagggaatcgactacgtcctcatgctggtggcgcttgtcctcacctacctcatccacccattggacgcctccttcgactacaagctc

SEQ ID NO: 47950 - DNA, 413 bp, Zea mays
  Clone ID: LIB3066-012-Q1-K1-H2
tgcatcattaaactggaagataaaaaatctggggagctttatgctagggcatttcggagagagggtgaaccacatccggtggaacctgtaattgatagtagcagatattttgtactacgtgttgaagagaatatagatgggcgtcagcgccatgctttcataggtttaggcttccgggaaagacctgaagcatatgacttccaagctgccctacatgatcatatgaaatatttaaacaagaagaaggccgctgaagagatgattcagcattatgagaagcaatcttcagtggattacagcctcaaagaaggggagacattggttcttcagcttaaaaataaggaaacaggcaccaagacaaaatcgacattttttgagcaaggcctaaacaagctctccgttaacgaaaagac

SEQ ID NO: 47951 - DNA, 270 bp, Zea mays
  Clone ID: LIB3066-012-Q1-K1-H3
atcaaccttgcacggtacgaaacggcatactaccacactaaactatggatcaatctggcgcgtatcataccgttatcgagcggattagcggccttctacgatatcttgacggtgccatacagactaagattctacagttctgtgctggtgatactcgacgagccggtgagccatggtgtcaaggcaggcgccgtactccgactattcgccgtcacctaaggaccatctaaacctctggaagaagcggctctagcaattgcgcaagtagaa

SEQ ID NO: 47952 - DNA, 339 bp, Zea mays
  unsure at all n locations
  Clone ID: LIB3066-012-Q1-K1-H4
aaggaacaccaaaatgacatatattccaaaccatctataccatgtgggtccttctaattcagcacactggacatccttcagacatggcaatacaaacagcacaatagctcgacangattgcatatgcatcatcttacacaactactgcaaagcataccatgatcatacctaaagtcgacttacttgctgaaccactcagcttcacatgaccttgccatggctacgtgaccatacatgtagatagcaatctgctatcgaccacagccctataccagtaccgtgcacattatcattgaaacgaaagactacgcctgcataacctatgcatcacatgctatg

SEQ ID NO: 47953 - DNA, 410 bp, Zea mays
  Clone ID: LIB3066-012-Q1-K1-H5
gaataattttactaatcaaattcttgttgggatatattcctccaattcccctcctggtcccaacaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggc

SEQ ID NO: 47954 - DNA, 394 bp, Zea mays
  Clone ID: LIB3066-012-Q1-K1-H6
ggaaggatggcgtcggagccggtggcgcgggcggtggcggaggaggtggcgcgctggggcgcgatgcgccagaccggggtcagcctgcgctacatgatggagtttggggcgcgccccacggagcggaccctccttctcgccgcgcagttcctgcacaaggagctacccatccgcatcgcgcgacgggcgctcgacctcgactcgctcccattaggcctctccaccaagcccgccatcctcaaggtgaaagattggtatgtggagtcattccgtgaaatccggtcctttccagaggtgaagaaccagaaagatgagctcgccttcacccagatgatcaaaatgatcagggtacgacacaccaatgtggtgcctgcgattgcattgcgtgtgcagc

SEQ ID NO: 47955 - DNA, 413 bp, Zea mays
  Clone ID: LIB3066-012-Q1-K1-H7
gcgcttcccaaatcccccaatcccgacgcccacccgaccccgtcgccagatctcgcgcctcgtccccggggctcgatcggatcagcggcggtcggcgattcggggacggggtcatctcgcctaggcttgggcggggctgggctggtgggagccgccgagccggggagccatggcgtcggcgcaggcgccgtcctccgccgctgtgccgtcgcgcaaggaccatctcgaggccgggaagaagcggctcgagcagttccgcaagaagaaagcggcgaagaaggccactgcagctagtgcagagcaggcaaaagcgcctgcgcctgatgtagtggagaacccacctccaattgtcaatgctggtagcttgggagatggactggtgtctgatgtagacccaaaccaagcgagcacgt

SEQ ID NO: 47956 - DNA, 415 bp, Zea mays
  Clone ID: LIB3066-012-Q1-K1-H8
gtgatttgaaataattgggaataaatagttcgtgaatccctgaagcgtgcatatatgtattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatatatgacgaatgtcatgtatgttctggtgactgtcatgtatatt

SEQ ID NO: 47957 - DNA, 412 bp, Zea mays
  Clone ID: LIB3066-012-Q1-K1-H9
cccacgcgtccgcccacgcgtccgcccacgcgtccgcccacgcgtccgcccacgcgtgcggtcccgtccgtccgtgcgtccgtccgaccatccgtccgtccgcagcaatggtcggcggcatgtcaccgccgcggcggacgctgtcgatggggagcggcggcgccatgggacgccgcgcggcctctgccggcgtgatgggcgacagccccaagcgcgggctgtcccgatcgatgaccatgggcggcgagcgcacggtgaagcggctgcggctgtcccgggcgctgacggtccccgagagcaccaccgtgctggaggtgtgccgccggatggccgcgcggagggccgacgccgcgctgctcacggactcgaacgcgctgctctgcggcatcctcaccgacaaggacatcgctac

SEQ ID NO: 47958 - DNA, 386 bp, Zea mays
  Clone ID: LIB3066-013-Q1-K1-A1
ctctctcgttctgctcacatcgacgcggttcggttccagtttcactcccactgccgtctcggcaacctcccctgttccacgcttcgtcctcgcctgccaggctgccatggccgcgacgtcccccttcgactgcgtcctcctagacctcgacgacaccctgtacccgggcgacaccggcatcggcgcggccctgaggcgcaacatcgacgagttcctccaggccaagctcggcgtgtcggccgacgaggccgccgccacgcgcgccgagctcttccgcgcgcacggcagctccctcgccgggctcatcgcgctcggctacgacgtgcacccggacgagtaccacagctacgtgcacggcaggctaccgtacgacaggatcgcgcgcg

SEQ ID NO: 47959 - DNA, 457 bp, Zea mays
  Clone ID: LIB3066-013-Q1-K1-A10
cccacgcgtccggtgctgggtgctgccggtggcatcggtcaacccttgggcctgttggttaagatgtctcctctggtgtccgagctgcatctgtatgatattgctaatgtcaagggagttgctgcagatctcagccactgcaacacgcctgctcaggttcttgacttcactggaccctcagagttagccaactgcttgaaaggtgtggatgtcgttgtcatccctgccggggtcccaaggaagcctgggatgactcgcgatgacctttttaacatcaacgcaagcatcgtcaagacacttgttgaggctgttgcagacagttgcccagagcgttcatccatatcatcagcaacccggtgaattccacggtgccaattgcagctgaagttctgaagcagaaaggtgtctacaatcccaagaagcttttcggggttaccaccctggatgttgtcagggc

SEQ ID NO: 47960 - DNA, 403 bp, Zea mays
  Clone ID: LIB3066-012-Q1-K1-G7
aaataataaaaatgttggcaatttgcatttggtcaaatccatccagatagaacaggatgcagtgaagcgcatgagcacaagtctaacacgggatgcaatgcaagcaaagggcgtaatagtagtcgcggcctctagggtggcagcgggttattattcttggcagcgaacgcggtgacgaactggcagcgcaacgtttgttgtcgtcatcatctttcctcgtcgccggtctcagaactcgacgcccttgaagaccttgcgcacctgctcgagcgtgacgaagagcacaacggtgaagggcccctggcgcatcacggtggggatgaaccccttgtacagcgccatgggtccctccgacctgacggtcttgagggcgcagtcgacggcgccggcgtagggcgggggc

SEQ ID NO: 47961 - DNA, 431 bp, Zea mays
  Clone ID: LIB3066-022-Q1-K1-B11
cggacgcgtgggctcccaaccattcgtccatatccccctcccaacaaaaaaaaggggaaaacgcccatcaatggcgatctgaatcaaccaaggcatctggaagcttggacatggagcggatcctcaagtcctccagggagtcgggctccctgaacctctccaatcgctccctcagggagatacccaaggaggtgtacaacaacttggacactggcagccaggatgagaaatggtgggagggagtggacctccaaaagctcattctggctcacaataatcttgaggtgttaagagaagaccttaggaacttgtcttcgcttgctgttctaaatataagtcacaacaagatatcttcccttccagcagctatcggagatctcccgttgctaacatcactggacatatctttcaatcaaataaacacttctgcc

SEQ ID NO: 47962 - DNA, 278 bp, Zea mays
  Clone ID: LIB3066-022-Q1-K1-B12
cccacgcgtccggacactgaatcactgatacatcatacatgcatgcatgggatgcgatgacgatttgatgcatgcatgcatgggtatacctaccaatttgatgaccgacgatgtatagtttcgtcgactgcttcatacacatatatagcagcccaattaatgtaacgttacgcaaatgcttatttgcgaggtatgacattacctctacaatgctatagcacataatagcagttgctaagccacgggttcgcagataatcatcatgcatgcgtgcacat

SEQ ID NO: 47963 - DNA, 421 bp, Zea mays
  Clone ID: LIB3066-022-Q1-K1-B9
cccacgcgtccgcggacgcgtgggctgcagtcatctcctccaccaccaccaccaggctcatggacagccagctcgcgaaaataatgaagagccggagcatggcatcatcggccgcgctcttggtgctagccctcgcgctagtggcggacaccgccccacatgtagcggatgcacagagaagagagcggcggagagcggcgaggcggcggaggcgaagaagatccaggacgacttctgctcgacgctgtgcgagggcaagaaggggacggacctggtcgtgtgcaatgagtcctgcgctctctaccagcagtccaacctggtgctgtactgcatgatccagtgcatgggcaagtgcaccgagcagaatggcatcacggcgccggcatgaatgtctgccaggaggagtgcgacaaggcgtacg

SEQ ID NO: 47964 - DNA, 320 bp, Zea mays
  Clone ID: LIB3066-022-Q1-K1-C10
cccacgcatacgttcatatacattttgcatttcctacccaggcagaccacacagggactcagcgctagaagtcgatcgcgtaaagtcataccagaatcaacactccacctgctcatcgagtcgatggagatcaacgtcgctgcctcacggccatgatacacgaaactccccccgatccgtctccagaagcatgcgccagcgtcactgcaactcgagcaggctgtcgccagcgctgcgactggagcaccgtccacagtgtggggagactggagggcgcctatcccgctcctgtcgccgatcgtcatgtcgcccatggttcc

SEQ ID NO: 47965 - DNA, 283 bp, Zea mays
  Clone ID: LIB3066-022-Q1-K1-C11
tcccactctttcgtccactcgtccttcctccctttttttctttttcttttttttggtgtttcggtttttttttttttcctttttttttttatccttttttttttttctccaaatacataacccttatacatgaaaccttatgccccgtgttcaaaaacttatttttacgcacgctcctttaaacaagctttctgctacatccagccttatccgctagttcttccacttcgaaccctcatatattgcccttcttgaccatttcttttcttttttcaccttccac

SEQ ID NO: 47966 - DNA, 447 bp, Zea mays
  Clone ID: LIB3066-022-Q1-K1-C12
agctcaaggacagccacgaggaggacatctgccaggtggtgctggtggccagcccgcgcaaggactgcgacgaggtccaggcgctcagggaccgcgccggcgtcctgctcaccaggaacgttggcatctccgacagcctgcgccccgccaacccgctaggctacttcaaggacgtgccgctccccgtctgcgccgcgctgctcaagcagctggactcggacgacgacgacgaccagtaaactataccacggcggcgtcgcggacatgctgcacaaaactacaacgatacagagcgaacgcatggcatggatagcagtatctacggaaagaaaaggaagaaaaggaaaataaaaaatgtatcagagtgcttgattcacttgctgctgtcacccattccccgttcttaacataacatgtgggccggcttggcccatgcacaagcccatc

SEQ ID NO: 47967 - DNA, 322 bp, Zea mays
  Clone ID: LIB3066-022-Q1-K1-C9
ttgaagcccggcacgccgtcagttttccgtttcacttccagcccatgccatgcgggtcctggcccgcaacctcgagcgattcatgccagatccggccatgctcgacacatgatgacttacccgccggcgccgatggctgctctctcacgccaagcacaccagacaccatcgccgaccactaaggtgaaacctccgacactgtcactgtaactggatcacgctcgtcgacagctgccggactgaatgcaccgctcacggcctatctgatcgcgctgtttctcttcctcatcttctcgaagctctgcatgcagcccattcctcc

SEQ ID NO: 47968 - DNA, 316 bp, Zea mays
  unsure at all n locations
  Clone ID: LIB3066-022-Q1-K1-D11
cccactcgtccgggcaagggacgtaagaagtattttnagattatagagccgttggttttagaggatttcaaaagattgctgtgtcaagggatgacaaactctgatcagacacatgatagacaaagaattgaggacccacgtggctttgctatgttggcttggacatgtctagagcgtagtgttctcgctatcatttgctcattttgtgataaactcttgaagcaatatgtcgtcgctttccctgaaattaatgatgaggtggtctacagctcccttgaattcctcatccttgctcgttatggactctgggatgttt

SEQ ID NO: 47969 - DNA, 447 bp, Zea mays
  Clone ID: LIB3066-022-Q1-K1-D12
agctcacggacagccacgaggaggacatctttcaggtggtgctggtggccagcgggctcagggactgcgacgaggtccaggcgctcagggaccgcgccggcgtcctgctcaccaggaacgttggcatctccgacagcctgcgccccgccaacccgctaggctacttcaaggacgtgccgctccccgtctgcgccgcgctgctcaagcagctggactcggacgacgacgacgaccagtaaactataccacggcggcgtcgcggacatgctgcacaaaactacaacgatacagagcgaacgcatggcatggatagcagtatctacggaaagaaaaggaagaaaaggaaaataaaaaatgtatcagagtgcttgattcacttgctgctgtcacccattccccgttcttaacataacatgtgggccggcttggcccaggcacaagcccatc

SEQ ID NO: 47970 - DNA, 278 bp, Zea mays
  Clone ID: LIB3066-022-Q1-K1-D9
gatccaccgtctccgcgccccctcaccggatcagctcgaggaagcggtgggtccagatgccgtccatgttcaaggaaggggccagcgacggctgcatgtctgagtcggtgatccgcaaggtcctggtctcgtacatgtacgtggctgtgtgaatcttcctctgatacttcgagatcgtctacatcaagttcattctcgaccccttgatgttcaactggcccttccgcatcttgctcaccatggctcacatggacttgtgctcctccctagccgtggct

SEQ ID NO: 47971 - DNA, 435 bp, Zea mays
  Clone ID: LIB3066-022-Q1-K1-E11
cccacgcgtccgccaccgcacaccatctgggaaaccgatcgagcgagcgaccatggcccgtgctctcaccctcaccgtcttcctcgtcgtcatcgcctccgctgtcgtgtcgttcgctgcggatgaggcaccggctgcctcgccaaagcattcggcctccacaccgtcaaaggcacccagcacgtcgcccgacaagtctgagaaggcccccacggcgtcgtctgaggatggtgcggctacccccgctaaggccccagcttccgcggcctccaactcagaggcgtcaccttccgaggcacctacctccgggtctgagttcggtgccgcctcacctaacgagagcgctgcgtcagaagaggcccctacaagtgcccccgaggactcatcatcggccagcccttccacgtccccgtcggaggctgaggctgcagtatc

SEQ ID NO: 47972 - DNA, 441 bp, Zea mays
  Clone ID: LIB3066-022-Q1-K1-E9
gaaataaaggccaacatacaggcgagggagagcttctcgccggggcgttcgtcggccatatgcactgttcatctccttcctctcagtgttctctgctttctagggtgtgagcgctctttcttgagtgagagggtccaacatttggtaccagagctaggatggagacgccgccggcaaaggatggcctcaagatgttcgacggcatgggctcgacgagtgccgcgatggagcgcgtcatcaacagcagctccgttgagctcccgctgctgaccaaggcgaattaccacgagtgggcgttggttatgcaggtctcgctggaggcgatggaactgtgggacgcggtggaggccgtgtgcaaggagcgtcccaaggatcggcgggcaatggccgccatcctgcgcggagtgccgccggagatgaaggcggtgctcgccgtgaaga

SEQ ID NO: 47973 - DNA, 440 bp, Zea mays
  Clone ID: LIB3066-022-Q1-K1-F11
cccacgcgtccgcccacgcgtccgttacgtgctccgcgcgatgcagcacgagcccgaggtggggtacgaggtgctgaagcagaggaccgactgcgccacggccgtcgccctcgcccgggccttcggcgcaatgccttacctggtgttcgaccccgaggccgccgtgatgtccggcggcgagagcagcgactcggagcggtcggtcgccggctccgccgaggaggaagactatgaggagtgggagttcatgcgcgggctcaccgtctgatgacgtgcccagccgcccgccccggagtgaaacaaggcgagtccgtcgccaggaagttgtcagtggccggccggcgttggtttacataataacccctaccgtccggtgttgtatcgagtcatggtcgtagtcgtcaggtgtctcgtcgtcgccggaagtgtttggcgccacc

SEQ ID NO: 47974 - DNA, 423 bp, Zea mays
  Clone ID: LIB3066-022-Q1-K1-F9
tcgttcacgcgttcggccactcgtccgtagacgttcaacgacggtggggacacgccggtgcacgtgtgcgcccgccatctacgactaggccatgtttcttcaatagatccgtcgtcgtgggctactacaataaccgagttaagcggaaagtcgcagtcaaagttcttggttttgcctgcattcacatctgaatcgagtacatgtgcatacacgcgtaccaaccttggattcctgtactgggtatgtatccaaagcccttaaatcttgctctgaggccaatgagaatgctacaactatgatatttatctatggtccatgactataagaaaaaaacaatgaacgagctaggggatgtggaagagcttgtgtctatgatgaccaatgtgacacctaggggtcaaaaggacctactgatatcattgt

SEQ ID NO: 47975 - DNA, 451 bp, Zea mays
  Clone ID: LIB3066-022-Q1-K1-G11
gccgccaccgcggcgaactacgcgtcgttgtggtcgcccaagcgcctcatgcagcgcgctggccgcgctttccgtcgcagcaggtcgcgcgcccgcgtcaggacggtcaaggacctcgccgaggaacgggcctcagtgctcgccgccagcagcaaggtctctgatgaggcggcggctgcggctaccgcggtgccgtctgcaggtgccaagacctccagcagcaacgatgcccgcgacggcgccatgggcagcgtgcatgacgagccgcggcagcagcgccacgatgactatcaccccgagatcgtccccgagaagatcatacacgaggacgcgttgccggtcgttgctgcggagaaggagactgccgtcgccgtcgcaacctcgaatgaagaggaggaggtggagtcgcccaagaaaggagcggctctgtcgccggtgccggatgctatcc

SEQ ID NO: 47976 - DNA, 441 bp, Zea mays
  Clone ID: LIB3066-022-Q1-K1-G9
gctacgcgtggcttctcctgcaatttggatccaaggcatcctctctagacgcttggactcggggccgttatggctgatcgtctctgaggagctattccctaactgaagcagattcattatcacactctctcctgtcggtcattggtgactctgccgacggccatgattatagactcgtaaagagcttacaatgtgtctccagtaatcccactacgtaagctactgatcaacgatcgagcatccgatgcatgccttcacatggtgcatgagagctatcttacatgcgtcaacgattgtacaaatgatccttcaaagacatttggatcaccataggacatctcttatgcactgatcacgatcttagaaatagaactgtcaactagtcaatctggcgaatgcatagccttcacaatgatgatcaacattcgctatatgcatcga

SEQ ID NO: 47977 - DNA, 448 bp, Zea mays
  Clone ID: LIB3066-022-Q1-K1-B10
gccgctttgggttggggtttaagcgcgtgtaagggaggccggaggcgacgacgacggcgccggcgtcggagaagaagaagcagacaactctcgtatatgtcttcttgccccttttccgatctggtggtcgtagcgctcatcatcgccgtcgtcgccgtcatcctccgcgccctcgcttgctctggccgatctatgcgcaaggggctcaacggctggaacaaatcctagtcgatgctcagggacgggttcggggtgaagtattccggattcctgcacataaggccgtgcggcttctgtagaggagattgacggattcggccgatttgcgctcgtctccgtcattgtttttttgcacccagagtttcttgtttgtctttagaagttttccccccatagttttggcaatcttggcgacatgttttggagttctccccgtcggaagagatag

SEQ ID NO: 47978 - DNA, 212 bp, Zea mays
  Clone ID: LIB3066-021-Q1-K1-G4
acgcgctacaggcgcaccatctacctgccatctcctttcacgccacgtatcctagaccacggacaggggcaccttttcactgacgctgtacatatccatataagacatcaaccctttacgaagcatcgcatacctcaaactcacactcaacctcaccaacatacacctcaagcacactgaccgacctcgacacactcatacttaccgatctc

SEQ ID NO: 47979 - DNA, 410 bp, Zea mays
  Clone ID: LIB3066-021-Q1-K1-G5
gcaggagcaaacaatgaacacaagtcagatcaaaggaaaaggcaatatgaccttatcgaaggtcctccgaaaaggttaagaaaaggatgtttacatatccaaagcagtgatgatgatgtccaagagaactaaagatggttgtttaaaacaccaaatttgcttgcttctcacacgctatcttttgcaaactttagcctaatccgctgtaaagcatatttgcttgataaagtcccctgaactttcttttgatgcaaacaagatctccatgctgaatcaaacatggtagataaaagggcatatctctatagttctgacatgccaccttttgcggtctctaggaccaatattttggtgcctcaacaaatatgtatgtatgactaatttgttatcaactgcgcttagttcacaaa

SEQ ID NO: 47980 - DNA, 247 bp, Zea mays
  Clone ID: LIB3066-021-Q1-K1-G6
ggtggtcaccgcgcggccacccatggggctcacgcatcacgtcgagaaggccatcgacgcgggcacctttgagcagatgctcgacatcaccgtcaaggactggcccgtcgaggaggcgctcggctacgccaagctcgcgctcaagtgcacggagatgcggcggagggaccggccggacctcgccacagtcatactgccggagctcaaccggttaaggaacctcggccacgcgtacgaggcacgcatg

SEQ ID NO: 47981 - DNA, 381 bp, Zea mays
  Clone ID: LIB3066-021-Q1-K1-G7
cccacgcgtccgcaagcattgaagccgtatctcggcgtcgccggacgagacaggttgaggcggggcggtaatggccgacggtgaccttgaggtgctcagcgtgctcgacaccgggaagactcaatggtaccaatttaccgccatagtggtcggcggcatggggttcttaaccgacgcctacgacctcttctgcatctccctcggtactaaacttcttggacgtatgtactacaccgtagaagggtacgagacgcccgggagcctaccgtcgaacgtgtccgagtgcgtcaacggataggccttactgggcaacgcttcatggcagatgttattcggctggctgttcgacaagctcgggctcatgaatgtctatggcatgac

SEQ ID NO: 47982 - DNA, 261 bp, Zea mays
  Clone ID: LIB3066-021-Q1-K1-G8
gcaaggcgtggcggcggtggcggcggcgtttcaagccgggccggcactcgacaaggacggggtcccggagtgggtgcccgacggtgagcgcagggtgctcaagggcggcggcttcaagaacacactcacgccaaacgtggtggtggcgaaggacggcagcggcaagttcaagaccatcaacgaggcgctcttcgccatgccgaatacctacgacggaagatacgtgatccaagtgaaggaaggggtgtacgacgagtacgt

SEQ ID NO: 47983 - DNA, 410 bp, Zea mays
  Clone ID: LIB3066-021-Q1-K1-G9
cggacgcgtgggcggtcaccggccggggagggctcagaaacctttcatccaatacatacatgtatctgagccctttcccgcggtgaggcccgaccggagtccacacacacacacacacggtgtcgatggcggccgtaataaggagccgccgcgtgtccgttgtcttctacgtcgtcctcgccgcagctgcagccgcggcgcaggcatccaataacgtcacctccgacgaggattactgggcggagcgcgccgaggtggctcggtcgcgcaacctcgccgcctacgtcagcgaccccgtggccgccacgaaccgcttcaacgcggacgtgctgagggccacgacgcggctggcgctggcgaggtacgatggcccgtgcatggcgaccaaccccatcgaccggtgctggcgc

SEQ ID NO: 47984 - DNA, 347 bp, Zea mays
  Clone ID: LIB3066-021-Q1-K1-H1
ggtgctccggcccgacgcgcaccatgggaggaagcagttacagcacgaggtggaggtgctcagctgcgttcgccacccgaacatggtgctcctcctcagcgcgtgccccgagtacggctgcctcgtgtacgagtacatggagcacggtagcctcgaggaccggctgttccgtcggggcgggacgccgccgatcccgtgggcgcaacggttcccgatcgcggcggatatcgcgacggcgctggtgctcctgcaccagacaaagccggagccgctggtgcaccgggacctgaagccggacaacattctgctggaccgcaactacgtgagcatgatcagcgacgtctgac

SEQ ID NO: 47985 - DNA, 267 bp, Zea mays
  unsure at all n locations
  Clone ID: LIB3066-021-Q1-K1-H11
cggacgcgtgggcgggcgctgatctacagctacaaggccgccgctagcgggttcgccgtcaagctcacgccggctcangtcgccgcgttgcagagtgagctccataattcaccggttaattctcccgtgctcttgctaatttacttttttgcgatgcttgcctgatttcctgtgcaaactcatggcgatttccccgtgtgctcttgtttgttggcctggccagagcattctgacattgtgcaagcgctgtctgacatgaagttcacc

SEQ ID NO: 47986 - DNA, 312 bp, Zea mays
  Clone ID: LIB3066-021-Q1-K1-H2
aaaaaacagaaggaaatcattgagttgtggcatgaatgcaatgtatctatagtacacagaacatatttcttcctcctctttagggggacactgctcacaatattcacttggaactggtgcatagtatactattccacattccacggtatcctagaggaccatctgatgcttatgctactgacacctccgatctcataagcacttcgaatgcctatcacagcggatatcgccacatctctactgcacctgctccagacaaaaccggaacctttggtacaccatgacctaaagcccgccaacattctgctggac

SEQ ID NO: 47987 - DNA, 365 bp, Zea mays
  unsure at all n locations
  Clone ID: LIB3066-021-Q1-K1-H3
cggacgcgtgggcggacgcgtgggcgccgatcgccctccgctcgctccaccgcggcgggcgatcgctcatctccccctaacctgccccgctcgcgattcccgaggcgaggtgccacccaccgcagatttcttccgacggacggttggctcgctcaccccctacttcgctgatcggatcgcgtgctgcccgaggtggaactttataattttgttgcgtgttttcataatgaaattagggaatgcctatggtgaaaaaaatgtanaggtgatgataaggcataggtgtttgacttagcctgccttagctatttctttgaagctaaggaaaataataatgggggtatggcctttaaaaataagggttg

SEQ ID NO: 47988 - DNA, 165 bp, Zea mays
  Clone ID: LIB3066-021-Q1-K1-H5
cacctctgagactcctccttcacaggccggcgtcgtcggtggtcggagagatggggcaacaacgcacgttggtgtatagcttcgtggcgcgaggcaccatcgtcctagcggaccatgctgaggtctccggcaactttgcctccgttgctgcacaatgcctacaga

SEQ ID NO: 47989 - DNA, 298 bp, Zea mays
  Clone ID: LIB3066-021-Q1-K1-H7
cccacgcgtccgtccacgcgttcgggtgcttagctgcatccgacaccctaacatggggctggtactccgcgcatgcccggagtacggctgtctcgtgtacgagtacatggaccacggcagactctaggaccggctgctacgtctgggcggcacgcagacgctcgcgtgggcccagcggttccggatcgcggccgagatcgcgacggcgctgctgatcctgcaccaaactaagcctgagccgatggtgcaccgcgacctgaagccggacaacatcctgctggaccgcatctacgtgagc

SEQ ID NO: 47990 - DNA, 193 bp, Zea mays
  Clone ID: LIB3066-021-Q1-K1-H8
cgcttgcacaccttgcgtctcgtctcccctctctctctgtcacacacacacacacacacgcgtcatgtcgggacgggaggggaggggaggtctagtgcgcgtacggatttcctatcctagccgcacgacgcgtgcgcggtcccggatcgacgatggccaatgcacgcaggccgccgctggcctgcgtcgagcg

SEQ ID NO: 47991 - DNA, 337 bp, Zea mays
  Clone ID: LIB3066-021-Q1-K1-H9
cccacgcttccgaagaacttggattcagatatagaagttcctaaagctatacggcttgtccatccataatgctcgcttaacctggatgcctatgaatgatacacagcagatcaagcaattgacgttctagatagacttaacgatatgggagtgtaccctgttgctattttagcatccatatcacagagacgattgggaaggtcatcgagatgtcagctctgtggccattgaaaaatacaaatgcgttggtgctgctgatgagagctgtcataatatggtcgatgctcatgacataatacacgggaatattgcccatgttattaacatcaagctggct

SEQ ID NO: 47992 - DNA, 451 bp, Zea mays
  Clone ID: LIB3066-022-Q1-K1-A10
cccacgcgtccgggtgccccgaggtgctgttccaaccatcccttgttggcatggaatcgcctggcgtccatgaggccacgtacaactccatcatgaagtgtgatgttgatatcaggaaggatttgtatggtaacgttgtcctcagtgggggatctaccatgttccctgggattgccgatcgtatgagcaaggagatcacgtccctggctcctagcagcatgaaggttaaagtgattgcgccacctgaaaggaagtacagtgtctggatcggtggctctattttggcttctctcagcacttttcagcagatgtggatctccaagggagagtatgacgaaactggtccgggcattgtccacatgaagtgcttctaagtttttttgggaaatttttccaaaaaaaaaaaagaagtttctggggaagttcgacatggtacgtcatgcgttaccgg

SEQ ID NO: 47993 - DNA, 421 bp, Zea mays
  Clone ID: LIB3066-022-Q1-K1-A11
agccactatctgctacaccagtggcactactggcacaccaaagggagctgtacttgctcatgagaacttaattgcaaatgtagcagggtcaagtttaggcattaagttttacccctctgatgtgtacatctcgtatctacctttggctcacatctatgagagagctaaccaggttgcattgcttcactatggtgttgccattggattctaccaaggggataacttgaagctgatggatgatttggctgttctgagaccaacaatattcgcaagtgttccccggttatataacaaaatttatgctgcaattacgaatgctgtgaagcagtctggggggttgagagaaaggctgtatcatactgcatacaatgccaagcgacatgccatgataaatggtagaaacccatcacctatgtgggac

SEQ ID NO: 47994 - DNA, 435 bp, Zea mays
  Clone ID: LIB3066-021-Q1-K1-G11
cataagctgccgtcaacccttctttgactgtgtcaagatccgatcggcatcgacttcgcacgtacattgaggctctcaacaccagtctctgtcagatgcagagccagaggcattgactgctgccatgtgtcctcaaatcttgttcaggttgagggacggtagacttgtgcaatattttttcatttgtaaatatatttgttggcccaagataggacatgtaagatgtcagaaatttggaactaggcagagcagcgaaaatctattataactcgaccagactactattatgatatggaattaggtggagtgtacgtgttaagttcattctgcgtgaattcaggcagaagcttgaaaacgaaatgaccaatcatggtcacttgtggaaatgtaaactacttcgtagattctctattagtactctattccggtcttttt

SEQ ID NO: 47995 - DNA, 423 bp, Zea mays
  Clone ID: LIB3066-022-Q1-K1-A12
atccagtatctgctacaccagtggtactactttcacaccacagggagctgtacttgctcatggtaacttaattgcatatgtaccacggccacgtttacgcattaagttttaccactctgatctgcacatctcacatctacctttggctcacatctatcatagagctaaccaccttacatcgcttgactatggagctgccattggattctaccaccgggataactcgaatctgaatcactatctctctgttataagaccaacaacatacgcacgtgtatcacgcattatattacaaccttcatgctgcagttgcaaatgctgttcagcaatctgctcgattgagataaacgctgtatcatcctgaatacaatgccacgcgacatgccatgataaatcatagaatccacatacctatatgggaca

SEQ ID NO: 47996 - DNA, 420 bp, Zea mays
  unsure at all n locations
  Clone ID: LIB3066-022-Q1-K1-A9
cggacgcgtgggcggacgcgtgggcggacgcgtgggcactccctcgctccgtctaccagtacgaccacgtccctcctcgtcgacgatctcgtagcggcggcgcacatggcgagcgacggcgcggcggctacgccagcgaaggttaccccaaagaaggccaatctcctcgacccgcactccatcaagcaccttctcgacgagaccatctncgaggtcgtgaagagtaagggctacaccgaggacacgcggctgggcaactggaagctggggatcggagccgtcgtgattgctgtcgccctnctcgctcagttttaccccaagaagttcccgcagaaccgcgatttcctccttggctgcatcgccctgtatgtggtgctgaatgtggtgctgctgatccttagctacaccaaggagaaggat

SEQ ID NO: 47997 - DNA, 454 bp, Zea mays
  Clone ID: LIB3066-021-Q1-K1-E1
cttgcacgtacgagctcagaaggaaggcagaggcaaaagcagccatggcgaactcgtcgtccggccttgcggtgaacgacgagtgcaaggtgaagttccgggagctgaagtcgcggcggagcttccggttcatcgtgttcaggatcgacgacacggacatggagatcaaggtggaccgcctcggcggaccgaaccagggctacggcgacttcaccgacagcctccccgccaacgagtgccgctacgcgatctacgacctcgacttcaccaccatcgagaactgccagaagagcaagatcttcttcttctcctggtcccctgacactgcacgcaccaggagcaagatgctgtacgccagctccaaggacaggttcaagagggagcttgacggcatccagtgcgagatccaggccaccgaccccagcgagatgagcctcgacatcgtcaggagccg

SEQ ID NO: 47998 - DNA, 310 bp, Zea mays
  Clone ID: LIB3066-021-Q1-K1-E10
tcgcccactcgtccgcccactcgttcgcaccaactaattaaaatgaccaagaaggatgttggcgagcgccgtcgcggtcggatcctaccttggccgccggtctggcctcgggaggagaacgtgagatcacggagccaggagggtcgaagatgtgatgtggaatggctagtattgctctccagcgatcaccatggccgcggtgccgcactccgtcatggccagtaatatccgtactgcaatttacgtctttgcctctctatatgtattgctaccatagaatctaggttgcgatgcacctacattctacatt

SEQ ID NO: 47999 - DNA, 438 bp, Zea mays
  Clone ID: LIB3066-021-Q1-K1-E11
ggaacttgtagcattgcaagagcagataggcgatgtcaatactggtttgacagaaagctatgtccaggaaaacttgaggtccagttttcatgttccaggagcagctagcatgtctgatcagttttctgagctttctttggagaatgatgcttgcataatatgccaggaggagtataaagctaaagaacttataggaacccttgaatgcggtcacaagtaccatgtgaactgcataaagcaatggttgatgatgaaaaacctgtgccccatatgcaagacgacagctttgtcatcagatagaaggaacggatgaccgtcgccaataatgttgttggttgtttaccgcgtggcaaattagcgtggattttgtatatagacatggttgcctttatttgcccgtcccctttgctgtggacataaactgagcttcgaaacact

SEQ ID NO: 48000 - DNA, 365 bp, Zea mays
  Clone ID: LIB3066-021-Q1-K1-E2
agcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggctgccgacgttgagcatcagaaggctaatgaggtgctcgctccagaggcggccgtcgccgagcccgaccacaaggaggaggaagccgtggagaagaccgtcgtctaggaggagaagccagcggcagcagcccatgcagaggaaa

SEQ ID NO: 48001 - DNA, 257 bp, Zea mays
  Clone ID: LIB3066-021-Q1-K1-E3
ctcacgcgtccggacccacgcgttcgcgaatggcgttactttacctagaccatgacatgggggttattgcgataaacatccgagagacgcactggtatcttgctgtgatccatgcaagaaatatgcagatactagtgctcgagacacttgatacttcacaagaccgtaaagacctcactgactctattaaaggtctgcaatggcaaattgatatgatatctcaacgtacggagttataagactacacgtggtcagac

SEQ ID NO: 48002 - DNA, 209 bp, Zea mays
  Clone ID: LIB3066-021-Q1-K1-E4
cccacgcgtccgccaaaacatagagtgtcgtcttttctattggtgtgattgggggcactagatacctaacacattgcactcagactacatatactgtgtttgcgtggagcatgccgtatgcgtgtgtgagcttgcgcatattggacatctaggccgtgcgtatcctgcgatgaaaggcgccgtcatcggcgcatcgaccgtgctggtcg

SEQ ID NO: 48003 - DNA, 243 bp, Zea mays
  Clone ID: LIB3066-021-Q1-K1-E5
ccacgcgttcgtcacatctagcgttggttttggagctcgtgcaaaatacctggggattaggtcagttataaaaatagccaaggtgactgctgtgcacacttaaatcgtggcgcatcttccgagtcatggcgttcacgcatctacaaccgcgacacttcagactaacgtggacagccttggccgaactaaccatcgataccgcaattttaccgacagtctaatcctaaacgagtgccgttaccc

SEQ ID NO: 48004 - DNA, 326 bp, Zea mays
  Clone ID: LIB3066-021-Q1-K1-E6
cccacgcgtgcgtcgactcgcgggtcgagtttcggcacatgctggtgcacctgaggacggggcagatcacgctgaacaacgtgctgaacatgatgctcatcaacctgtacatggaccactccaacgcgctgatccgcgacttgaaccgggactacaagctgcactagcggatcgacacgcacagcgactgcgacctggcgtccatcctcgcgtgcatcaaccactggatcatccacatgtgcatgtacagcttgatcgacgggctgatcgactcgacgaacattaccacgtccaacaccgagttcaacagccactacaacgacgat

SEQ ID NO: 48005 - DNA, 454 bp, Zea mays
  Clone ID: LIB3066-021-Q1-K1-E7
gcgcgccatcactccactcgatcgaccgccttcgtgtccgtgccctacagctggtgatgagggcccgcccaaccatggcggcggcggcgcccgtgcgcgcctgggtggtggcgctggcgctggtgctggcgtgcgcgctgctccagccgcggccgtccgacgccgcggcgcagcccggcccgcagtcgccggcgacggcggtgtcgtcgggcgccgccaagcccaagtgcgtggccggcgccaggaacgaccacgcgtgccgcgtcggcgccgtgcacgacccggacagccaggaggaggagggctccagcgtcaccatcgacgcgcccgtcgccgcgcccgacgacgtcggccacgacgacggcagcgactacaacgaccccgacgtgcccaacaacgaccagctcgtcgtcgtcggccactgaaagctgccgcgcgcgcgcgcgcgccgacc

SEQ ID NO: 48006 - DNA, 393 bp, Zea mays
  unsure at all n locations
  Clone ID: LIB3066-021-Q1-K1-E8
gggtggtgatgccggtaaccgtgagaattacatcaacgagctcatcaaaaggatgagattaggttcacgaccaagctcattgtgttctaagaaactttctgtgctctcccaattttacattattaggaagtggatgaatatgcatgcagttttgttgtttggaactagatgtgtatggaagaaatatgatcttttttcccggaggtttagaattatatatttagggctagtttggaaacttcattttccaagggatttctattttgcctaggaaaaatgaactgggcttcccaaactagcccatgatgcatttcccatcctgtgtatcgggcctttttctctgtccaagacgctctntctgaagtacgatcttgatttaaatccatgatggat

SEQ ID NO: 48007 - DNA, 157 bp, Zea mays
  Clone ID: LIB3066-021-Q1-K1-E9
tcccactcgtccggcttgactctctcgtgcttttacccatccgtcgtctagcatgactcatgggagattggcctgactacagcaatgacggtgcagtctcatgatcaccaccaccaccaccacctcgagttccctttcctcgtcagcttctgctctc

SEQ ID NO: 48008 - DNA, 433 bp, Zea mays
  Clone ID: LIB3066-021-Q1-K1-F11
cccacgcgtccggggcaacccctacgtcgtcttcacccccgcgtctgccgcaccgtccacctgccagaccgtcaggaaggcgctgggccgctacggcaagctgctcgaggacggaacccgcaaggccgccgacgccaccggcaacatctggcaccacctccggacggcgccgaacatggcggacgcggcggtggcgcggctgacgcaggggaccaaggtgtacgcggagggcggccacgacagggtgttctaccagacgttcggcgccatgcccggggagcagctccgcaaggcctacgcctgctacctctccacctcctcgggccccgtcatcggcacgctctacctctccacggcgcgcctcgccttctgcagcgacagcccgctctgctaccagggccctgccggccagccgcatgagtgcatgtactac

SEQ ID NO: 48009 - DNA, 349 bp, Zea mays
  Clone ID: LIB3066-021-Q1-K1-F2
ctcgctggtcgttgcctgctgcggattgctcccaggcggccgcactcactccgctgttgagatttcgtttggttctactttccgtcttgtccgtcgccgaggccttcttcccctcgcttgccaactgcagcaagcagatcagatccatccaaccactaacaggaaggcaggaagcctgatgggctgggctgaagttgaaccatgagtgccgtcacggtttcgtcgtcgctgaacccgaacgcgccgatcttcatcccggcggcgctgctgcacgtggaggacttctcgccgtagtggtgagacctcatcagcaccacctgctgttccgcgaccactgataccgcgagca

SEQ ID NO: 48010 - DNA, 350 bp, Zea mays
  Clone ID: LIB3066-021-Q1-K1-F3
cggacgcgtgggggcggccggaccgggccgtgtacacgctgttccggccggaggagaacgcgcggcggatgcagcgcggcgccgagcgcatgtgcatgccggcgccgtcggtggagcagttcgtccacgccgtcaggcagacagtcctcgccaacaggcgctgggtgccgccgcaggggaagggagccctgtaccttcggcctctgctcgtggggagcggcccgatccttgggctggctccggcccccgagtacaccttcctcatctacgccgcacccgttgggaactacttcaaggagggcctggcgcccatcaacctggtggtgcatgacgagttccaccgcgcgatg

SEQ ID NO: 48011 - DNA, 252 bp, Zea mays
  unsure at all n locations
  Clone ID: LIB3066-021-Q1-K1-F5
cccacgcgtccgcccacgcgtccgcggacgcgtgggcggcgcgtccagaccgcgacggcattggcatgaggggaggaggagccggagagaagctccaccacaaggaggccaatgccgcgcacggcgccggcgccggcgccgcggggaagggggccaaggcttgtttcgtcaacggcctcctcctctacgtcgtcctgccggtgctggtcttgtacttcgtcatcatcgccgnctcgcagttctacaaccctc

SEQ ID NO: 48012 - DNA, 405 bp, Zea mays
  Clone ID: LIB3066-021-Q1-K1-F6
gaactgagcccagcgctagctgctgccggggcgcgccgtcgtcgccgagccggtcggtctggtctggtctggtctgcctgcctgccaggtcacgcagcctggctccaccgatcgcacaccatacattgacgtcgtcgtcgcggccgtacgtgccgttggacggtggaggaggcggtggcgctacgacagtatatatatacacaattacacatacacaccccaaaaagaaaagaaaaaaactactgccattgctgtcgttgtgcgtagcttctctctatatatatacccgtatttaaattctcgacaaaatttgtttgaccacggtgatctgtcatatatgtcgtccattgatttgtgttaatttgacataagacgttgaaaagaagcttgactactctactgtgc

SEQ ID NO: 48013 - DNA, 396 bp, Zea mays
  Clone ID: LIB3066-021-Q1-K1-D9
cccacgcgtccgatggctggttcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgactgcgcggcctgcggagggtgctacgaggtgcggtgcgtggacagccctagcgggtgcaagcccgacgcggcagcgctggtggtg

SEQ ID NO: 48014 - DNA, 267 bp, Zea mays
  Clone ID: LIB3066-021-Q1-K1-F7
ctgggcttcttcgtcgtacgccggcgtccctgctagtgcctgccgttgaactctccggccggcattgatccgacctcccctaagccatcgatgagtagagaaaaacagtgaacgccacctctgtactcgccccaccttatggcgcgtcgctcctgcagtaccggcccacgctctgcgcggcgctcaagtgttacggctgccctcaaatccgtcgtcggaccattggcactggggcaagccaaagcacggacaggtgctcggcgtgct

SEQ ID NO: 48015 - DNA, 226 bp, Zea mays
  Clone ID: LIB3066-021-Q1-K1-F8
gagcgcgggttcgcggtcaccttcatcaactcggagtccgtgcaccaccagatcggcgccggcggcgacatcttcgccggcgtgcgcgcgcgggggggagagacgacgacggaggagctggacgtgcggtacgagctggtgagcgacggcttcccgctgggcttcgaccggtcgctgaaccacgaccagttcatggagggcgtcctgcacgtgctcccggcccacg

SEQ ID NO: 48016 - DNA, 387 bp, Zea mays
  Clone ID: LIB3066-021-Q1-K1-F9
cccactcgttctctcctgcgcagcgcaacatttacacgctaaggctggccgactacatcctggaacaggtcctgtaactactacgtaccatctgcattgcatgtccacgactatagcttctagtttagactttcaatcatactatcatcaaagcaaaggccttcctgccggcgtatttgctttgactcttgtacttcacgccattagatatctagcacttggtcactcttcttaattagttcgctttgcttttgaggttgattataccattttgatgcagcgtgaactgcatgcatggacatgcaacgctccaatggcctttgtaaagtgaaatgtttatccccattatctgcatttttcctatcaaaaatgaactggttctcatat

SEQ ID NO: 48017 - DNA, 320 bp, Zea mays
  Clone ID: LIB3066-025-Q1-K1-A4
gggtatttgactgcaacacggcaaatctcctagagacccaaacatgccacctacatggggttacaacgatggaggcgacatgttctggtggacacgagcttattctcacatccagcctaaatgaggttaagatctgggatgccttctcggtatctgcagggcctttgcacacatttgaggcctgcaaagctgctaggtttaaccactctggaacttcatttgctgccctttctactgatacagctcaacgggaggttcagttgtatgatgtgcagacatatactcttgctacacagcttcctgataacactagcagttca

SEQ ID NO: 48018 - DNA, 324 bp, Zea mays
  Clone ID: LIB3066-025-Q1-K1-A5
cccacgcgtccgcccacgcgtccgcggacgcgtgggggaaaagaagctcgtcttttacacaaaagtaaaagatgcaattacttccttaaacgctaagaagactatcaataagaaaaatacacggagtcggcgtcagaagaaactgaaagcatatgacctctcagcactgtccgagtccctcccagaaccaggtgcaccaaagcagaagcctgaagcaaagttgaactgcaagtcaagacagtcattagtattacgggaggctgctcatctcaaggttgtgctgggaaagatgcagttccagcttgacccatttgctgcgatcca

SEQ ID NO: 48019 - DNA, 325 bp, Zea mays
  Clone ID: LIB3066-025-Q1-K1-A6
aaaagccgaacaagtacaactatccaattgggaagaggcgcatgcagccagtgggaataatagttttcgcatcagtgatgggcacacttggcttccaagtgctgatcgaatcagggcgccagctcataactcaggagcacgcggatttcaagttcaagcaagagctctggatggtcattagcatgtcctctgttgcggtcgtgaagttcttcctcatgctctactgccgaacgttcaagaatgagatcgtgagggcctacgcccaggaccatttcttcgacgtaatcacaaactctgtcggcctggtctcggcgctgctcgctgt

SEQ ID NO: 48020 - DNA, 397 bp, Zea mays
  Clone ID: LIB3066-025-Q1-K1-A9
cccacgcgtccggactccgagtcggaaggccgcgtcgtctattccgacatgaagctggctgatgagacgggatctgcgccggctccggcaccggcgccggggccgacgaccagttgaagcgaggaaggtggccaaaactgagggcccggctactatcttttgctataactaaagatagggccaagtttaatttctccgataaattctgtccgagcaaaaagtatgatggggtttttagtcgagatggtaaataatgtatgacgcgcgtgtggaccaagagtcatggcttgctgtacttgtggtttctgagctgcaacactcaatcgactactaaactaaggtaataactaggttagtgcccgtgcgttgcaacggaaacatatattatcatgataat

SEQ ID NO: 48021 - DNA, 317 bp, Zea mays
  Clone ID: LIB3066-025-Q1-K1-B1
agcgaacctacaagaaatatggagaaaggagaagtggtagaattcactctgcctttccattcccccatccgccatggcggcgccgccggagctcgttgacgacacgatcgccgagatctgcctccgccttcccccggacgagcccgcgcacctcgtccgcgccgccctggtctccaggcgctggcgccgcatcctctccggcggggccttcctccgccggtaccgcgcgttccacggggcgccccctctgctcggcttcgtcgacaacaccatcgggctccacggcgccacggcccctcgcttctcccccaccacct

SEQ ID NO: 48022 - DNA, 118 bp, Zea mays
  Clone ID: LIB3066-025-Q1-K1-B10
gaattatatttcaaaagagctcacctagcgcatgtgttacaagacaatataatatgagcaatggctttttttggcaccagaccacccaagaaataagttatgctacatgtctcttctg

SEQ ID NO: 48023 - DNA, 436 bp, Zea mays
  unsure at all n locations
  Clone ID: LIB3066-025-Q1-K1-B11
tggggatggtctcagttttcatgaaaggttctatggatcacgtggaaaggaccagagcggaacaagccatgatggattccgtgccaagaaccaaaattcttcttgcaaggcccttgaaagtttcaaactggtgatggcatccactaggggcaatccaatttttgcgatggtgacgaaaccaagtagaagatggcaccctaacaagttatattatttccttttcttatcctgcttagatccaaggatgtgatggtctgaaccctaacggtctcctgctatcttgatttgacgtctgggagacgcttgattccgtgcctgtgggttgtaaggcgttaaaacttgactntgttagtgtactcccaatgatataacccaatcctgggtaaacaaacgcatggngatgaattttggacgaaaccatggacaactgatgtgt

SEQ ID NO: 48024 - DNA, 437 bp, Zea mays
  Clone ID: LIB3066-025-Q1-K1-B12
gcgaagcattggatcgactacttgagacaaacaacttccctgaatttactggacgagtatgccctgctccttgtgaggggtcatgtgttcttgggattattgagaatccggtgtctatcaaaagtatagaatgtgcaatcatagacaaaggtttcgaagagggatggatgattccacgacctccacttcaaagaacagggaaggtggccattgttggcagtggaccagctggtttggctgctgcggatcaactaaacaaaatggggcattttgtaactgtgttcgaacgtgcagaccgaattggaggtttaatgatgtacggcgttccaaacatgaagactgacaagattggcattgtccagcgccgtgttaacctaatggcagaagaaggtgtcacatttgtggtgaatgccaatgttggtagtgatcctctgtac

SEQ ID NO: 48025 - DNA, 155 bp, Zea mays
  Clone ID: LIB3066-025-Q1-K1-B2
agccaacctccaatacctatatatatttcacaagtggatgaacatactcttccgtacgattatcttattcatcatcgccctcctattgcatctccttaacaactctatcatctagacattcctcagcataccacctcactaccccccacacatcg

SEQ ID NO: 48026 - DNA, 318 bp, Zea mays
  Clone ID: LIB3066-025-Q1-K1-B3
cccacgcgtccggctcctcgggaatccggtgccaggcctcgccttctcgcggcggtgctccctccctcttcgtcccccagcgacgcaggcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcaaggagcagcagatcgaggtggacagggcgaagcaccggcggaagaa

SEQ ID NO: 48027 - DNA, 320 bp, Zea mays
  Clone ID: LIB3066-025-Q1-K1-B5
cccacgcgtccggatgatatcaagtatgatgaggaatatgtattgaatgcacgaggaatgaatctcttcacatgccaatggagacctttgaactctgaaccaaaagctctgatctttctatgccatggatatgccatggaatgcagtatttcaatgagaggcacaggtacaaggttggcgcaggctggatttgtagtgcatggaatggactatgaaggccatggaaaatcttctggacttcaaggatatattaatagtttcgatgacattgtggttgattgctctaagtactttgcaagtgtctgtgagaaagaagagta

SEQ ID NO: 48028 - DNA, 322 bp, Zea mays
  unsure at all n locations
  Clone ID: LIB3066-025-Q1-K1-B6
ctgctggacccgtcggcggagcacggcgtcactaagttctccgacctaacgccggcggagttccgccgaacctacttgggcttcggcaagtcccggcgcgctctcctcagagaactcggggagtcggcgcacgaggcgcccgtgctcccaaccgatggtctccccgacgatttcaactggagggaccacggcgccgtcggccccgtcaagaaccagggttcgtgcgggtcgtgctggtcgttcagcgcgtctggagcgctggagggtgcgcactacctngcaactggcaagctggaggtgctttcggagcagcagttcgtcg

SEQ ID NO: 48029 - DNA, 322 bp, Zea mays
  Clone ID: LIB3066-025-Q1-K1-B7
cggacgcgtgggctctaagtgatggtgaactaaagcctgatgagcaattggttaacgacattattcaagaggttgacaaggataaggatggtcgcatcagttacccagagtttgaattgatgatgaaaagtggatcggactggaggaacgcctctagacgttactcaacagagaatttcagcagcctcagtcaaaaactgtgcaaagatactttatgaaacaagaaagtagtttccaagcagcaattactgactgaagtaccacaccctcaacctcaactaaacagcatcaaagacaacgcaaaagcaggattactggatct

SEQ ID NO: 48030 - DNA, 324 bp, Zea mays
  Clone ID: LIB3066-025-Q1-K1-B8
cccacgcgtccggcaaaaccatcagatctagcagaactctctcgacctcatcggcgttggcggagcgcgtgttgaccggagatggcgccgagcgggtggaggaggagcgcggcggcgcgggtcgcctggcgcccggccacggtttgcctgtggctcgcgctcgccgccgccgcactgacgctcgcccaggctaagaaggacctgacggaggttacccacaaggtctacttcgacatcgagatcgacggcaagcccgcaggccggattgtcatggggctttttgggaagactgttcctaagacggcagagaacttccgagctctt

SEQ ID NO: 48031 - DNA, 239 bp, Zea mays
  Clone ID: LIB3066-025-Q1-K1-B9
attttgaaagagctcatctgatccatgtgccagcgagctaatatttaattttttttctatggttattttatggcaccacaccacccaagaaataagttatgttacatgtcccttcgtgcaccttgttgtgttgggttaatacggttatataaattgaaatacaatatgtatttaatatttttagagaaaaaaaaaactgcagaatacagctaaaggaaaactacaaactaacaaaataa

SEQ ID NO: 48032 - DNA, 312 bp, Zea mays
  Clone ID: LIB3066-025-Q1-K1-C1
cggacgcgtgggggagcacagagctagctagccagccagccagcagccagcttgctcgccgcgcccgtccttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccg

SEQ ID NO: 48033 - DNA, 441 bp, Zea mays
  Clone ID: LIB3066-025-Q1-K1-C10
aaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccaaggtgatcagaggaagaacgtctcgaatttcctcgtccaggccggcattgtgaaa

SEQ ID NO: 48034 - DNA, 298 bp, Zea mays
  Clone ID: LIB3066-025-Q1-K1-A2
cccacgcgtccgggccggcgtctgcgttcctagctcgatcttgaaccatagggggcgggcatggcgcccagcagcagcatagcagtactgctgctcctcgtcgtcgccgtcgtcctctccaacgtcccctcctcgggcgccctggcctcctcgtcgtcgtctctgctgcaccagtcgtctcctcctgagagtgagactgagaccgactgtagcagcggagaatcttcgtcgtcgtcgtcgtcggacgaggaggaggccggcgagaacgataatgagaaggagcaggagatggagaagg

SEQ ID NO: 48035 - DNA, 416 bp, Zea mays
  Clone ID: LIB3066-025-Q1-K1-C11
cccacgcgtccgcccatcagccaagagctacgcaaacgcacagcgatgcacaagcacgagataccagccaccatgcgcctgtccctcctcctcgtcgtcgtggccgccctctcggcgcgcaccgcggcgcagctgccgctggcgggcggcggcggcggcgccctgaagccggacttctatagccagtcgtgcccgcgcgcggagcggatcattgcggaggtgatgcagacgaagcagatggcgaacccgacgacggccgcgggcctgctccgcgtcttcttccacgactgcttcgtcagcgggtgcgacgcgtcggtgctgatcgcgtccacccagttccagaagtcggagcacgacgcggagatcaaccactcccttcccggggacgccttcgacgccgtggtgcgcgccaagct

SEQ ID NO: 48036 - DNA, 98 bp, Zea mays
  Clone ID: LIB3066-025-Q1-K1-C12
atgtgttgaacccttatgtaagacacattcatgcgctctctcaagagcggtatgaatgcttctatgctgaactgatcactctcagttacgatattttt

SEQ ID NO: 48037 - DNA, 322 bp, Zea mays
  Clone ID: LIB3066-025-Q1-K1-C2
agcttaattgcgccactgctcgttatcctcctcttgcattgcattgcaggtcgtaggtgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggc

SEQ ID NO: 48038 - DNA, 439 bp, Zea mays
  Clone ID: LIB3066-024-Q1-K1-G6
cccacgcgtccgggagctgaagcacgtgcaccaggccatcaagtggggcaccgactacctgctgaaatgcgccgccaggaagaacaagctgtgggtgcaggtcggcgatcccaacctggaccaccagtgctgggtgcggccggagaacatgaaggcgccgcgcacgctgtacgagatcgactcgaagacgcccgggacggagatcgccgtcgagacgtcggccgcgttcgccgcctcgtccatggtgttccgcgacgacaagaagtactcgcgcaagctgctgaacaaggcgaagctgctgttcacgttcgccaagagccacctgggcagctacgacggcgagtgccccttctactgctcctactcgggctacaacgacgagctgctgtgggccgcgacctggctgtacctggcgacgaggcggcaagtgtacgcggac

SEQ ID NO: 48039 - DNA, 424 bp, Zea mays
  Clone ID: LIB3066-024-Q1-K1-G7
gaattaggcaagcgattattcgcatcgttgcttaggtgctctaacaagccgcaattggttagagattggatcaagttccaggctttttaaaaagtgccttccagcttacttaattgactcgcatgggctttctcgctataaacgaactaaacgaagcgcctaaagagagagatccgcgggacaccagtcaataaagtaaaaagagagtattctcttatgtagtcttattccttcccacccccttgtgggtgctgctcaagcagctcaagaggcgccaaccccacaaccacaggtagaaggagttccaggtgcggcgtccagatcagggactagtggcccgtcctgttcggatgtaaaggaaagatgaaaaacttttctcaaacagtggggaaagggccccatacgtcaaagccagataaagaat

SEQ ID NO: 48040 - DNA, 452 bp, Zea mays
  Clone ID: LIB3066-024-Q1-K1-G9
cccacgcgtccgtgcacgcgtccgacaacgcttacgtgttatgcacgatgaggatcaatgcgtcgacatcaacactggtggcaggacgaactattgctcaagattatgaacaaggacacataacgctatcgcacgacgacagccatcgtattcgcgtaagaagatcaagtgcctcggagcagaccaaccatatgctggcgaacgctctgagcacctgtacatacctcaatgtgagtgacaacgtcgaaaacttctgacggacgcagtcattaacgcagatatacatggaacagctacagtccctgatgatcattgcgacgacttttccatactactcgtctcgcaacagcctgtacaagatctttgacgtcttgggacgtgttatacacatcaagatatgcgatttacaagatcctaacaccgtaaggactttgcaagtctgacactctttg

SEQ ID NO: 48041 - DNA, 339 bp, Zea mays
  Clone ID: LIB3066-024-Q1-K1-H1
tcgcttgtctgaaacaagaccactgcgagaacttttaggccatacaccaacccaggttgttgctggcgcattgcttgggtgtacgatagccacagcaggacaattattcgtttgaactccgaaggtgcaggagaaatgttgtagcatttgcatcgcggggacttgagaagaagtttctctagtgttctgctactttaggtattggtaagattttcaacttggagctgtagtgttgttgaatgttgtaagctctgatggaacgtgattatatgtcaaggtgatgttcacaggattgttgtacagaacatttgttcgataatgtcatggttatgattgatg

SEQ ID NO: 48042 - DNA, 297 bp, Zea mays
  Clone ID: LIB3066-024-Q1-K1-H10
cccacgcgtccgcagacatccttcatcgggatggaagctgccggcatccacgagaccatcgggaactccatcatgaagtgcgacgtggatattacgaaggatctgtacggtaacatcgtcctctccggtggcaccaccatgttccctgggatcgctgacaggatgagcaaggagatcactgccctggctcccagcagcatgaagatcaaggtggtcgctcctccagagaggaagtacagtgtctggatcggacgatccatccatgcatgcctcagcaccttgcatcagatgtggatc

SEQ ID NO: 48043 - DNA, 426 bp, Zea mays
  unsure at all n locations
  Clone ID: LIB3066-024-Q1-K1-H11
gccactctaacggaacagtatacggaataccgatttgatggcccaaaataagcacatcatgggtgtggtggctctcctttttcttgtggtggcaacatcatcatcagtgtgggttgcagaaggagccgatgacttaaaagtttcttgcgttaaagagtgcacccaaaattttaacactcccgagggcaagaagatctgtgaaacgatgtgtgccaaccctaaaggaaggcctatcgacagagttagagctgattgatcaatgctcatctttatttgtagctagctatcatgcatgcgatgatggccttcttgattattattatttcattcctcatgttagttgttcttgcatgctttttccaccactaatattgtcctaattgatgcatacaagttgtcactcaaagcaatttctatgctntactt

SEQ ID NO: 48044 - DNA, 259 bp, Zea mays
  Clone ID: LIB3066-024-Q1-K1-H12
acgtccacgcgtccggagacattcatgaatcagatgtacaaactacggtacatacgcataactcgagcttaccctcataaagtgcggcgctgatcttagtaaggcattatccaggaaccttgctctcttcgcagacgccaccatcatcactagaaccgctaaccctatgaacgaacttaacattgatcacagtatcaggtccatcatgagccatgaattggctactccttatggaagtttcaaatccttggatcacacc

SEQ ID NO: 48045 - DNA, 431 bp, Zea mays
  unsure at all n locations
  Clone ID: LIB3066-024-Q1-K1-H2
atcagctgctttcttgtatgtcagccttagatccttccaactcttttgcttcttttgatgcacacaaggtacgaaagctagctgatttatatcctaatgacatgtcaagcattgacttgttaaaacttgacttgcaacttgacaattatattgatggcataagagaagatgatagattcaaagacataactaatcttgtggacctctcagttaagcttgttgaaacaaagagacataaggtgtttgatatggtttatttgcttctcaaattggtattgcttttgccggtggcgacagcaagtgttgaaagggcattttctacaatgagtttggtgaagactaaattgagaaacatgatgtgtggtagtcttttggatgattgtctngttacatacatcgagagggattatttcttcgaagtgaatgaagaa

SEQ ID NO: 48046 - DNA, 341 bp, Zea mays
  Clone ID: LIB3066-024-Q1-K1-H4
accacgcgtccgaggagatcctcaagatcgcgtaggagaacttcgacttcagggccgggatgatcagcatcaacctggacctgaagaagggcggcaacaggttcatcaagaccgacgcctacagccacttcggacgtgacgacgccgacttcacctgggaggtggtgaagcccctcaagttcgacacggcatcggcttaaggctgggagtgctcactgtggacatgaggactaccgttctctggctctgctgctacctgcaagcattgctgctgatgcatgtgagcgtctgatcagcgactggctgctgctccatagaagatgaacggagagaacgatgat

SEQ ID NO: 48047 - DNA, 244 bp, Zea mays
  Clone ID: LIB3066-024-Q1-K1-H5
gtcgctgtcatgctcatcttcgaggtcaactaatcctaacaaggaaaagatggcgacgacggcgtccatgcttatgaacaggtacgagctcgggcgcacgctctgacagtgcaccttctgcaaggtgtacctaggccggaacatctcgtccagtcagtgcacgtgcatcaaggtcattgactatgagaacgtgatgagcgtcagcatgatcgaccagatcaagcactagatctccgtcatgcgc

SEQ ID NO: 48048 - DNA, 148 bp, Zea mays
  Clone ID: LIB3066-024-Q1-K1-H6
cggacgcgtgggcggacgcgtgggcggacgcgtgggcggacgcgtgggcggacgcgtgggctgtctccatctccatatatagctagagtgagacttcgctgttgtttaaaagagaagagttaagaaatggattgacaagttatataat

SEQ ID NO: 48049 - DNA, 384 bp, Zea mays
  Clone ID: LIB3066-024-Q1-K1-H7
cctttcaacctgtgctggaacatctttggcggacatagtcaatgcatctacggaagcttccttatagaaaatgcctatcatcatcggccatccgcgtcctgtccatgctgagatcctctctacatctcccccaaacgcagacagagagctccactagaaagctaaatacggcatcacagaaatgtgcgcagacctatagaactgggctagcaagagcccttatggatacacggcatctgactctccgaacctcaatgctagttcacgctgaacaacaccgattgtcccatgtggactcacttgtacatgagactgtagtgccagccaaccacgataaatgtagatctagtcggtcgctcatactgagagaagttctatatgcct

SEQ ID NO: 48050 - DNA, 266 bp, Zea mays
  unsure at all n locations
  Clone ID: LIB3066-024-Q1-K1-H8
cggacgcgtgggggtgggcaatggggcagcaaccctgttttggtcggatagatggattcagggtcagagaattgctgaccttgcaccacaagtctttgcaacagttcccaagatgagaattagcaaaaggacagtacatgaagctcttactgatcactcttgggtgatggatatctagggagctctaactnttggagttattaatgagtttcttagtctctgggatttgctctccgtagtggtgttacagcctgggattgatgatg

SEQ ID NO: 48051 - DNA, 304 bp, Zea mays
  Clone ID: LIB3066-024-Q1-K1-H9
ctcacgcgaccgtacatacatcacacaaattataaggaaaggattcgacctttacatctgaggtttacattgtctgaggaaatgatacgtacatctacgcgtcagcaatatcggcctaggtttccgctccctcgactacatccgaagcgatgatgccattcctaagccttatgcgctcatgtgtctcgactacctatacgaaaatacccgactacttcatgaagcgcagcgtctactgataaacatgccgtgcttgatccttaccctacgtgactgaaaccatatgatgctccaacacgagcct

SEQ ID NO: 48052 - DNA, 422 bp, Zea mays
  Clone ID: LIB3066-025-Q1-K1-A11
actcgcgcgtgcgccaatagcatcacgctacgcatttacaatccatcacctttcatccggaactcgtacaattttaactggtagctgtattccaacatctgatgcacagcctaccgatctttcatcaaacgctaccgcaatcttgacgacaacaactagaacccacagaagtacgtgcagtacatcccagatacagtcgaccaacttctaggccagctcttccaatggcaacaatggtcctaacaaacactcttaacatcatatagtgatagtgactgcattattacagacagatgccactaacttcaacagtacagatttcttactaatcaaccaccagttacttctatcactacatataatatactagtgacataaacctcatctttgcatgcactacctaattttcttttcccataaaa

SEQ ID NO: 48053 - DNA, 441 bp, Zea mays
  Clone ID: LIB3066-025-Q1-K1-A12
gcttaaaggacgcagctttcctgggaaggttttgctaacccggcgatccgagcctctgtcccctggctgattattctccaagctttgagagcgagcacgatgaagatgagcgcaaggagggttctcgtcaggagggagaaggtcaagcatctggaaactcatttgacaatgcaagttcaaagaaatcaaatattctgtcaacaagtagttcaaattcattgccagatgctcaggggctagtttctggggctagagctactgattctgcaagaattgctaaattcacaacggaactatctaggccagctgttatattagacaaattgcgtgaactatcttggagtggtgtgcctccatatatgcgacctaatgtatggcggcttcttttgggatatgcaccgcctaataaagatagacgagaaggtgttctaacaaggaaaa

SEQ ID NO: 48054 - DNA, 438 bp, Zea mays
  Clone ID: LIB3066-024-Q1-K1-G5
cccacgcgtccgccccttcccccgttcgctgtcccgacaggtcctccccactcctggagccggggtctaccctccccgtacgcatgcatgtcgacatgtcccaccgcgtccggctcgccgcggcggcgctcgtcgtggtcgccgctctggcgcttgcccccggcgccgcggcggcgtggcagctgacgaagaacggcaccgtggtcagctacgaccgccggtcgctcatcatcgacggccggcgggagatcttcttctccgggtccatccactacccgcggagcccgccggacatgtggccggagctcatcgccaaggccaaggagggcggtctcaacaccatcgagacctatatcgtctggaacatgcacgagcccgagaagggtcagttcgacttcgaggggcggtacgacattgtgaggttcttcaagctgatcc

SEQ ID NO: 48055 - DNA, 446 bp, Zea mays
  Clone ID: LIB3066-024-Q1-K1-F3
cgagagcagaaccaatactctgagctaaaacttatcacatagactcctgctcgagagaccggaggcgttagacgagaccgccgacgacgcacgagcgctcgatcccgagcgtctataaccttaggattcaagaagatccatcatccgaccggcttcctctacatcgcagaatgaaacggtcgcattacgacactgctcaagcagccaactgctgaccatgatcaagtggatcttgatgagtcgacgtatgaccctgaacttgataagttgcacgctgagagaattgctgcccttaagaaataggttgagaagcctgaagtgctaagaaggctatgtcacggtgaatacaggaaggtaattgaaggggacttccttggcgaggttactagcaatgaaagagtcatatgtcatacctatcaccgtgaatcttacagttgcatgatcat

SEQ ID NO: 48056 - DNA, 445 bp, Zea mays
  unsure at all n locations
  Clone ID: LIB3066-024-Q1-K1-F4
ggacgacatcgtggcgtggctgagccccagggtctgacgccgccggcgcgttgcggtgctggccgtangacgcgagcggctttttgatcatctgctgagcgcggaggacctgcaggccgaggacgcctcgcctccggacggtgggtgatgacgcggtctggtctggtaggctgcggaccgagggagagcgggtgtgccttctcgcccccttggtgtgctgaactgctgatacgatacgaggagcaggacaggagtacggagaactactactacctacggctatgggcgatggctttactcgcgcctnccggtgtgtcccgagattttttttcggggacacgtacgaattatgtaacggagttcgtttcgccgtgccacacgcacgagcggtgtccgatacacctatagaaaacgactttccatattgcgagttgtgtgatgtatt

SEQ ID NO: 48057 - DNA, 400 bp, Zea mays
  Clone ID: LIB3066-024-Q1-K1-F5
ctcacccctccttcacgcctccctcaccaaataaggtcccgcccttttccgacattcacaggggggacaggaaatcagcggccatggcctcgattccggcgactaccttcgccgtcatcttatccgtcctcttctgtgccgcggctggcaccgtcgtcgacaacgacctgcccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggtgtgaccgacgcgaacggcacgtacacgatcgagctcaaggacagccacgaggaggacatctgcgaggtggtcttggtggaaag

SEQ ID NO: 48058 - DNA, 444 bp, Zea mays
  Clone ID: LIB3066-024-Q1-K1-F6
cccacgcgtccgccaaaatgatttgcatgagctatggtcattgttggagttcatgatgcctgatatatttgctactggggatgttgatctgaagaagctgctgaatgcagaagatcgcgaactaatttcacagataaagtccattttagggccatttattcttagacgtttgaagtcagatgtaatgcagcagcttgttcctaaaatccaacatgttaagtttgttgtcatgggcacagagcagtctgaagcttacaaaaatgccataaatgagtaccgtgctgcttgccaggctcgtagtgccaagtcttcagatggcatttccaataatgttgctggattgattccaaagcgacaaatatcaaactattttacacagtttcgtaagattgcgaatcaccctttgcttataaagtgtatttatggtgacaaagatgttgatcg

SEQ ID NO: 48059 - DNA, 434 bp, Zea mays
  Clone ID: LIB3066-024-Q1-K1-F7
gtgactcgaaatattcgggaataaatagttcgtgaatccctgaagcttgcatatatataccgctgccaagataaaggtaatggactcgtcacgcaggttccagccggacgtcatcctgcttctactgctaattgtgtccaccgatatggcacaggcaaggtaatgcgataagtacagtgagctatttgttggcgcatgcatgatcgcagacaactgcgccaatgtgcgccgcggtgagggcttcttggtcggcatgtgcagcaccttccgtcgtcgctgcatctgcactaagcactgcttaacaagatcgctcgatcgctcgccatgcatcgtcaacctattattaataacgtgcattatctcgtgcttatttatgacgaatgtcatgtatgttctggtgactgtcatgcatattctgatgaccggcatgtatc

SEQ ID NO: 48060 - DNA, 447 bp, Zea mays
  unsure at all n locations
  Clone ID: LIB3066-024-Q1-K1-F8
cgtcactgtcgcagacggcctcgcactcgcactcgccactgatcaaccagaactacccgcggctgaaccagatgcaggtgttccaccacctcggcggcagtcagcagccgtcgttccaccaggacggcagcgcggcggctttcggtgacatcgtctcctctcgcctgccgccactgccaaccgccagaacgcaggcggagctacattcgaaccaattcgacacctccatcagcggcgggctggtggatcagtcgatgctgatcggcgacgaacacctgctgcggcctaacccgagtatggtcaaggtctcctccatgcccgcgctctcctaccgtgagccggatgggtccaggatgctgccagcccatggcgccgggagcgacggcgacgtctcctcgctggggcaatgcccttcgggacaggacctncaccgtggtgcgacatggg

SEQ ID NO: 48061 - DNA, 405 bp, Zea mays
  Clone ID: LIB3066-024-Q1-K1-F9
cccacgccttcacccatctgacagaccagtcttccgcactaaacgatcctacattggcgtcgcgcactacaacaggcatattggcgtctccatcgatgaagcggacgactaacatgagttacagcctacgcctgacggcgatgcataccacctaagcgacaccttcggtcgaccacttactcccttcgacgaaacctgctacacctgcttcagtccctcatccttctactacgcaccgcactacgcctactccgagccgtacgactactctcaccactccaagccaaagcccatctacagcttccgacttcagcatgagcaacagtcgtattactgtagcggatactgatccaggcccgaacccgctgccgacgatggctgttgctatggatctcgctttggatc

SEQ ID NO: 48062 - DNA, 444 bp, Zea mays
  Clone ID: LIB3066-024-Q1-K1-G1
ccgtctccgtctccgattctggatctgcccatgccgtaacccgcaggctcccggcatctcggtctcgcctccaaaattcaccttcgccgattgccgccgtgggccgccgcgacggcgttgcggacgcctcgtaccacctccgtcgcattctccgctgactcccccctcggtggcgtcccactgcgctcctcaacagcctgctccattcccacgccacctcctctcgctccgctgcgaccaccgaggaccaccagagcgggacgccgcggaactcgtcggccacgtcctggccgtcgcgcatgctgacgacgaggccgttgccctcccgggcaccctcgacgcggagctcgcgcgcgtcctgcgagcgcacggcgccgctcaagcggcgggcgcgccggcggaggaacaggttgaggtatgtccagaacagaggacagggaggga

SEQ ID NO: 48063 - DNA, 393 bp, Zea mays
  Clone ID: LIB3066-024-Q1-K1-G10
tgatccacgagcacgcggagaggctccggcgcgcgctggccgacacccggcggcggcactaccgttcgctcgtcggcgcggccgatgcggctgctgctcggcggataagggagaaggagtcggaggcctgggaggccgcgcggcgccgcgccgacctggaggatcgggtcgcgcggctgagggcggaggcggcggcgtggcaggcaaaggagctcgcggaccagtccacggccgcggcgctccacgcgcagctgcagcacgcgaggcgcaaggccgccgacgccgaggaagggggcaacgcggcggacgacgccgggtcgtgcttcgtcgacccggacagggtggtggagatcgccccgccgtcggccaggccgtgccggtcgtgcaggctgc

SEQ ID NO: 48064 - DNA, 445 bp, Zea mays
  Clone ID: LIB3066-024-Q1-K1-G11
cagcaaggtgctcgccatttcacgcattatggtggcatggcaaccggttggcatatcaatgggggtcttcgacatgtgccaccggtatctgaaagaaaggaagcagttcggagtccctctggcggcgtttcagctgaaccaagagaagctcgcccggatgctcggtaacgtccagtcgatggtcctcgtcggctggcgtctctgcaagctctacgagtcggggaaaatgacgccgggccacgctagcctagggaaggcttggaactccaggacggcccgcgaggtggtctcccttggccgagagctgctgggtgggaacgggattttggccgacttccttgtagccaaggcgttctgcgacctggagcccatctactcgtacgagggcacgtacgacatcaacagcctggtgaccggcaaggaggtcaccgtgatcgcgagcttc

SEQ ID NO: 48065 - DNA, 450 bp, Zea mays
  Clone ID: LIB3066-024-Q1-K1-G12
cccacgcgtccgcccgcagccgcccgctgctccggtccttccgaacgctggcctgttcttgggtgcctttggcccattcgtcaggcggcccctccgcaggcgacgcaggcgcgggcacgacggcgcgtggccccgactacgtagacagctaaccggtctccgcctccggcccttctcctgtcgcccgattgagtcgctgctgcaactgccaacttcacccccggcgagctcaccacagtcttccggaaaggtgctatcaatttggaagatggcagatgaggagcaggccccaagctctaagaaaagggttgcaggtactcaaatcaacaaggattatccggaacctgatgatgaaggaacagaacaagagatgggtacatttaagaaagctactgaagaagttatggcaacacggaggattgtaaaggttcggcgccagcagacgtcatc

SEQ ID NO: 48066 - DNA, 443 bp, Zea mays
  Clone ID: LIB3066-024-Q1-K1-G2
cccacgcgtccgcggacgcgtgggcggacgcgtgggcttgaccaaccagacgcaccggccgcgggggcgatgccctgctccacgctccgccggcggcggcgccattcccgccggcccaccgtcgacgctctctccgaacgcggctccctacacctttctcgcgcgtcagtcccgcgccccacccggacgcctccaagatggtgatgctccaaggttgattgataataactttgtgttgtatggagaggacaacagttcttattcggtgccactggcagcacaatcaggaatgaagcagagtgacactgtttactcaagcagctcgcatggaacacaccaaggtcagccaagctccgcacgtggaattcctgtcggtgtttatgcatctgcaacgtcctcaattgcgatagtttcagagccatcagtgaccataggttctgatt

SEQ ID NO: 48067 - DNA, 449 bp, Zea mays
  Clone ID: LIB3066-024-Q1-K1-G3
cccacgcgtccgggagtcagttcaaggaaagaagcacagcatcaaatgttgaaattgaagtgcctgttccttcagatgccacaaacccaaatataagaacttcaatgggttctgctgcatatgctcctgagagagatgcaatggtctggaaagtaaaatcattccctggtggcaaggaatacatgtgcagagcagaatttagtcttcctagcataacagcggaagaaggggccccagaaaagaaggcaccaatacgagtgaaatttgagataccatatttcaccgtatcaggtattcaggtccgttatctgaagataattgaaaagagtggttaccaggcactcccctgggttagatatatcacgatggctggcgaatatgagctgagacttatatgagttttctcttttctggctgatggaagacatttatgaaactgcaagatacat

SEQ ID NO: 48068 - DNA, 410 bp, Zea mays
  Clone ID: LIB3066-024-Q1-K1-G4
ggcactttccctgcctgattggcgatttaagcggtgggggagggaaggccgatggtcagtgaaagagagtaggtggacggacggtgctggcatcgccaattcaactccgcatctgcatcggcagcgcgccagctccatagtgtaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagacca

SEQ ID NO: 48069 - DNA, 449 bp, Zea mays
  Clone ID: LIB3066-024-Q1-K1-F2
cgaaaacagagcaaatccggcgagccggtgcggcggagggagacgcctgctcgagaaggaggattagcaggaggcagcggagatggatccggacgcagtgaagtcgacgctctctaaccttgccttcggcaacgtcatcgccgccgccgcccgcgacatccagaaggaaatggtggctaaagacaaggctcaagcagcacctgcaagccatgatgaagttgatcttgatgagttgatggatgaccctgaacttgagaagttgcacgcggagagaattgctgcccttaagaaagaggttgagaagcgtgaagtgctaaaaaggcaaggtcacggtgaatacagggaggtaattgaaggggacttccttggggaggttactggcagtgaaagagtcatatgtcatttctatcaccgtgaattttaccgttgcaagatcatggataagcatt

SEQ ID NO: 48070 - DNA, 491 bp, Zea mays
  Clone ID: LIB3066-032-Q1-E1-G11
tggcttggaacctttgggctgatttatgtgcttgggtaccctacccgtctaattaagtcttaacactagtacaagtgatactataggggagataagaggcggcctagggaccgttcccggaagcgagacgctaggcggtacactggaagcatgggtcgcgggttcttgtaccgctaatctttcctatgggactagaactaagatggttttggggtgtggagggcatgcggagaacgcgcatacagtagacgcgagtacggataacgccctgacggttactaggactatcggaaatcatggcgaatacttcgacgataaacacgatagtatcgtctctttcgcgacaagtaacaccataactaaggacgccgccggtgccaataccggggccgtcggcacaccggaagggtacctaggggataaccctagtaatacccgctcgcttaacgccctttctagcgcgtaactcgtatacttacggaaccgcctat

SEQ ID NO: 48071 - DNA, 134 bp, Zea mays
  Clone ID: LIB3066-032-Q1-E1-G2
tttcatatgctgtacctgtagttacgggcactgattctgccgttggcgggaggaataagaagattaagtgtatagggttgaagcttgatgacgcccactctaagtcttccgctaagtctcattgccctccggct

SEQ ID NO: 48072 - DNA, 479 bp, Zea mays
  Clone ID: LIB3066-032-Q1-E1-G3
tggcttggaacctttgggctgatttatgtgcttggtggcggtggagacgcattcgtcgggtacgattgataagactgctattagtggtcggctgatgcctggtcatgctgggtatggttctggtgggtctatgttgcggactacgcctaggttcgagaattatattatgttccatttgttgcgttgttgggttaagcttacggagttgcgtacgtatgggttgttgcctcatgatcgtagggttaagtatggtgttgatatggggaagtcggcgttgtatgcttagtatcgtgaagatacgagtcgggggtctaaatccgcttactttgagcgaaatagtaccaacaacgaaaagaacactccccccaacggcctgaaaaaaaaaaaaaaaaaagggtggttgtctcagaggacttaagtccatgcatgtgcgtacgtgatgctacagtctcctcacagcgctattcaaacctaaccta

SEQ ID NO: 48073 - DNA, 495 bp, Zea mays
  Clone ID: LIB3066-032-Q1-E1-G4
gcttggaacctttgggctgatttatgtgcttgggaatgaagacggtccgcccaccagcctagccgttcttagtctaaattcgcgggtcccaaccacggacgtcggtatcggccccatactctaagcacatgaatccctcagccatccctcctataaggaacggacaacggaatagcgggagagaaaccctcacactatcgtatcggtcggcgtgaacaacggaagtctcccggcgaccacgctaagaggaatataacacgtttagtagcttcataaagcaagcgacatacccttccctaaacggacaaataaaaaacggaaggagggtcctcacgctatcgtcacggtaatagtcggaagttgacgggtagccgctacgctttgtaacgtcggccctatcctctaggcagcggagtccgaccctccacacttaagcgagggtacttatacgtgccgggataacggtcactgtaccatggtaatggtcgttatacg

SEQ ID NO: 48074 - DNA, 506 bp, Zea mays
  Clone ID: LIB3066-032-Q1-E1-G5
tggcttggaacctttgggctgatttatgtgcttgtggatgtgcgggtggatgtgcgggtgataagacggtgcgtatagataacgtgacgagagttccgccttcttcggcttctcctcgtactgcgtacggcgagaaggaagagctaaagggtactgacgtgaaagtgcttgggttcggcgggcttcctgatactattaagccgggtgttcttggtaacggtaagatagatagtatgaaggtcgcgtaggaggtacgggtactggtgcgtggtggtatcgggaagtagataacttctacatttaagggtgatccttccgctggataatctaatcctataggtttccgtaagggtgatgcgattacttaggcggacggtaactcgtcggtgattatggattcaagttagcataaggaatacggcaaccggactgagacctcatgtgcggacaattcggctactattggtaagggaaattccgatgggtagggtttacttgcgcggagt

SEQ ID NO: 48075 - DNA, 489 bp, Zea mays
  Clone ID: LIB3066-032-Q1-E1-G6
ggcttggaacctttgggctgatttatgtgcttgaaaaattagtagtcagtgacggtcggagtttgggtatcgtctactgcttctgtggtcgttgctgtggcttcggttgtgtggttggtgctcgtaggtgggggagttgtggtggcggtggagactcgtacgaagatcttgctttttgattcgcgtattaggatggtggggaagtatgttaataagcataaggcggcggatgtggcgatggcgtcagagacgtaggcggatgtgcctaagaagtgtgcgaaggtggtgtggaggtctgttaaggaggaggctaagatggttgtgatgtttgaggtgtggagggtgtcgaattctcgtaagattcatcattcggatgttgctgataattctggtgttcgtaagtgtgttactggtccttgtgatgttgctattacttgtgttatgacgagtacggcggtgtaggatatgtagaatcgtgatgaggagcct

SEQ ID NO: 48076 - DNA, 501 bp, Zea mays
  Clone ID: LIB3066-032-Q1-E1-G7
ggcttggaacctttgggctgatttatgtgcttgtttatgtgcttgtaagactagtagagttgatgctaagcatttgtagcggcctcgtttcgagtcttggtggccgacgtttaagtcttctgaattgaatttaaataataggactatgactgagaagtcggctgagtattttcggcctaagaaggggcataggttggttgctacgtcggtatagttgtatggtcttagtagttctaaggacgcttaggctgttcctagtaatgttgattataaggatagtagtattaaggcggaatagttggtggatagtcttccgaagttggtgagttcgaatgtgcctgatactactctttatcttagagggcctgattcgctaagttcgcctgaggcggattaagagtagaaggttagtaatctgtggcctacgatttagaaattggtgctggtgacagcgctaaagtcggagtagactgtcgagatagagtgtcctacggcgaagaa

SEQ ID NO: 48077 - DNA, 505 bp, Zea mays
  Clone ID: LIB3066-032-Q1-E1-G8
ggcttggaacctttgggctgatttatgtgcttgctgaaacttctctttctcgagtcagactcccgcctttacttacgtcgatgtattcgtgtcatgtaccttgcgtcgaaacttcctttcgtttcaaaccttgctgacggaagcttgaagggagtatagagcagaggcgaaacctacgttaatctacgttaatctgcctcagttgcggagttgtgtttgaggaggattgtcgcggctcgttgaggttggttggccgggtatgtgttgtgccgggacgtacggccgtcggggttagattgtgtttgttttcgtgttggacttgaggttgaggttgtgtttccgtttggaggtagagtagcctgtcgtctgcggttatgtggaggttgagtgggttcgttcgtgtgtgttgggcggtgaggttgaatatcatctatactcgcgcatacgtagctgtcggggagttaggcggtgccttagattacggcgcttactgtgatgtcgagct

SEQ ID NO: 48078 - DNA, 410 bp, Zea mays
  unsure at all n locations
  Clone ID: LIB3066-032-Q1-E1-G9
tggcttggaacctttgggctgatttatgtgcttgtttatgtgcttgtagtcctctggtccacggcgttagagttagattgatgcgttcagcagtgcatcactccagtcctaagagattgatttaggtaagacttaccgactgacggagtcgtccttctcgtctatgcggtcttcttccgtgtatgtttcggttcgttcggttcggatggttgttgtgtggtgttggtagctctggcgtcattcttcggatcatgctcgttataagtttagtgatgattgtaagtcgcttatggagatggttggtaatgcgacttagtgtaatgtgtggtcggggtctattgatcattgtccttcctcntgtgctactgcttgtcttggtactggtgaggagattcatgttttgtgtaata

SEQ ID NO: 48079 - DNA, 486 bp, Zea mays
  unsure at all n locations
  Clone ID: LIB3066-032-Q1-E1-H1
gcttggaactttgggctgatttatgtgcttgtttatgtgcttggcacttccgtcgtcgacgagcttatcggtattaccggtaagtgttcccttagtactaacgctgagaatgccgaggagaattgctgcgtttcttgcgagtcttcacctcgtcgtttcggcgtctcttagcatactagtggcgcgacttctcctgaggagatttcgcattagaagattaaggacggtaagttccccgccgacgcttctaaggagggaggtgcttctttcggtactaaggccgataagggtattaccgaggccgccggtatcgacaaggagattattatttaaggttacgatgattccggtaagtgtcgtgttaagcatcatgaggttggcgtttgtcccgttaagcggtgtgtcgcctctaagaccggttttaacgagttactatagtccgttactgattcgaatgtctanggctcggtctgtcacgttactact

SEQ ID NO: 48080 - DNA, 385 bp, Zea mays
  Clone ID: LIB3066-032-Q1-E1-H10
tggcttcgaacctttgggctgatttatgtgcttggatgagtacctctagctatagaaaaccctttgcggttggaccgaatacttctatgcgctattggcctatgaggaatccacttttatcctaacctacattttcggactatttcacctccgcgacgctttgacggccgaagaggttacagattttactcgtaatagttatggaatattattagacgagaagaccgttactattaacgtcaccacaaacgcacttaacggacttaagtttatatctcccgtcggtactacagtatccgcgacgagtactgtactgacggcttgctcgatttgtagtacgacgctcgggaaggcctctggagtcgttacaggcggagtcatttcc

SEQ ID NO: 48081 - DNA, 491 bp, Zea mays
  unsure at all n locations
  Clone ID: LIB3066-032-Q1-E1-H11
tgcttggacctttgggctgatttatgtgcttggtgaggagagtctggagtgggagggcatgggttgctggacgtctgtagtcgttattgttgttcgatggtcaccccaattttgtgtcttcgttgatgttgtatctgtttttggttcttctttgttctttagactctgtctgtctggtgttagccgttctgtagcccggactactctacattctggtgaagacgagggagacttcgtatacttagggagggtaacgcggtaattagaccggtgttaagcctcgggaggcggcgcgtgacgaatacggtaccgatttcattgggtggcatatcggtaaccttgattcctagccggagtgcgccaacgctcatcataacgaagttcntcgtggatgtcccgccttttgtgtcgcctctacggactccgagttcgggataacggatagcgcttggattggatttcacgggtagactccttgtccgataatcccg

SEQ ID NO: 48082 - DNA, 405 bp, Zea mays
  Clone ID: LIB3066-032-Q1-E1-H12
tggcttcgaacctttgggctgatttatgtgcttggtattcctacttctgctcatattgctcctcttgttattgatgttaagaggaatgttagggatcgttacgcgttgacttctgtttgctccttaactgggcccgttgcgccttctgcttattcggttattactttcactattggtattggtactaattttgtgtggagttccggtgttgttgcgacccataattagtattacgttcgggtcgattatcggactcctcgggctggttttcctactggtgtcgtgtcggtcgttactcattattaggcgactactagggtaactttgcctaagagcaggctccaagggagttgacgtcgtcgtcctgagacgactttggttccaaaggaccggactgcggtcgcc

SEQ ID NO: 48083 - DNA, 518 bp, Zea mays
  Clone ID: LIB3066-032-Q1-E1-H2
gcttggaacctttgggctgatttatgtgcttgcttatgtgcttgaaaagccacgggtcctagccctatcgcgtaccggacacgcaatccctcggcgggatcacccccctcggagtccgcgaataagcccggggccggagtagctcacgtaggccccggcggggctctttcgtcgatagtatctcccgttcataaccctacagccgaaataaaaggatgcctgtccgaggaaaccgagacgcttccgagtagcgtcattttcggtaagtaagagcagaatactctaaccgcacggataaatcgaataatcgatgggaggaacccaacaagagtagagggggttcaactttacgaactcctagtagtagtagcccgccgtaaataatactaatcttcacagacaacgagtataactaaacctagtcccctcccggcagtacgagaactgccgcataacaccaaaaagggcgaagaaaacgttttcccaaaacccgcccccccgcatactcgacgcacaca

SEQ ID NO: 48084 - DNA, 282 bp, Zea mays
  Clone ID: LIB3066-032-Q1-E1-G10
ttggcttggaccttggctgattagtgctgttagtgctgtcaccgactgggtcgttggctcggtcaggacctttctgttttcggcagaaactcgttggatccttcggttaccatgagtcgtatattgcgagtgtcgagacccggagagcgttattgagtaaaccttcgggggtgctaataaactggagtctggacgggacgtttgcggtattggcgtgttttacctgcatacgcggttcggtcgcgataacatgataactcgggtggtgaaccgtcggctagc

SEQ ID NO: 48085 - DNA, 468 bp, Zea mays
  Clone ID: LIB3066-032-Q1-E1-E5
tggcttggaacctttgggctgatttatgtgcttggagataagtggtggtagtgagtagtaagttttgttggaagatgagaataaggagaaagagtggtagtcggttaaggagaaggtgcatgtggtggagaaggctgcttagtaggagacgtctaagcatgttaaggagaagggctcggcgcttttgattaatggtatggggcggcataggggtactgtttgggagcctgcggatgtttataatgagtcttgtgtgtgtcatggtgcgttcgttacgaagcgcgataattagtcggtgtggtaggtgtggtgtcggcttaatgttacgtgtaaggatcgttagacttcttatagtggttatgagcatggtcagagtgcgcctaggagtcatgatgatcggaatgttattgttagggaggttgctcctcggcggggtaaggaggaggttactcatgataaggataagga

SEQ ID NO: 48086 - DNA, 406 bp, Zea mays
  Clone ID: LIB3066-032-Q1-E1-E6
gcttggaacctttgggctgatttatgtgcttgttgatgtgcggatctcaacatcgcctcgtaccacccccacggtattcgccgttgccaaagacttacggatatgcatagcattaacatacgaactcctatagcctatacaaaacaacctcgtcgatccgcgaataaagtaaatacaacaacctaacccggaaatacgcaactcgatcaagacacagccggactataaggatacggcttacgacagcgttacttatcatcacggtaagtgttccgctatcgctctcctagatcccattgcgaagactgctaataccggcgtcgtaaacgttttacttcaggcatccctaatgtcaagcggttatcacggcttcgcgcggtgcgccgtccgcatttacgtaaagcac

SEQ ID NO: 48087 - DNA, 501 bp, Zea mays
  Clone ID: LIB3066-032-Q1-E1-E7
gcttggacctttgggctgatttatgtgcttgagacaaccggaagtcgtcctagtcctccgatcgcgctccatatcagcaaacccgccgctcatactacgacataccaacattcctccaaaactcacatcgtacggcatcccacacaaaccatcccgaccgcacataccactcaaacaacatatcaaaggcaaaaaaatgacccccccacgaacctagccaacctgcacacacataaaaacaaagcaagaaacgcgaccaagcccgaaacgccagccccatgaccgcgttatccggcccacgaacactcgcgcacgcatccccaagagcaaaataatagtacgccaaggttcaagcgtactcaagccacctcacacccaccgactacaaccaataacaaaatatgaggaggtcgtaaaccgccctaccacccctcctcctgcttgacgcagtactttacccacgcgcgtctctctttccaccccgccgacaaacaaccaaaa

SEQ ID NO: 48088 - DNA, 498 bp, Zea mays
  unsure at all n locations
  Clone ID: LIB3066-032-Q1-E1-E8
ggcttggaacctttgggctgatttatgtgcttgaggaacccgactcctgagcggtcccgttctcgggcgcgtcgaacggcgtctctaatgttggagcggtcgtgggagctacttacttaccggaaaggggactcgtaggactcgctctattatccgcagaaagacccaatccgggcggcaacagggtctctgcgcgttgtccgggcggattactcctatcaccaggtcctaaaataagagggtcatgggtagtaatagagcttagaatatacgattttaatatcttcggtaacggtatccttttccttttcgagtcaaacggctccggaggcgaagcagtggcgatagttcccgttgattcgctacccgactcgttctcgaagttgtctagggagtcgggaacttacggctacgttcccgctcgcgtcggaaactcnggcagaccaatggagcgcgactcgtggaagcctctcgccatcgaaccttcgtagatgccta

SEQ ID NO: 48089 - DNA, 247 bp, Zea mays
  Clone ID: LIB3066-032-Q1-E1-F10
ttggaactttgggctgatttagtgcttgggtaattacacgtagtggtgacggtcggcgcattggatcagtacatgcccattgttacgacagagatcactgagttcaagtatgtgtccacgtactgacgtgcgtgtatcatatttcacatagattcctatccataaggagggcgattacatagggttcataaaacgggttatatccgtacaaggatcgtcacgcgcgtgatatcggataccgactagc

SEQ ID NO: 48090 - DNA, 405 bp, Zea mays
  Clone ID: LIB3066-032-Q1-E1-F11
tggcttggaactttgggctgatttatgtgcttgtttatgtgcttgtttatgtgcttgtcagtcacgcagtcgaacctggagttaggtctgagtgaggggggggtggaggtgagacggattatgtggtggatgtgtattggatggattcgacgattactatgtggtatgcgtcgaatgagtagagttggaattttgagctttgtggtgatcctattacttcgtctctttatactgcttctggtcgtaagcctgctgttcttgttgctaataaggttgggtctgtttagtctactgggtctgttggtgagattaatgcgtacggagaggagtagaagaagtcggatgcttcgcttaatgaggcgcctgctaaggtttctgctagtagtggctgtattcgtgcttccg

SEQ ID NO: 48091 - DNA, 496 bp, Zea mays
  Clone ID: LIB3066-032-Q1-E1-F2
cttggaacctttgggctgatttatgtgcttcgttatgtgcgtggataagcactctgcaattccctgggtcttctccttcacttctgtgcctttggattaaatttcaacttgagtatttagtgccttaggtttcatttgtccttctctgtgttggttcccggggtctctatttcgagtggcaggaacttgtacggtcttagccgggcgttagaagtacttaagctgccggtgggagattgggaaacggtggaaaaagagggggtgagagccggggtggaagacacggaagagtgggagtaggaaagggaggtggacgatgcggatgcgaagacctgctgacctgatggtcttgatactcgttttgagtgtcgtgatgctggtattattattgctgttgactctaaggactgtgcagctgatgatcggtttaaagacggattcaccactttaaaggtcgtcagcgacgctaaatcaacaagtgcgggtatcaactcag

SEQ ID NO: 48092 - DNA, 513 bp, Zea mays
  unsure at all n locations
  Clone ID: LIB3066-032-Q1-E1-F3
tgcttggaacctttgggctgatttatgtgcttgttaggactacgcgggattagtcttgacgaagtccccttaccccctccaggtacgtaatcttgacgaagtcgtcggttacgctgcttcttgttggttcacccttacggttatgataaaaccgaggactggccattattcattcgtgcttactggacgaattcacgctgtcgtcgtccaatcgtataccgagaccgagaccgcgcggccgctgtcgtcgtccaatcgtataccgagaccgagaccgcgcggcgccccgccctaggcctagttctattgttcatcgcggggaggataataccgcagccccagatcgtcgtctcataagcattcatcgtttcatcctacccctagggcgtttccaccctcaagttcgcacgacctggtcagtagacgctatcgcactccccctattatcgcgccggaaggaggccataccgtanaaacgtaacgcgccttcggcctccgttcgtggcgggtcac

SEQ ID NO: 48093 - DNA, 505 bp, Zea mays
  Clone ID: LIB3066-032-Q1-E1-F5
tggcttggaacctttgggctgatttatgtgcttgcttatgtgcttgcttatgtgcttgtctcctggcggagacaaacattaggagacgaggacgaaggctccagaaaccattagaacacaagccatgcaaagaaagattgctgctaaaaattactcttatactattaaacggacaaattactaaaaagtacctcagtccaactccggatagaacaacccctaaagtaccactacaactacaacactctagttacatctcagaaagaggccccattagacatgacacggacttacggtaaaagttaaccttaaagcgtaccctaataggggtcgtaaacgataggtaaatatcccaaaaggactcacgggatactagcggtaaatatcccaaaaggactcacgggatactagcgtaccctaagttactacttcctacggcgtagattcacaattaaagcactagacccccccacagtacccccaaggaaacaaggagtcggatagc

SEQ ID NO: 48094 - DNA, 480 bp, Zea mays
  Clone ID: LIB3066-032-Q1-E1-F6
tggcttggaacctttgggctgatttatgtgcttgggaagcgcggacgctaaccgcggcgtacgcgtccgggctcagcgtcataaatcgcggagtatttaccttaagccgcgcagcgggccctgggcgttccggtgaacgttcccgtacttcaatattcaaagcggtggataccgtgcgaggtcggtcctatagagtagtgagcattgtttgttattagaggcggaaggacaacgagttgtcacgtctcaggttaaccagggaatacgcgtttctcacggcagattatcactccccaaacaaaaaaaaaaaaaaaaaaaaaaaaaaaaaaaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaact

SEQ ID NO: 48095 - DNA, 406 bp, Zea mays
  Clone ID: LIB3066-032-Q1-E1-F7
gctccgaacctttgggctgacttatctgcttgtggatctccgactccaaatgatccgtacgcgcctgggcacatctccacaaatcgggaaccacgtaatacgaatacgcgtaagcgtaaggatacgttccagctaaagagtgccacacgcgatcagtattcgaacgatagctgatactatcgcatggtacggtactacggagtagatactgcagtgattgctatgactattaatattgcaagcacgccaggtgaccatcgtcctcttactcattgaatacatctctacggacaatacaatagcaccgattcgacgttttggttatcgtactagtactggtagttcacgctggcctaaggatcacaaggatgctatggacactaatgctcatgatcgtatgtccaac

SEQ ID NO: 48096 - DNA, 459 bp, Zea mays
  Clone ID: LIB3066-032-Q1-E1-F8
tggaaccttgggctgatttagtgcatgtaatgttcgttatgtacttggactgactatcataagacggtgcgtataaataacgtcacgagggttccgccttcttcggcttctcctcgtactgcgtacggcgagaaggaagagctaaagggtactgacgtgaaagtgcttaagttcggcgggcttcctgatactattaagccgggtgttcttggtaacggtaagatagatagtatgaaagtcgcgtaagaagtacgggtactggtgcgtggtggtatccggaagtagataacgtctacatttaagggcgatccgtccgctggataatctaatcctataggtttccgtaagggtgatacgattacctaagcggacggtaactcgtcggtgattatggattcaaattagcataaggattacggcaaccggactgagacctcatacgcggacaattcggctact

SEQ ID NO: 48097 - DNA, 393 bp, Zea mays
  Clone ID: LIB3066-032-Q1-E1-F9
tgcttggaacctttgggctgatttagtgcttgtggatgtgcgggtggggaggcgcttggggctatgtcgtctaatcttaagcctccttatacgaatacgcattagcgtaagaatacgtcgactaaggatgcgattgcgatggtgtttggggatagttttaatatggacggtacttatacgggtgatctacttgggactattactattaatattgctaccggtgctggtgatgatcgtactcttactggtttcgggattcttaaggcgaatactatcggtgcgattcgtggttttggttatggtactagtactggtagttcaaggtggcataaggatgagaaggatgctatggatactaatgctaaggaccgtatctccaagaagataacgcct

SEQ ID NO: 48098 - DNA, 418 bp, Zea mays
  Clone ID: LIB3066-032-Q1-E1-G1
gcgggcccccccccccccggccccccccccccccccccccccccccccccccccccccccccccccccccccccccccccccccccccccccccccccccttaaatccccggaggggcaaaacaaaaagggaaaacccggcggaaaaccccagaaaaaagggggccccggccaaaaatagccccccccaaaaaaagacccaacccaaaaggggcaaaacgttaaaaaattcgggggcaaagggcccggacccacccggaaaacccaaataactggcaaaaagagcccagggcccccaaataacgccaaaaaacgcccccaaacgcagcgaaaacacccccggcgaaaaacccttcccaaaaaacgtaaaacacatcaaaaaacggtcaccccagaatcgcaccaaacccaaccccccg

SEQ ID NO: 48099 - DNA, 485 bp, Zea mays
  Clone ID: LIB3066-032-Q1-E1-E4
tggcttggaacctttgggctgatttatgtgcttgactaaacttatggcccaacaatgaattgcgccaatccattacaataataatctaaccttcactgaaccttccttcactgaaccttcacagcaaaaccttcacaggacagaatgcatatagggcgcatataccacacacgaacgaaatacacctaccaatccaagtacatcttcccccccacccaacgagccgacaccaaccaaacactcccccccccagacccccgtaaaggccctacccatgttcaacttacactgagcagatttcgctgccgcgagaacctccaacctacgagccgcagggagggatccacgctattataaatagaaatcaaagtaagcgccggacccaaagtcggcgccaaggaccacaaaccgatccatcatattttggagcatgaaattaaggacatcgacactccggtagtaccttgagcaatcttctagtctgg

SEQ ID NO: 48100 - DNA, 374 bp, Zea mays
  Clone ID: LIB3066-032-Q1-E1-D3
ggcttggaacctttgggctgatttatgtgcttgtttatgtgcttgagaagttgattacttctacgaataggcatgagtctgggtgtatgtctgggtagggtattcctgttaaggcgcattatggttggaattctgtgcttggtgagagtgcggttactaaggctactgataaggagaaggcgacgtgtgctggtacgactgattagactaagtgtgagactcttgctacgtgttctgcctgctattttaatgctgcgtagtcgtatgaggcgacggttagtaagagtaagacacatcctgttacggagcatgcctggggtggtgagtctcctcgttgtgctcgttgtgggtggtctaaggaggatattgtgaga

SEQ ID NO: 48101 - DNA, 515 bp, Zea mays
  Clone ID: LIB3066-032-Q1-E1-D4
ggcttggaacctttgggctgatttatgtgcctgagatatttaccggaaactcgcaccctcaacccgccgggggacatcaggtgcacgaatcaggactcacgtagcgggaatcacactagatagccacctaaaaacgcattcgaatattaacagcatgccggagaatgccgtcctgattaggaccatcactcctgactcgaaatctcgacaagtagaaccgaagataaatgactgggcatccggggaacacggaacccacccatcgacggcccattcagcatccgttcattagttaggtgttttacgggatgatggtaaagacatagctctgggcaccaggacggtaaaggtagtgacagacaaacctcatcttaagcacacgccgggactatgcaagtcggcgtccgatttatacctaatgactcccggtaaaaggacgtccgctaaaagcgtgactacgcgtcaccttaacaatatacgacagactagcttctgaggaaggctcataggggttt

SEQ ID NO: 48102 - DNA, 499 bp, Zea mays
  Clone ID: LIB3066-032-Q1-E1-D5
ggcttggaacctttgggctgatttatgtgcttgtactgggtgagtctcggcgcaggcagaaaacggttgacgttgaggacacttagttttctgctcgtgataatggaatcggtacggctaaggtcgggcctgttggtgatgatgttttgagggttgctccttttagtactgcggggtgtttgtgttatatcggcgctacggctgggacggggtagaaggatgttcatgctggcgatgaggtgtagcttaagaggggcacttcgatttctaagcattttactgagtatgggactgctagtaatcgggatgatacggagaagactcggtactatattcctcataatgagtcttgtgcggtctttgaggagtattttgcttcttctattgaggtgttttcgaattttaaggtcaatagggagaagacgatttagactacgcctgagattcctaatatttttgtcacgcatgctgttacttaggttgcgtctctctcgcacgt

SEQ ID NO: 48103 - DNA, 498 bp, Zea mays
  Clone ID: LIB3066-032-Q1-E1-D6
tggcttggaacctttgggctgatttatgtgcttgaccacaccgcattcaagcaccatccggtgctttacgaacttgccgcaaacactaagccacaaccctcatcactcctgcctctaaaaaaaaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacgggatgtgtttcgcagtggtgtaccaagtgtggtgggcgcggcggccatgtgtagtgcgattgtcatatccgttagtgtttcagtgtttgtcttccctgtccctcctttccttccctctgttatgcct

SEQ ID NO: 48104 - DNA, 295 bp, Zea mays
  Clone ID: LIB3066-032-Q1-E1-D7
tggcttggaacctttgggccgattgatgtgcctgcagacgttgttggtacagtaaacgttgtagtaagccagatgagtacacgacgtagttcaactatcgtcgctcgaaaaggcaagacactgcaacgacgaccgaagcgacgtcacctccgatgcagaggacgtttcaaccgacgtcgataggacggagactgagaacatcacggataccgcgtgacaagagacgaatgtctccggtagatgctgactaactagctagggcgagagatactcatgcgatatactcgaatcccac

SEQ ID NO: 48105 - DNA, 504 bp, Zea mays
  Clone ID: LIB3066-032-Q1-E1-D8
ggcttggaacctttgggctgatttatgtgcttgcttatgtgcttgtttatgtgcttgtttatgtgcttgcttatgtgcttgacggataatctcccagggtgtccggcgcacctgtatagaggaaaactaattctataaagactgaaagctgcttatataaggagaggttctcctgagcactcgacgatcgccttctatctccaaagaaccccgaccattctccccatgccgattccgaagtactaacggtcgacttaaagacctagaacgtctccggaaactcgaaggagcccgtaattcccccaagagcttctggaagtcacttcataaacgcgaacgaattccagaaaatatcgtagaccatacgacggaccagtaggaacggatgaaacggcccgagccggcctctcgagtaggccgataagcgaggattctcacgaagtcgacgtcaatacccatagagtaaaaggactcacaccagagtagcacagaagggcggacgcg

SEQ ID NO: 48106 - DNA, 444 bp, Zea mays
  Clone ID: LIB3066-032-Q1-E1-D9
tggcttggaacctttgggctgatttatgtgcttgggtatggtggtgtagggtatggatgatacggatcataaggagtttttgttggtgttgtctcctgagtttggggagtctaagcttcggcttcctcattgtgttggtactgttgagcctgctgttattccttctccttctcatactcttacttctattgctacgggtgctcttaagcttattcttaagcgtgttattgctggtacttagggtactgttcggcttcctggtggtacgactcctgtttctgctcatcgtattgctggtactcttggtgggtatactaatttggtggcgattcctgggtcgccttcggtgaggaagccgctttctattagggtggggccccatactactacgtagcgttcgcgtgttacccgtggtgtgggtgcggctaacgggccctagtaggg

SEQ ID NO: 48107 - DNA, 499 bp, Zea mays
  Clone ID: LIB3066-032-Q1-E1-E1
ttggcttggaacctttgggctgatttatgtgcttgtgcatgtctgtacggatgatgacggacttgcttattgccgttaccgtagccgttctgtctgcctccggcgatcgccgtcgtggcggctgatccggaagatgctattcgtattgtcgcctttacacaccaccgacgcgactcgacacgaccacacacgtacggcgatgggcccacgacaaccttacagatacaacccaacccaacccacgcacccgcgctaagctgcctcgcaactacgtgacgaaacacacgacccggccccttacccgcccgaaaaaaaaaagaatcccaaaaagtaaaataaatagaacgaaaaaaaagggtggttgtctcagaggacttaagtccatgcatgtgcgtacgtgatgctacagtctcctcacagcgctattcaaacctaacctatcggttgctgccccataatgctgcgatcgggaaaatttcggtgccatttaatccaactg

SEQ ID NO: 48108 - DNA, 396 bp, Zea mays
  Clone ID: LIB3066-032-Q1-E1-E10
tggcttggaacctttgggctgatttatgtgcttgtttatgtgcttgcttatgtgcttgtaagacttctccggagcctaaggaagaaaaaccccagggtgaggaaaacacggacgttgcgaggcgcgggtcggctttccgctcgggaactgctccgccgccgtctcgcggaattgccgcctagacatcgtcaatgccataacgaaatcgttagtagcaggttccgacgggcacgtcgttcacctcgccagggactcgcggaagtacgaaatctcactggaaaacgctgcacgaatccccggtgtctaagccgatgcgtacgatattaagacgcatactcccctcttcgtaattaccgctgtcctggaccgactaggattggcggacttaagaccata

SEQ ID NO: 48109 - DNA, 481 bp, Zea mays
  unsure at all n locations
  Clone ID: LIB3066-032-Q1-E1-E11
tggcttggaacctttgggctgatttatgtgcttgtggatgtgcgggtggatgtgcgggtgcttacttgagtcaagcaaccaggctgaaaacgatttgcgttagtagtagcagtagtagttggtgcgcgatgtcggcatcgtctggctcttgttcgtcgtcctcggccggcgccgtgtaggtggcagcggagccggcgttcgtcgacgacaacactgttgttgttgtcgtcggtatggtggcggatgacggtgagttgttctagtagcgtgtgattttggcgagtgcggaggaggtgcgttgtggtgtgcttgagatgtatgttggtgcggttcatgattatcgtacggtgctgtcgggtgttgatttgtgtagtaaggaggttggtaataagaatacgtatgggtcggtggcgtcggttattaggacggttactgattatgttgntagtattgagcttaagactgatgattctgtggagtc

SEQ ID NO: 48110 - DNA, 322 bp, Zea mays
  Clone ID: LIB3066-032-Q1-E1-E12
aacccttgggctgatttatgtgcctgggtactgttaagtagagtcattagtcgcgtactcggtctagtgttgcgactgtgaatacggaggtgcgtgctgatcggcctgttgacgatcagcctaaggttaaggcgaaggagctgcctaatgacgggaaggagtctattagtaatgtttcggtgtctactgagaaggggctactgtcttctcttgcgtcaaagggtggtctgaaatcatcgccgtctgaggaggagggagaattggtgtaagttcggttcgtatctgataaggatggtactttggaacgagcgtttcgatagcg

SEQ ID NO: 48111 - DNA, 518 bp, Zea mays
  Clone ID: LIB3066-032-Q1-E1-E2
tggcttggaacctttgggctgatttatgtgcttgtcatgctgagtttgaggattgtaagggtgctcctcggcataataagaagcctcagttgttgttgtctgtagagtcgaggatgtcattgcaggaacgggagtagaaattaggaggaggagatggcatctgttttaaagctcttgctaattcactcaactgccagctgctagctccccagatgggaagagagactacccgggtatagagatgaaggtccatcgtagcgttactgtcagagtcgttactaagcataagcaggtaaacctgctaatccagcgcgctttacgccgccccctccagctgcttgtcgtcgcaggtcccttggtggtggctgcccgcgcggccggtacttgcggttacgttcgcgtgcgtgcggttgtgtccgctgcgcgtgctcgctgctgtgccggtgctgctctcctgcgtcttttgcgcgccgccgcaaaataggaagacgcccctcggcgctcccggtggaacaata

SEQ ID NO: 48112 - DNA, 492 bp, Zea mays
  Clone ID: LIB3066-032-Q1-E1-E3
cttggcttggaacctttgggctgatttatgtgcttgtcggtccgcactttctctctgctctcttagtcatggtagttggtgaaggccatttgaaagttgaattgaacaaccgaagttcaagttggaagtaccggttccaccgaaaagttcaagacttccgcttcccaagaattttccaccgtgggtcctccgtccaccggccgaacttgctccccctccctaataaccggcttggttacctccgaaccaacggaaaattgcggataaggcctccttatctcctccaaagagacgggccttaggcgctattggtaagaaaaagccgcgaatctgtacggcccctctacgttaacgccgttttatacccctccttttgcgcccccctcggtgattagaccggaaggtcccctttaagagctatggctccgaatctcacacggcacttgtggaacaactaccgcattcgaactacacatcgtaacgcggtagccc

SEQ ID NO: 48113 - DNA, 506 bp, Zea mays
  Clone ID: LIB3066-032-Q1-E1-D2
gttggaacctttgggctgatttatgtgcttgggtgaggaggatagggagttgagtgtaagagtcgaggtcctgttgtgaaattttagattctgtgttgttttccttttcttgtggtgctgcttctgtatgtctcttgacttaagacgcacaagtcggggagaggaaattgtgataaggcgtagtagcctacgattaccattggtgttagcgagaaggccgtttcctaggtatcgaaagtcagcgaccggtatccggaaggagtccccgatcctcctcacagttaattctaggccctcgcggctaacatctggtactccgaagacacccctaatagacacaaagaattcgacgtcgacacgacaacggcggaaggaacactctaaccccgtaacgactcataggccgacttctaggacaccgctacgtccgctacactacggtatacgaaagttgttataacgcgcgaacccatctgctaggaacctaacggcggatcgtagctaac

SEQ ID NO: 48114 - DNA, 460 bp, Zea mays
  Clone ID: LIB3066-020-Q1-K1-E4
cccacgcgtccgcccacgcgtccgtggacaatgtctactaccccatcatcatcgaccagaaggactgccccaacaacatctgcgtcaagtccggcgcctccaaggtggccgtcaacgacgtcgtcttcaagaacatacacggcacctccaacacgccggaggccatcacgctcaactgcgccaacaacctgccatgccagggcgtgcagctcgtcaacgtcgacatcaagtacaatggatccggcaacaagaccatggtcgtctgcaagaacgccatcggcaagtccatctgcttggcaaaggagctcgcctgcatctgaaccaattgactaacatgcatatattatatatataatcactctttcgaacctctgtctttctcacgtactctaaagtctccaccgaatatataatccgctggtatgtataatctttcttctttggatcatcacaaaaccaa

SEQ ID NO: 48115 - DNA, 433 bp, Zea mays
  unsure at all n locations
  Clone ID: LIB3066-020-Q1-K1-E6
cctgtggtctgctgagctctccaagctcgctgccaacgcgttcctggcacagaggatctcgtctgtgaacgccatctccgccctctgcgaggccaccggcgcgaatgtgactgaggtggcttacgccgtgggcaaggacacgaggattggccccaagttcctgaacgccagtgttgggttcggtgggtcttgcttccagaaggacatcctgaacctggtgtacatctgcgagtgcaatggcctgcccgaggtggccaactactggaagcaggtgatcaagatcaacgactaccagaagagccggttcgtgaaccgcgtcgtgtcgtccatgttcaacaccgttgccggcaagaagatcgccgtcctcggcttcgccttcaagaaggacaccggcgacaccagngagaccccggccatcgatgtctgcaaaggc

SEQ ID NO: 48116 - DNA, 436 bp, Zea mays
  unsure at all n locations
  Clone ID: LIB3066-020-Q1-K1-E7
cccacgcgtccggaaaaaatttcttgagtttgaaaataaactgaagagactagaggagctggaaaaagaggcaacagagctaagagcggcaaattcaaggctgcagcaggagaatgcacatcttattaggcgactggaggttacacgcctaccccctgtacctaagcccaaaactagtaaaagcattggaggaggctgatcggttgaaacaagaaactgataggttggctaaagaggttgaacaacttcagagtggcaggtttgcagatgtcgaagaattggtatatctgaaatggataaatgcctgcctacggtatgagctgagaaacaaggatgccccatcagggaagactgttgcacgagatcttagcaagaccctgagccccaagtctgaatngaggccaaacagctgataatggaatatgccaatgtgggt

SEQ ID NO: 48117 - DNA, 281 bp, Zea mays
  Clone ID: LIB3066-020-Q1-K1-E8
cggacgcgtgggctcgatgattagctgaggaccaagttaatgtctgttagaaactgccggagatcgacattgccagatgtggtgtggtataagataggcaatatgtgtgattattttttgttcgaggttatcaccccccttgccccagaaaagatgagaagatgtcgatgtaacaagccctctgcgcttctgtaagtagatgagtgttgctgcatgccccctgggtacatgtatcggtttgagcagaaaaaataaaaaaaaaaaaaatatataaataaaaa

SEQ ID NO: 48118 - DNA, 430 bp, Zea mays
  unsure at all n locations
  Clone ID: LIB3066-020-Q1-K1-E9
ccaagatctacggcaaggccatggagcagctgaccgcggcgatgggcgcctccgagagctgcgaggacgcgtggaagggcgaggaagatgtccccgtcgccgcgcacgacagggagtacggtcggatggcgcacatcgccttcggattcacacaccacgccgccgccgccgcatgaatcatcatgtcatatgcatgcatcgcttctcttccttgtcgcattaattttcatgcgtccaatgattcatatctctatatgcatatctctctgctctgccttgttggctggctcttctcatcattccctagcagatcgcatagtattagttgcatgcattatatngatgatgcaggtatttcgtcgagcaacaaggcgtactatcaatggtttttgaaatacccaaaattagtgaataaagggaaactggttat

SEQ ID NO: 48119 - DNA, 222 bp, Zea mays
  Clone ID: LIB3066-020-Q1-K1-F10
cgacggatgcagctaccgtcattcaggctccagtgccaccccgtgccatcgggctgcgtccgctatctaccgagcgttcgtgcatggaccagagcgtgggacggagcaatggatgttgagatggaggcagtcgaaggagagatggctacggacttgttatggtcttacactgacgagccgtacgcgttgcgccagcggaagatcatggctatgtacagttaa

SEQ ID NO: 48120 - DNA, 456 bp, Zea mays
  Clone ID: LIB3066-020-Q1-K1-F11
cccacgcgtccgatcaaatgcacaattgcacgttattgagggagtaggaatagtgtattcagaaatttaaaggtgtcaaattggcatctgagcaacaactctaattaacagaggtgaagccaggtcacaagtgagggaaaacaggagaagtgtttcacttgtcagcactgccaaaggaatcagagctttcgttctgagctgaagcatcgaccgaaaatttctgggcttccaaaatcttcatttcccgctcagcatgctctcgctcacactgggtaatgcccatgataatgtccagcatggttccagtagtgccgaagaagacgagtggggctaaggatttcttctttatgcccacaggattagcatcaagagcacccgcaactgagaagaaccaagttcctagagcattggctactgtgcaatcctccagttgcttttcgccgccgccgacccggt

SEQ ID NO: 48121 - DNA, 454 bp, Zea mays
  unsure at all n locations
  Clone ID: LIB3066-020-Q1-K1-F12
tctccctccccctttctctctcttctctctctaccaccccaggccccccgatctggtcctgccactccgatcgcccgaccgatcgccgagcttccctgttccctccccgcccccgcgacgccgcgacgccatggagccgccgcacgccgagcaggtcgtcgcctctgtagaagcaggaggagagggtggcactgcaagcccgggcaccggcctcgaagggccggtgcttagcgcgggggctggacggcggtgggtaaggggaggacggngagctgggggcggngcaggaggcggacgcacgactaccggagcggcctggcgaggccgactgtggctactacctccgcacggctaccggaccggcctggcgaggcggctgcggctatcgctggtggcgtcgtggggtacggtgacagcgaggtgttcagccaaaatgtcttcggagatacaatct

SEQ ID NO: 48122 - DNA, 311 bp, Zea mays
  Clone ID: LIB3066-020-Q1-K1-F2
cccacgcgtccgagaagctgacggaggcgggcgccgacggggtcatgatcgacgtctggtgggggctggtggaagggaaggagccgggagtctacgactggagcgcctacaggcaggtgttcaagctggtgcaggaggccgggctgaagctgcaagccatcatgtcgtgccaccagtgcggcggcaacgtcggcgacgtcggcaacatcccgatcccgcagtgggtgcgggacgtcggcaaaagcaaccccgacatcttctacaccaaccggagtgggctgacgaacatcgagtatctcacgcttggagtg

SEQ ID NO: 48123 - DNA, 353 bp, Zea mays
  Clone ID: LIB3066-020-Q1-K1-F3
atcagataggcctgggagctacgcgtaggacaccttgacactactggcgagggaagcgctagaccggcgctcaactgacgcatggagcaggaactcctgcgctagaagtatgtgtgccgagctgttgatctgctgtggtgacactgaggacaccgaggaggtgctcgtgatcatgcggctcaactccatgctcatcaacatgatcatgtacaactgcaacgacatgatgatcaacgacgtcaatgtgacggtgtccggctacagcttcaacacggacggtatacacatgggcaactcgatcgacgtctacatcaccaacaccgacatcggcgtcggcgaccactgcatctaca

SEQ ID NO: 48124 - DNA, 403 bp, Zea mays
  Clone ID: LIB3066-020-Q1-K1-F4
aggctccccaaagatagcatagcagcagcactcacaatagcaaaaaccaccatccgtcgtcgccaggcgtagcaagaacatcaccaccgcccagcaataatggcgcagagcatgaggattgtggcgctggccctggtggccctgctggtggtggcggcggcggcgcccgtggccaccgtgtacggctgctacgacgactgctacgagcgctgcgccaacggcaagaaagaccccgcctgcaccaagatgtgcaaccaggcgtgcggctccacggatcagggcgccggtgccgtcggcgccgcgccggcttgatcgtccagcgcattcatcgcttcagctcgatataatcgctgctacggcagcaactcacatatgattcgatcaattttccctctctaatttc

SEQ ID NO: 48125 - DNA, 376 bp, Zea mays
  Clone ID: LIB3066-020-Q1-K1-F6
cgccaaacgccgctgcgctctctctccttctcgtcctgaccccccagagcgagagggaggggcacccataggagcctgtcgttttgatcggtgtctctctgcccccgttcccgcgaggagagaacaacctggagaaaatggcgccgatctccggagccacggccgtccttgtgatggccgtcgtcgccacgctcgccgccgcggctaacgccctggcccccgccccagcacctgctaccagtgacggaacaagtgtagaccagggaatcgtctacgtcctcatgctggtggcgcttgtcctcacctacctcatccacccattggacgccttcttcgcctactagcttcttttaaaaccattcgctttgtaaatttg

SEQ ID NO: 48126 - DNA, 175 bp, Zea mays
  Clone ID: LIB3066-020-Q1-K1-F8
cggacgcgtgggcaccggcacctattacactcaggaggacgatagcctgctctccactgggagggactcatgcaccggcgagaccaaggatgacgtcaacgtcgagtatagcggcactaataacaagaacatggctatatgcacgaacgccaagggcagcactaatcgacgactt

SEQ ID NO: 48127 - DNA, 286 bp, Zea mays
  Clone ID: LIB3066-020-Q1-K1-F9
cgacggaggcagctacagtaatacatgctggaatggcaccaggtgacatgcggctgggtcagctatctaacgagagaacctacatggaccagagcatagaacggagcaatggatattgaaatataagcaatcgaatgagatatgcctacggacaagttaccgaataaccctgtccaatcctacaacatgcaacagaggaacaagacagctatgaccagttcaagaagcgacttatggcgaccatatgcactcgtccggctcacaatagatgtgtatgcataaattg

SEQ ID NO: 48128 - DNA, 329 bp, Zea mays
  Clone ID: LIB3066-020-Q1-K1-G1
ggattgcagcacttcatggtgacaaggatcaagcttctcgtatggagaccctgcagaagttcaaatctgggacgtaccatgttctggttgcaactgatgttgccgcacgaggtcttgacatcaaatcgattaaaacagttgtcaactttgatatcgcaaaagagatggatatgcatattcaccgaattggaagaactggtcgtgctggtgacaaagatggcacttgcttacactctgattactcagaaggaggcacgctttgccggtgaactggttcaaaagttgattgctgctggccaggatgtacccaatgaactcatggatctggc

SEQ ID NO: 48129 - DNA, 461 bp, Zea mays
  unsure at all n locations
  Clone ID: LIB3066-020-Q1-K1-G10
agatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaactnctgcaccaag

SEQ ID NO: 48130 - DNA, 428 bp, Zea mays
  unsure at all n locations
  Clone ID: LIB3066-020-Q1-K1-G11
cgagaggatcagcttcaacgggtgccggaacttcctgctttggcagaaggctgcggctcagggtgccgccgccagccacgccgggtccgatgctctgacggcaaccctgagccccggcaggaagggcagcggtggattcaaggctactgatccgagccatggcaggaaaggcggcggcggctggaaggctggactgaacaagttcctcctcagcttcagcatcaaggtgtgatccatgcgtggacgagagaaggggggcgtttcttggtgtcgaggcaccgcgcaacaataaaaatgcattgcatnggtttgtctgttttttcaattaatcaggattgtttggtgccgccagtgaaatggcgaagtgtaattcgtcatgcgaatccgagtcgagtcgaggcaaagtgtgattcatcgtatgtttgagt

SEQ ID NO: 48131 - DNA, 107 bp, Zea mays
  Clone ID: LIB3066-020-Q1-K1-G12
acccatatcgcatccactaacactgctactagaactcattatactgaatccaacatggtgataggttaccttcgtcggattcgcaaatacctattccttaacgcata

SEQ ID NO: 48132 - DNA, 193 bp, Zea mays
  Clone ID: LIB3066-020-Q1-K1-G2
atcgacgaaagctatatccagctagtgacaagagcaaaaacaccatcatcttatacgcccgtatcagacgccacctcaatggcccagagcacgaggatggtggcgctagccctggtggtcctcctggtggctgagacagctttcgtgtttaatgtcaccgagtacagctgtttccataactgctacaagcggt

SEQ ID NO: 48133 - DNA, 431 bp, Zea mays
  Clone ID: LIB3066-001-Q1-K1-A7
gatgccaaccaaaccaatccattactgcccgcttaatcaaagtcaggatatccgacggggcggcggctgattcctatctcatattctcagagcagtaaactaccagcagtaaaataacaaaggtagcaggtagtacaaggcgaaggcgaaggcgaatctggaacgagctcgtgcaccgcctcgagccctcgactactcgccacgtgtcgcgagcaggcccaccaggacctgggtggagccggtgcaggagacgagggcaagatgcggagtaccagtgctactgctcggctctccattaaaaagcagtaaaaaaaatcgggtaccagaggtccagaacaagtcgtacactcgtactacagtctacagtcatggcgcgcacagcaaacggcgcgggtcgccacattatctgatccccgccccggtctcggcac

SEQ ID NO: 48134 - DNA, 325 bp, Zea mays
  Clone ID: LIB3066-001-Q1-K1-B8
gcggctgctggcggaggccgactgcctgcccaactccaccgtgtgcagcgaccacgacaggcacgtgttctgggaccggtaccaaccggcccagcgcgcgtgcaaccttacggcccgtgcgttctacgacgggccggccaagtacacgacgcccatcaacttcatgaagctggcccaggccagttaatggtttctgtatggctgtccacgaatacttactagccacgaatacctgtgaaaacagcaaaacaaaaaatgggcaccgttggccattatacatggaaacttgttaatttaaaaaatagaatgtttctatctgtttaat

SEQ ID NO: 48135 - DNA, 434 bp, Zea mays
  Clone ID: LIB3066-001-Q1-K1-D6
cccacgcgtccgtacgttcgccgcgtaacgcgcgaacgtgccatctgacggtgcgtttgtctcccccctggcttgcagggtggggcacgaacgaggcgctcatcatctccatcctcggccaccgcgacgccgcgcagcgccgcgccatccgccgcgcttacgccgaggcctacggcgaggagctcctccgctccatcacggacgagatctccggcgacttcgagagggccgtgatcctgtggacgctggacccagcggagcgcgacgcggtgctggccaacgaggcggcgcggaagtggaagcccgggaaccgtgtgctcgtcgagatcgcctggacgcgcaactgcgggcagatcttcgcgaccaggcaggcttatcacgagcggttcaagcgctcgcttgaagaagacatcggtgcgcatgtcactggggac

SEQ ID NO: 48136 - DNA, 406 bp, Zea mays
  Clone ID: LIB3066-001-Q1-K1-E12
tacatcacagacaatgaataccaagaagaatgttgttctttgctgccttcttttcgtgctcgttctgcatgcagatcacgctctagccaagtgtggctatacaactcctttaattccattctgcaaagcgtggatgtgcaaggcggagtgttggacggaggctaagttaactggaggcaaagtcacgcaacagaagtgcatgagaggtgggatcaagggctggtgttactgcgaattctgcatttaattttgcaaaggagaaggatcaccatttctttgcttggtcttgccttggtcaataacttagtgtaataatgctagttaagtctctaggcagactaggctagatcgagttgtttgttgctggtagctaggcattgctagcgtctgctattggtttaagata

SEQ ID NO: 48137 - DNA, 279 bp, Zea mays
  Clone ID: LIB3066-001-Q1-K1-F6
gactatcgccagcaaagggagagcgccgaggtgagagagataatgcggtggtggtgctcatggtcgaatgaatgggggtgtcgggctatgctcgtttgacgtcctgatcgaatcaaaccctttcaccgttggttgcctcatgccgtggtctgggaagtcgatgactggtcatcatggcaggaggccccgaccgaccgtgcaatcgtgtgcctacgctttggctgtgcgccaatgaaatcacggaatctttggatccaattcggcatcacagtagaccag

SEQ ID NO: 48138 - DNA, 397 bp, Zea mays
  Clone ID: LIB3066-001-Q1-K1-G1
agaaccaaaactgtgtttcttgaattataaatattccacctcaattcgcctccccgtttccgagaccaaattaacgcatctctacaggaaataacgatgtgagatggtcaaagcaaaacaaacttaactcatcagttattgtcgcgcgagagcgcgctcgcgggcatgggcatgcgaacgttagcagcggcgacaaacgatgcgagggcccaaaacgcccggctctctgttgtcgtccgtggagaaggagatcgatcagatcatgttggagagcgagcggcagttctcggacatctcgacgagcgacgcgtcgaactgctccatggggttcttttcgccaatctgcctgaactgctcgtcgcagttctgcatgttctgcgccgtcatgcccatggtg

SEQ ID NO: 48139 - DNA, 275 bp, Zea mays
  Clone ID: LIB3066-001-Q1-K1-G8
aagcataccgataggtgaaccagcagcctgcaataagggccaggacatccaaataaaaccgagagacctcagccctcaggcaagccgaccgccgacgtaccaccgcgccaacccgagagaaagatggagatgatcaagaggatcctcatcggcgcgctcctgggactcgccggctcggccaccgaagtgctggcctacaccgaggccgccgtcgtcggtacaccagccgcatccgagtatacacggtcagtcgaagccgccgctggcgccgcctg

SEQ ID NO: 48140 - DNA, 195 bp, Zea mays
  Clone ID: LIB3066-001-Q1-K1-H10
tcgaaaaatcgcacaattagtgacttttattcatattgcagattaacgacagaggttcagtctcgattcagaatcctgatcttgaatttctgttgtgcatcgaaatttatcctgaacagtacacactgtaattctgaagtacaggcaagcgagtggctaaatgtatctgatacttgaaagcagagaagactgaac

SEQ ID NO: 48141 - DNA, 458 bp, Zea mays
  Clone ID: LIB3066-001-Q1-K1-H3
aaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccagtccgattgcatgatcgtcgccggcacgctcaccaacaagatggctccggccctccgcaaggtttatgaccaaatgcctgagcct

SEQ ID NO: 48142 - DNA, 229 bp, Zea mays
  Clone ID: LIB3066-001-Q1-K1-H5
gcacacgctagcgaagaactgttgaagctgtatcccggtggataggggacctccgcgaccgttggcctgagtcgagttgtcacagtctgtatctatcgctcctgaaacctgaggggcctgtattgtttgtcaagcactttgtttcttctcttctgtttgtagcctactatatccactgaaatctaaggggcctgtattgtttgtcaaaaataaaacctactaaaacact

SEQ ID NO: 48143 - DNA, 418 bp, Zea mays
  unsure at all n locations
  Clone ID: LIB3066-002-Q1-K1-D12
tatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctncacttggtgctgcgcctcagggga

SEQ ID NO: 48144 - DNA, 168 bp, Zea mays
  Clone ID: LIB3066-002-Q1-K1-E5
tacatcacagacaatgaataccaagaagaatgttgttctttgctgccttctgtgcgtgctcgttctgcatgcagatcacgctctagccaagtgtggctatacaactcctttaattccattctgcatagcgtggatgtgcaaggcggagtgttggacggaagctaagtt

SEQ ID NO: 48145 - DNA, 368 bp, Zea mays
  Clone ID: LIB3066-002-Q1-K1-G12
gaataattttactaatcagattcttgttgggatatattcctccaattcccctcctcctcccaacaaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtc

SEQ ID NO: 48146 - DNA, 96 bp, Zea mays
  Clone ID: LIB3066-003-Q1-K1-C10
gacgcctgatgaggctactagcaaacaacaccatgtgttcggattgtcattggttattgatgtcttgtgaatgaataatataaattttttttggtc

SEQ ID NO: 48147 - DNA, 377 bp, Zea mays
  Clone ID: LIB3066-003-Q1-K1-E9
cccacgcgtccgtatggctagttcgtggatggcggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcaaacggtggccgtgagcacggtgttgtttggcgacggcgcggcctgcggcgggtgctaccaagtgcagtgcctggacagccccaacgggtgcaagcccg

SEQ ID NO: 48148 - DNA, 238 bp, Zea mays
  Clone ID: LIB3066-003-Q1-K1-G2
cagactgcgagcgccttcgcgccgagctccgccggatgccgccgccaaacggccgagccgtgctgctcttccgcaatcccgtgtggctgctctgcacttcttgatgcatttttgttgacatggtttgcgtttcattcaaacttagaatgcttcttaatttcttttcgttgcattgaaaatatccagcggtttattggtgtttgggctaataaatagataaactgttcacctatggttc

SEQ ID NO: 48149 - DNA, 428 bp, Zea mays
  Clone ID: LIB3066-004-Q1-K1-B4
taatgaatcagctccttgacacgaacccggagaccaggatcacggtggctcagataatgtgagagcaggtggtttaagaaagggttccggccggtcaggttctacgtcgaggatgaccaagtgcacagcttggcagacagtgaggctgaggcgctggaagaactggggcccagtgacagtgagccttcacccccacctccccctcccccgccaccaccaccaccacagaaagaggacgacggcgatgattctggctgggagtcagactcctccgtagcgtcctgcccagccacattgtcatcagaggagaggagacggcctgtcggatctcttccacggccggtaagtctaaacgcgttcgatatcatctcgttctcaaggggattcaatctgtcggggttgttcgaggagcgaggcaatgaagtgag

SEQ ID NO: 48150 - DNA, 338 bp, Zea mays
  unsure at all n locations
  Clone ID: LIB3066-004-Q1-K1-D5
cccacgcgttcggaaggcccggccgatgccacggccacggccacgctggctgcttaacggaccattgtgccattgttgctgtgagagagatgtgcgtcagccaacatgtgtgctattgctttggcttatttgtgttcagaatccacttaaactcggtcgaagtgagctttccgttcggcaacgtctgtactcttacgaatctcgatcgtgtatgtctttaagtattgtgttgtgtttcaaagataaaaaaaggtgacctttgtgtatgattttttatacacgttgtctcttagctgcattgatagtctaaagtctcagaattgtaccatgcanaaaaa

SEQ ID NO: 48151 - DNA, 421 bp, Zea mays
  Clone ID: LIB3066-004-Q1-K1-D7
cccacgcgtccgtatggctagttcgtggatggcggcgccacgacctctcctgttgtcgctgctggtcgccatgctagcggtggccgccgatgtcgccaacgccggccacgccaagcccctgacgcctggcgggcgcgtggtacacgacaaccacggcaagttcacggccgggccgtggaaaccagcccacgcgaccttctacggcgggcgggacgggtccggcaccacggcgggcgcgtgcgggtacaaggacacgcgcgcgcaggggtacggcgtgcagacggtggccgtgagcacggtgttgtttggcgacggcgcggcctgcggcgggtgctacgaggtgcggtgcgtggacagccccagcgggtgcaagcccgacgcggcggcgctggtggtgacggcgaccgacctgtgcccaccc

SEQ ID NO: 48152 - DNA, 443 bp, Zea mays
  Clone ID: LIB3066-005-Q1-K1-A7
ggattgtgggcgagtgcgtgcgttcgtgcagccagagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagtttactctggaaagccagtcctaccacaagagctg

SEQ ID NO: 48153 - DNA, 408 bp, Zea mays
  unsure at all n locations
  Clone ID: LIB3066-005-Q1-K1-B2
cccacgcgtccgccgtgctcagatgagcattgctcaagcctaataatggtgatcgatatgggccatgaccagtgtgatgtgctgctctatatatgggccatgatctgtggtcaccagagtgtttgttcacagatttgaaaaacaacaagcaaaaccaaaacacacatgcagcggacgcgtgggctgtcagcataagagacgaaacgtccgtgcgctatgtgccgctcactagcaaggacgcccagttgcacgcaagctgagtgatctatcatgtcaaaaaaaaaagttatcctcacctgacaaggtgaggcattcaatcgaatcgctacccttgtaaatgtattaatcctactgtctcagtaaatgcgctggcttggaaataatgtaaatgatggaacatcaaanaaa

SEQ ID NO: 48154 - DNA, 145 bp, Zea mays
  Clone ID: LIB3066-005-Q1-K1-E4
tgataacatgcatcatgcatgcatattcattctttcgctcatgcattccgatatggtgccggagttaaaaaaatgtaaatcaatgtgcaaactcaaatgacatcttaaccagttgtgatcaatctcaaccgctaatgcattgcac

SEQ ID NO: 48155 - DNA, 438 bp, Zea mays
  unsure at all n locations
  Clone ID: LIB3066-005-Q1-K1-G6
gcgcacgcgttcgggccacgccgatgtgtaccatgacgtgatcctcccgcgcgtccatggcggttcggcttcgagatcaaggaggtgggcatgaccagccgctacgcgtccgctgaggatctgcaccagatggacagcgaccaggaagagggtgctgagggtggcgatgacggtgacagcagttgcccacacgccatcgacatgcaggcggaggagttcatcaccaagttctatgagcagttcaagtcagaatcgttcaacggccgtgccttcgagtgatccattgatccatccgcttgcggcatgtatgtaatcgttctgatcttacaccgaaattgcattcgtgtcagagacgactctacccaatatggatcaggaagaaatgtatcagtgatcgcatcgataaaaaaaaaanaacannnnaaaaaaaaaaagaaa

SEQ ID NO: 48156 - DNA, 454 bp, Zea mays
  Clone ID: LIB3066-005-Q1-K1-H2
cccacgcgttctcggacaccttaactaacttttaataaatagttcgtgaatccctgaagcgggcatatatatattcgtgccaagataaaggtaatggagtcgtcacgcaggttccagccggccgtcatcctgcttctcctgctcattgtgtccaccgatatgacacaggcaagggaatgctagaagtacagtgagcgatttgttggcgcatgcatgatcgcagacaactgcgccaatgtgtgccgctgtgagggcttattggccggcaggtgcaacaccttacgccgacgctgcatctgcactatgcagtgctaaacaagatcgctcgatcgctcgccatgcatcgacaacctattcttaatacacgtcattatctcgtacttatttatgacgaatgtcatgtatggctctggtgactgtcatctatattctaatgactgtcatgtatcttgtt

SEQ ID NO: 48157 - DNA, 56 bp, Zea mays
  Clone ID: LIB3066-005-Q1-K1-H4
gtgggaaaaaaaaaaaaaaaaaattaaaaaaaaaaaaaaaaaaaaaaaaaaaagag

SEQ ID NO: 48158 - DNA, 342 bp, Zea mays
  Clone ID: LIB3066-006-Q1-K1-E5
atcttttttttaatcaaggctttataaataaaaaaatagaatagtacaccataacaacatacaacagctttgcctcgatcgagagcatgcatgaatcacaggcgtcgtcgaatcaaaagaaaggaagaaacaaaatgatgtgtggggtgggggtttggtgcatggccgtcgctgttaaaattcgacacaggacagttgcgtaaatagacctagcgtaatcagctgcacaaacgaatgagagagcgagcgagggaagcaaaatctgggtgaggagatgaatagatgatgacaggagcgcaacgcggcctggcagactgggcctatgcagtatggacctggttc

SEQ ID NO: 48159 - DNA, 314 bp, Zea mays
  Clone ID: LIB3066-006-Q1-K1-E8
gcctgtggagcgtcagcgctgcgctcatcaacggcgctcttggtagcaagtgcagacctcaaaatgcaacgtcatcgaagttggatatctacatagaggacatccagaaagggaaacatggaagcgattcagggtcatacgacgccgaaggaaggtttgttcctgacaagttcgaagagatattcgccaagcacgccaagactgtccccgacgccctgacgtcggacgagatcgaccagctgctgcaggcgaacagagagcccggggactacagcggatgggctggcgcagaagcggagtggaagaccctttac

SEQ ID NO: 48160 - DNA, 401 bp, Zea mays
  Clone ID: LIB3066-006-Q1-K1-E9
acggcttcttccacgtggtgaacaacgactacacgcactggctcatgtacgccatcggcgggagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaagctgcagctttcatcattggcgatcgatcgt

SEQ ID NO: 48161 - DNA, 406 bp, Zea mays
  Clone ID: LIB3066-006-Q1-K1-F8
tatgccgctaaatataggcactataggtatattattatcccacaacgaatgatcctgagaaagatccatcctaattcagacatctcaactagatgcaaacttttttggggaaaccgaacaattggttttattcctctgagctcctttgaacatattgcaatgtatctcctttgaacagttgttcctttttattcctttgaggagctaagtacccttttattcctttgtttatgtttatgttgtaagtatatttgaaatatgatttgtgctggagatatttattaacttatctattgttttatcttccaggcccaacgattgtggttcagctctgtttatcaactccctttcgagaagagatggccaccggcaggaacaacttatcgacattagtggccatgggaca

SEQ ID NO: 48162 - DNA, 60 bp, Zea mays
  Clone ID: LIB3066-006-Q1-K1-H4
cggacgcgtgggaaaaaaaaaaaaaaataaaaataaaaaaaatatcataagttcaaaaga

SEQ ID NO: 48163 - DNA, 350 bp, Zea mays
  unsure at all n locations
  Clone ID: LIB3066-007-Q1-K1-C12
cccacgcgtccgcggacgcgtgggccggctcaggaacgtcgagagcggggagatacaggtgcagctgcagtgggtgaacttccctcctggtcctgctcctgctgctgcaacaaccaggtgacctgatcgatggtagctgctgttcctgtcgccattgcctcctgctggcaggaacaggaactctctgaagcacggggtcagggtagttcatgttgcttcgattcgatcgtaggggagataatgccggatggcgctgctcatgctttgtaaagtttgggaggacatgcatcataattgaagtcaagtgataggatcctgttttttaagtacacgatacaacacanaanaaa

SEQ ID NO: 48164 - DNA, 405 bp, Zea mays
  Clone ID: LIB3066-007-Q1-K1-C6
gttatgctggagcaggattatatgatagtgtaccgatggatgaggaggatgaggttgtgcgggattatacaactgaccctcttatagtagaccgtggattccgaagctcaatcctctcaagcatagcacgggctggccatgccatctaggagctatatggttctcctcaggacgtcgagggagtagtgaatgatggaaaaatctatgtagtccagacaagaccacagatgtagtatgtatgcatctattagacagctcaataagcactgttgtacgcttgtatggttgggacatatgggcgttatggcatgtatagttgtatgcctagatgtacatcacgtgtactcgtatatatatatataaatgctgaaacacgcattggtccaaaagtgtaagcaatccaag

SEQ ID NO: 48165 - DNA, 410 bp, Zea mays
  Clone ID: LIB3066-007-Q1-K1-D11
tagcaactcaatttacagaactttgagttgctaccggagatgtacagccccggttttggtttggttaatccagatctttgggaataactctcgaaaccgaataaactttggatacagagatgccagttttcaggtgcctgcactatttgacattaatggtgcacctatggttccgaacagaggaacagttgaattctctggaggggctgaagcctgcacttgtgcagttgagattatatcatcgcgtcgatttattttggaacctgtattcagctggtgttgaggcatttgtttctgaggtgaaatgaactctccatgcccaacaactgaaactaaagacgacacgataaggtgcctgacctgaaccggcacatttcctgtggtcaggtttaatcatatatatgtagctg

SEQ ID NO: 48166 - DNA, 267 bp, Zea mays
  Clone ID: LIB3066-007-Q1-K1-D7
cccacacatcctaccactcctacgtagatgttcaccagcatacctcaatacattccatctgatcgcacttaaaatggtgagacctcattctatatacattctcatactcatcttctactcgttcatcaacattatcattctcatttcatacattatattgaccatatataccttctactatcttcacatctctcatttttacaagcgcacgattatccatactctgaataatatctcctatcatctcacttattatcagactatctc

SEQ ID NO: 48167 - DNA, 400 bp, Zea mays
  Clone ID: LIB3066-007-Q1-K1-G8
accggtctagaaccgggtcgacggacgcgtccggagcaaggagagcgccggcgacccggggcatacatcagctactggaaattagagagccgggtcggttggtcggagaacctgcgaggaaggactaaggagtcgaagatgactgcggcggtgctgtccgtgcgcacgacgacgacgtcgctgctagcagcagtcatcctgtgcctctgcatcgtctccctctccccccgcggcgccgctgccgcgcgggtctcccccggcgccagcccgatcgtggccacctgcatgacgggcccgtacccggagctgtgcgtgggggagctgggacagcggctgctggacgtgcagacgtcgatcgcgtccgcggcgcccgaccagcgcgcggccaggatcgcgggcg

SEQ ID NO: 48168 - DNA, 329 bp, Zea mays
  Clone ID: LIB3066-007-Q1-K1-H12
atcttggccgcttcgacaaggactccccgatcagggccatcgacttcggcctctgcgtctccttcaaggagggcgagccgctcatggacatcgtcggcagcgtctactacattgcgcccgatgtgctcaggacgacgtacgggcacaaggccgacatctggagcgtgggcgacatactctacatatttctcgccggcgtgcctcctttctgggcagagaacgagaacggcatctataccgacatcctgcgagggaagcttgacctctccggagagccatggccgtacatctcgttgggagccaaggacctcatgatgaagatgctcagc

SEQ ID NO: 48169 - DNA, 388 bp, Zea mays
  Clone ID: LIB3066-007-Q1-K1-H8
agctaacaatgctcacttagacgtaggggtggtaatggattgtgatccatatggttcttcacaaaatgtcaaggcacttaataaattatagttcaaaaatgactaaaaatagagcctaatcttaacccgattcgatacttaaattttatagtgcaaaatttatagcccattgtcagccagttggacgttgatggttggcacttgcagagctagcaaaatataatagtactactagtgtgaaaggagggccttgtggcactggcagctccggcactgcttctccggtgcgttgctgctatcgccgttcttggcgtctaagtaccatccggagagcgtgtcgaagaggatgcccgcgccaacgccaacagccaggtcaatggtgtagtgt

SEQ ID NO: 48170 - DNA, 370 bp, Zea mays
  Clone ID: LIB3066-008-Q1-K1-B2
taccctcgtcgtcgtctcactcaccccgccttcacgcctccctcaccaaataaggtccggcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagc

SEQ ID NO: 48171 - DNA, 367 bp, Zea mays
  Clone ID: LIB3066-008-Q1-K1-C12
gctcatgctctcgcgtgggaccgacgccggtggccctgcggcgtcacgaatccatgggcgaactggggcccggactccgaggatgctgagcccgccccggctgcctacgtcgacccctcctcccgcctccactccggcggcacgtgcctcaaggccggcgcctccctcagctcggcccccacgcccaccaagccgacctagcccatcgacccggtcctggcacagcccatggaggacgtgcgcaccatatacaccgtgcccaacgagctcggacgcggccagttctgcatcaccagcctgcgcacgcacaaggacaccatggactcatgcgcgtgcatgaccatcgtcaagcataagctgtccacca

SEQ ID NO: 48172 - DNA, 405 bp, Zea mays
  unsure at all n locations
  Clone ID: LIB3066-008-Q1-K1-E5
gcagtgcgccacggctgctggtctcggcggacgagcagaatttggaccgtcgtgntgtgagagcgggaggagtacctgcatacgatggcgtgtgctgactgccgtgcggcagctggcgctgctgcatagtcgtggcgcatagcggaggggcgtatgtcgcaactaccggcgatcaacgggactacaatggcgatgagatgctgaaacgcgcgcgtgatggctcgctgcggcatatgacgtttgggctagcatggtgcgcggaggatatgattcaagcgggcgagctgcgctaggactatcaccgggtccatgtacatattccggcttctgcagcgcgagaacgattgtatgatccgcgtcagcacgctgaccaaaaaaatgggtttaagcctttcaaagggttat

SEQ ID NO: 48173 - DNA, 184 bp, Zea mays
  Clone ID: LIB3066-008-Q1-K1-F12
cgatctgcctacttttaagcacgggctttttcttgtcttccctgtaactataatataagaatgtgtattatatacaagacgatacaaccctgcgggtgttggtcatgttcctaacctttttgcacactccacttgctggttgcaatatgcctgcttccagatgcagaaagacattgaacctgac

SEQ ID NO: 48174 - DNA, 319 bp, Zea mays
  Clone ID: LIB3066-008-Q1-K1-F4
cccacgcgtccgagtgaacttgagctacaggagctcattggcagtaggataccggattctcagattgtagaaaatctggaaaaagatctggtcctagaaaaagatctggtcttagatgatgttgatgccgatgatgccatgagagactagcttcgcctgtttgtttgttactaaatagacagaacttgagagtttcacaacttaattgtcaaaaacatattgccttataatttacactttattttcctcacttatgtacatattcataccatagttatgtaatatctgttgaagtcgtcaaaaaaaaaaaaaaaaaata

SEQ ID NO: 48175 - DNA, 439 bp, Zea mays
  Clone ID: LIB3066-008-Q1-K1-F9
ggattccgggtcgaggcacgcgtccggccacgcgtccgcccacgcgtccgcccacgcgtccgcccacgcgtccggattaccatgagcagcgggccctggtacccggttccgctggtgcgcatggactccctgtcgtcgtcgtccacggcgcccgacgtggagctgacgctcgccaacttcaccgtggaccgcctcatacagatgttcggcgccaaggggttcacggttcaagagctggtgtcgctggacggcgcccacacgctgggcttctcccactgcaaggagttcagcgaccgtctctacaacttcagcaaccacggcggcaagccgaagcagttctaccccagcatgaacccgttctacgccagggggctgcacgacttgtgcacggactacctcaaggaccccaccatcgtcgcgtttaacgacatcatgacgc

SEQ ID NO: 48176 - DNA, 382 bp, Zea mays
  Clone ID: LIB3066-008-Q1-K1-G7
aagccccacacacacaaaagcaaaaagcatcatcacaataatggcccgcgcgtgtgtgttcctcgtggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgcctcatccccggactcgccgtcggaggcgccctccagcagcagctcatccgactagccgcgcacaacgcagttcttgtcatgatctatctagcaaataaaaagatcatatgtctcggttgattctctggaataactaatagtatatatgctgcgcccggatgatatataaatatgtgca

SEQ ID NO: 48177 - DNA, 318 bp, Zea mays
  Clone ID: LIB3066-008-Q1-K1-H1
gacagaaattgcgattgcacataacacaaaaatcagctaataatcaagaaagcaaacaggaaaagccaaaagaaaaacgtacgtctagacaacaggatggaagaatcaaagcccacttcaccgcacaccggagctagctagagcctggtacaccagagtggtaagcggccggggccggccggccacggagaggatctcctcgccacacgacgacacctatgatatatctaggctaggggctgcagggcttggggaactggtagccaacgtacttggccctggcgttctcgcacttggccgatgtggcaccctggccct

SEQ ID NO: 48178 - DNA, 69 bp, Zea mays
  Clone ID: LIB3066-009-Q1-K1-A1
cagcaccatggcccgtatcttgtaaatatgtatatgtctatttcatatctatttttagtgatggcttat

SEQ ID NO: 48179 - DNA, 365 bp, Zea mays
  Clone ID: LIB3066-009-Q1-K1-A5
gtatcttcggtaaaaattatagcagtgcaaatcatagcacattctgtaggtgtaggatacagtaacacagcagcagaacatcaaacccatctcctgccaggctctgagcaaacgccaaagcctccaacgtggcacctacgtaccgtaccccagtcacccaccccacaccctacctcgctcgcagtcgcagcttccgctgtacgcacactactgcgcggtgcacgcaccgacgacacggcggcgcagcttatgtatgagtaagtatagggactcgccatacaggtagtcatcgcagcgtgccaccccgtctagcgatcgaacacagtcgacggggaacgccggccggtccggtcagttggtgagcg

SEQ ID NO: 48180 - DNA, 381 bp, Zea mays
  unsure at all n locations
  Clone ID: LIB3066-009-Q1-K1-C5
atcaaaagtaggtgntgtttctcgtagccatgagacccatcaaatcaaattaatgaagcacccatcaacaattagcaagaccgatgaactagcaaggcttcttgcagaagcacttgcgcatggccacgtcccgcttgcactcgccaccgggaaagctctccttcatgcacacctcggcgcatctgtcgctgttgaagcagaagccctcgaactggagactcggcgataagcattgactctcttccttctccgtgcttttctgctccttcttctccttctcctgctgtttcgctttctccattatcaaggcatgcatgggcatggctactcccattttggcatcgatggttcccacctctgctgcgacgaggaggagaaaca

SEQ ID NO: 48181 - DNA, 388 bp, Zea mays
  Clone ID: LIB3066-009-Q1-K1-E7
aattcaacgacaaagcagaccggatccacaacgccatcctccagaccatcgccgaggggaagtacaggactgctgatcttggtggaaaggcatcgacatcagagtttacaaacgcagtctgtgatcacatctgagaaacggatgtgattcttccttctgattgttttgtcatcctaatatttttttgtcacatatgagaggagctttagctttaagaggttaactggcagcacctcgaacttctttggggtgtttaacacggtttgagaccgtcaaataattttgtcacatttcttgcggttcagaaattctttcaacattggaatggagccaagaattgtctgtaataatcaacatcagcattataacagtatgtagggtttatctc

SEQ ID NO: 48182 - DNA, 153 bp, Zea mays
  Clone ID: LIB3066-009-Q1-K1-F8
tcagtcctaaaaaaaataaatataaaaaaaacaattataaaaaataaaaaaaaaaaaaaaataatatagaatcttcacaaaaatttaatatatatattcaaatattttcctaattttttaaatctcatgtcctcttcttatttttttccaaat

SEQ ID NO: 48183 - DNA, 62 bp, Zea mays
  Clone ID: LIB3066-009-Q1-K1-H9
aaaaaaaaaaaaaaaaaaaaaaaaaaataaaaaaaaaaaaaaaaaaaaaaaaaaaaaagaaa

SEQ ID NO: 48184 - DNA, 327 bp, Zea mays
  Clone ID: LIB3066-010-Q1-K1-C6
caacgggtgagggattgtatgaaggcctggactggctgtccagcaacattgcaaccgggtcctaaattgtcaagcaaggtttggatcatctaggagcttttggatgatgatgatggtgctggatatttagggttgggttggtatttccgtatgtaagatgtatgcccctgagctcggcagtttttgagctctgcttaagattctcacagttaaattgttttatgtaatttgggccttgagatgtttctgaaccaaacagctaaaagagttcagttgagttaactggttgccattattacattatgagattctttgaaaaaaaaaaca

SEQ ID NO: 48185 - DNA, 433 bp, Zea mays
  Clone ID: LIB3066-010-Q1-K1-F1
ctcgagccctagctaggaaagtagggttttcgatggattctctgagccggagggagcgggcacaccgcgccgtcgacgccatgaagcctctgggcttctcgaagaaggaggtcttcgccgtcctcaagaacctcctccagctgttcgataactcctgggagcccattgaggacgagtgctaccgcgccctcgccgatgctatcctcgaagcccgcgaccggccccagatgcattgcagcaacagtacaagaggggttcggcttccgccggaaggggagggctgccggccccggccttctacttcccgtgacatccacgacggtctggatggtgggaccgaggcccttcgcatcaagaggacgaggatcagcgctagttgctctatcgatccccagtcttccggctccgctgcggaagcccttgatgaacctat

SEQ ID NO: 48186 - DNA, 446 bp, Zea mays
  Clone ID: LIB3066-011-Q1-K1-E7
taactacccccgcgctggctcgccaccaccgccgcagcaggcgtgggaatctgggcagggggccgcggagaagaggaggcagcgcgctctccgtccgccatggcgggctcttccgaccccgacaagctcatgagcaaagccgacaaactaacaaaattgagttttacaagatggaatgctgattggaaaagcgctacctccttgtatgagcaagctgcaattgcgtataggttcagaaaggacaatgagaaagcaaaagatgcttttgagaaggcctcaaaaggacaggaaatgatctcctcaccatgggacgctgctaagcatatggaatctgctgctgctttagcaaaggagcttgggcgctggaatgaagtatctgatttctatcacagagcttcagaattataccgtgaatgtggaaggccacaacctgcatctgatgctct

SEQ ID NO: 48187 - DNA, 353 bp, Zea mays
  Clone ID: LIB3066-011-Q1-K1-F10
cccacgcgtccgcggacgcgtgggtccgcgctcaaggacttcctggcctttgtcgtgagcgaggccaacctcaagggcgtcgacgccatgcccgaggacgtcgcccaggcggtgctctacctggccagcgacgaggcgaggtacgtcagcgcggtcaacctcatggtggacggaggcttcacagccgtaaacaataacctcagggcgtttgaggattagttgaggcatttatgccagctctgggattgggagggagtattaccactatttcttctgctgttgtgacaagtgagtgcaagactaataaactgcagcatgttcatgtatccaacagatgattgaacagaatagaa

SEQ ID NO: 48188 - DNA, 392 bp, Zea mays
  Clone ID: LIB3066-011-Q1-K1-F4
gtcgttcaagggccagatcgtggggcttatctacgctacgcagtttctgcggatgccctgaagtgctctcaacgttctcatgatcgttgtcaaattggtgtctggctgagcctgatgaattggtatctgttccacctttatgtaagagctgagagatcccaaatttaattgtactcaaggttgctgtaaatatgctgtttctgttgattctaatgtggatttctgttattgttgtcgtaaattaatttggtcagaaaatgactgtcgacattcatactatccaagccggcactttattgggggtgtctttcttttgtacattaatgaattcaagacatatttgcaacgtccttgtatgttttgtgaaaaaaaaaaaaataaataaataaaaa

SEQ ID NO: 48189 - DNA, 82 bp, Zea mays
  Clone ID: LIB3066-011-Q1-K1-F5
atatatacatatatatataatactaacaatcatacacataaaaataactaataataaagggggacaatatataaaaagaggg

SEQ ID NO: 48190 - DNA, 233 bp, Zea mays
  Clone ID: LIB3066-011-Q1-K1-G9
tcgcccacgctgtcgccatacgcctcctgctgtcacgaacaggaactctctgaatcacgggtgcaggttagttcatgtggcgttggattctatcgtatagtagataatgccgcatggcgctgctcatgctttgtaaagtttgggaggacatgcatcataattgaagtcaagtgataggatcctgttttttaagtacacgatacaacacaaatcttaacatactccctttgttt

SEQ ID NO: 48191 - DNA, 264 bp, Zea mays
  Clone ID: LIB3066-011-Q1-K1-H11
cggacgcgtggggtccatggagccgtgcatgcacgggccgacgttctacgactgcgagtccaagcacggcgccggcacggggaagctggtgccgcacgtccagcactgcgaagacatgagctgggggctcaaacttgtccatcccgagtgaaacagcaataataatgaaaagaatatcttttttaatggttcgaattcctgtgctaaaaaaaaaaaaacacaagaagaaaaagaaaacatgaagcaacaacaaacataaacaac

SEQ ID NO: 48192 - DNA, 132 bp, Zea mays
  Clone ID: LIB3066-011-Q1-K1-H6
cctgcaatttgtaagtgtaatgacctatatgatttaatcttccttttaaaaaaaaaatatgaaaaaaaaaataaaagagaaaaaaataaaaacaaaaaataaaaaaaaaaaataaatatactataaacaacc

SEQ ID NO: 48193 - DNA, 395 bp, Zea mays
  Clone ID: LIB3066-012-Q1-K1-B6
gacggacccgtccatgctatggctcgccgacgcgccggtcatggacatcaagggtggcttgtcgcacccgtcggccgagatctccgtctccaagcctccgccgcatccgccgcagatccattttgagaacgggagcacgagcacgctcacggagaaccccagcccctccgtgcacgcgccgccaccctcgccggcgccggctgctccacagcagcggcagcaccagcaccagaatcaggcgcaccagggcccgttccgccgggagctcaatttctcggacttcgcgtccactccttccttggcggcgaccccgtcgttcttcaagcccgagttcggcgagatcctcagcttcggcgccgacagcaacgcccggaggaacccgtcgccggtacctt

SEQ ID NO: 48194 - DNA, 391 bp, Zea mays
  Clone ID: LIB3066-012-Q1-K1-D1
aagccatcatttccaccgcacgtccgcaccccctctccggcgtgccgacggtatccaggcggcggtggtgcgcggcgtcttgaggggcatcaaggagaagggactcaccaacttcatccgcgacgtccgcgacgaaggatacttcaaatgccttctggacgggaaccttttgcaaacgaaaatccacaatattggcgcaacacttgtaggagttgacaagtttggtaacaaatattatgagaaactacatgacactcagtatggaaggcatatgtgggtagaatatgcagagaaaggtcgttacaatgcatcccaagtgcctgctgaatggcatggatggctgcaccacatcacagatagcaccggggataagctgctgaaccagaagact

SEQ ID NO: 48195 - DNA, 60 bp, Zea mays
  Clone ID: LIB3066-012-Q1-K1-D12
attttaaatgccgattgccttggtttcaaaaaaaaaatacaaaaacacaaacatggggac

SEQ ID NO: 48196 - DNA, 87 bp, Zea mays
  Clone ID: LIB3066-012-Q1-K1-D9
aaaaaaaaaaaaaaaaaaaaaaaaaataaaaaaaaaaaaaaaaaaaaaaaaaaaaaagaaaaataaaaaaaaagaaaaaaaaaaaaa

SEQ ID NO: 48197 - DNA, 308 bp, Zea mays
  unsure at all n locations
  Clone ID: LIB3066-013-Q1-K1-D1
gtctcatgcgcgattattcccccctccggccgaccttttacacacgtacgattggctgtgatgatcatccacgcatgcatcgatcttccgccaactcatcaccgtctcttcgatctcctctcagcaatatacgtacaatccttcgtcgctcatcttgatcggagtagctagttctcttctgaaataatgcatatgccctagctgctcgctgcacacacgtacgcacggacacacctnctcttggatcgatcgtctcccttctcgccgtcgtcggccgccgtcgtgccccgggtcgatctcgatcgttg

SEQ ID NO: 48198 - DNA, 94 bp, Zea mays
  Clone ID: LIB3066-013-Q1-K1-G4
aaataaaaaaaaaaaaaaaaaaaaaaaaaaaaaaaaaaaaaaaaaaaaaaaaaaaaaaaaaaggagggaaaaaaaaaaaaaaaaaaaaaaaaaa

SEQ ID NO: 48199 - DNA, 401 bp, Zea mays
  unsure at all n locations
  Clone ID: LIB3066-013-Q1-K1-H4
aagcaacccaatccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgncggacctacctcggccttcgcaagtcccggcgcgctcttcttagag

SEQ ID NO: 48200 - DNA, 424 bp, Zea mays
  unsure at all n locations
  Clone ID: LIB3066-014-Q1-K1-A3
tgcactcctctggacgcatatagccaagcggccgaagccccattccgtgcccgccccgcgggccgcgcgtcgccttgagatctgtggcgtcgtcggcgccggataacgagtagagatggaggagacggcggcggtagcggggacggctgagaaggcgtcgtcgtacaggtactgggtgcgggaggccaccggcgacgccgcgccgctccccgtcccgcgcaagctcgacaccgatgccaacgggaacgggaacccgccgtccgtcggctccgtctggaatcaggctggaacatgggaggaaaaagaacctcaactcatgggccaatagtagaataaaggatttgatgggctctataggttcattggccttncctacagggaaggcatctattgacgaaatgtccaagtgctcangcgacgcatt

SEQ ID NO: 48201 - DNA, 452 bp, Zea mays
  Clone ID: LIB3066-014-Q1-K1-B11
cggacgcgtgggcggacgcgtgggcggacgcgtgggtgctcggcagccggtatccgtgctgctcttccttggcggccgagcggggctccctctgacgactccgcgcttcctctggtgcacggccgcttctattgccgtcgtctggggcttctgctgcgttaccatgggccaaacagcgaggaaaatgccgagagagagaggtagagacagtttggtcgtcgagtcacatggagggtgccctggtggccggggaatccttcacctgcggagtgctacattgccgggctgctgcatcgtggtctgcctctactaccagggctgactccattgccggacagccaaaactctcggtcgagtctctgaaggccgtctgtccctgttccttccgcagcgaggtcacgagtcacccgaggaccaatttggtgaggtacctggaatctcaagtgccagac

SEQ ID NO: 48202 - DNA, 418 bp, Zea mays
  Clone ID: LIB3066-014-Q1-K1-B6
gcctccgaaaatggcatgtgtatttaacattttgcttgttttccactctttggaattcggcatacatgattagaattgcctcctaaacccaaacaaaaggattacatatactacaattcagaagtctcagtagtatatatggttagcggtgcatgctctctcatgcaatatatataaacttaattagcttgctgctgcaggtccatagcccaccgcgccggatgaatcgaagggaattcaaagtctagtagaattggacgtttggaagtgtagacggcatcgggtctccagttcggcgggatgacgtctttggcgatgaccttcttgccggactcgctggtgaggcggatggaaaaggggcccttgagcgccttggcagtgtccatccttcagatggcgccccaagagagcttcatgg

SEQ ID NO: 48203 - DNA, 70 bp, Zea mays
  Clone ID: LIB3066-014-Q1-K1-E12
gcctactgtctgttaccatgtatattatataaggaaggatgcgttcaccaatgtttgaaaggagacaatc

SEQ ID NO: 48204 - DNA, 258 bp, Zea mays
  Clone ID: LIB3066-014-Q1-K1-E2
tgctgtaccggtccggggtcgaccgacgcgtgcgcactgaacgatgtgtctgtcaaagaagaacactgtctcgatgatcgtccatatatgcgacagtgtgtcgctgtgtgtgaacactgaacaacgtgtcaaaactgaacttatgttgccaatttatttgcaagcaacaaggcgctcccagctgatcttgtgcctttatgcagtttatacagttcaaaatttcaaataaactatgaggctcagcctagaattcattac

SEQ ID NO: 48205 - DNA, 345 bp, Zea mays
  unsure at all n locations
  Clone ID: LIB3066-014-Q1-K1-G9
cccactcgtccgcccactcgttcgcccacgcgttcgcccacgcgttcgcggactcgtgggggagaaaaccgtcctgatctggatggacataatgaaggagtaactatggctggatatggttatgggatccctattagtcgcctttatgctcgatatttcggtggggacttgcagatcatctctatggaaggatatggaactgatgcttacctncacctttcacggctgggagattcggaggaacccttgccgtaatttattcaaaagaaccattcctgtaattaggatattgcttctgtgctggtatgcaagtatagttctgaaggccaaaaattaaaataaaaa

SEQ ID NO: 48206 - DNA, 202 bp, Zea mays
  Clone ID: LIB3066-015-Q1-K1-A4
cccactcgttcgtgcatattcattctttcgctcatgcactccgatacggtgccggagttaaaaaaatgtggatcaatgtgcaaattcaaatgacatcttaaccagttgtgatcaatctgaaccgctaaaaaaaaaaaataaaaaaaacaaaaaaagaaaaataaaaaaaaaaaaaaaaaaaaagataaaaaaaaaacaaaaa

SEQ ID NO: 48207 - DNA, 103 bp, Zea mays
  Clone ID: LIB3066-015-Q1-K1-D2
tcgaaaaaaaaaaaacaaaacaaaacaaaaaaataaaataaaaaaaaaaaaaaaaaaaaaaaacgggaaaataaggaaaaaaaaaaaaaaaaaaaaaaacata

SEQ ID NO: 48208 - DNA, 348 bp, Zea mays
  Clone ID: LIB3066-015-Q1-K1-F10
cggacgcgtgggtgttgagatactaatgctagcgacaactttatgctaagacgcatatatggctgattgttacaatggagggatgagaagacaggaaactctagcaatcagatatatatgcgtcttagcataaagttgttgagatactaatgctagcgacaactatgttgacttgtcgagtatgtagagatgggctcatcatttcgtggtgagcttgtacatatttcctgagattactttgtcctgccaaacatgcgccagttctccattggttgctaatgctcggctctgggattgtatattcgtatttaataaaagtacttgctcctattcgaattcgataaacaa

SEQ ID NO: 48209 - DNA, 106 bp, Zea mays
  Clone ID: LIB3066-015-Q1-K1-G8
cccacgcgtccgcccacgcgttcgcccacgcgtccgcccacgcgtccgcccacgcgtccgggcacgcgttcgcccacgcgttcgcccacgcgttcgcccacgcgtt

SEQ ID NO: 48210 - DNA, 284 bp, Zea mays
  Clone ID: LIB3066-016-Q1-K1-A6
atgaaaaacaaccgagagagacatataataaataaagaaataaacaataattaggcaagcacattccatgtgtttgccactcgcattccatacactgatgcacgtacatgtttctatatcatcagggtgcaacgtatatactggtagttattccagagaatgaagaggtttttgcgtctagtcggaggagctgctgctggagggcgacgttgagcatcagaaggctaatgaggtgctcgctccagaggcggccgtcgccgagcccgaccacaaggaggaggaag

SEQ ID NO: 48211 - DNA, 328 bp, Zea mays
  Clone ID: LIB3066-016-Q1-K1-E7
caagatcgctcgatcgctcgccatgcatcgacaacctattcttaataacgttcattatctcggtcttatttatgacgaatgtcatgtatgttctggtgactgtcatgtatattctgatgactgtcatgtatcttgttcatgtatgctcaaggttcattatcttgttcatgtattaagtatgttatgaataactcaatatttattattttgttcatgtatgaattatcttctaatgagctcaaggttcaaaaaaaaaaccaacaaactacataaccaaaaaaaaactcatttaataaccttttttaactttatagtcacttataaaaat

SEQ ID NO: 48212 - DNA, 63 bp, Zea mays
  Clone ID: LIB3066-016-Q1-K1-G10
ggtggcaactttctgtgaaatgtgctcggatcctctatttgtttatgcttctacttacattca

SEQ ID NO: 48213 - DNA, 241 bp, Zea mays
  Clone ID: LIB3066-016-Q1-K1-G11
agctacatcgtcactatcgtatagcgtgacctaaattcaaataaatggccgaccattacaacagtccgactgggaaaacactcactttacccacatgaataccctggcaaaacatctgcatttgcccaacatgcctaataaataaaaggcccacaccgattgccatctctaaaaactgttcagcctgaatggaaaatggtacgcgccctgtaccccaaccttaaccacgcattctgtgagg

SEQ ID NO: 48214 - DNA, 66 bp, Zea mays
  Clone ID: LIB3066-016-Q1-K1-H6
cggacgcgtgggaaaaaaaaaaaaaaaaaataaaaaaaaaaaaaaaaaaaaaaaaaggaaggggaa

SEQ ID NO: 48215 - DNA, 460 bp, Zea mays
  unsure at all n locations
  Clone ID: LIB3066-016-Q1-K1-H9
aagcccgagaacgtgctcctccgcgccgacggccacgtcacgctcaccgacttcgacctctcccgccttgcgcacccgcacctnccctcgctcctcggcttcaccgagacggacgaccttctcgcgtgggccgtcccctactgctccggcggcgacctcaacgagctccgctactcgctccccgaccgcatcttctcccccgcggccatccgcttctacattgccgagatcgtctccgcggtcgccgagctccacgccgcgggcgtcgtgtaccgtgacctcaaggtcttcgacaagcgctccgccgcccgcagcaggaagcctgacgccgacccgcgcgcggtgggagatcagcgtgctctcccgccttgcgcacccgcacctnctncaccccagcaggtcgtccgcggagtcgtcgtcgcccccgcggtcagcgtcgtcccgcggccaccacaacccg

SEQ ID NO: 48216 - DNA, 425 bp, Zea mays
  Clone ID: LIB3066-017-Q1-K1-A2
aagtacgtactgcactgcacaccctttattgaatcatcatttacgtacggtataacgaatccaatgggatcgtgggaacaaataattttttttaaaaaaaaagaggaccccaaaaagcttatacgacagccagacaatgaatgttacacaagtgtaaaagatcaaacgacaaagctcctgctcctgctcgtctcatgaagctttcttggtcttggcaatgctcaggaggtcgccgaaaagcttgtcttcgggcttcgtcgccgcagagggtggcgctctcgtagtctggtacgacgagttatcctgcaccgagaggccatacatgccctgggacagcccgttcgcgccggggtacccatacattcccgccgtccccaggttactgtagtagtgtgcagcggccacagcaggatgctgcatgtacc

SEQ ID NO: 48217 - DNA, 219 bp, Zea mays
  Clone ID: LIB3066-017-Q1-K1-C2
cgaatagatatagatagtgtttcaacaggccctcctcatcggatgtggtgttgtctgagctgaagtggttagttgtgacgagtgaattcagtgctctgcagacaacaactattatcataacctgagggtagagtgaattattcattgtaaaatatacctaaaaccataaatacataataaaaataaaaaaaaaaaaatacaaaaaacacatgataaaaa

SEQ ID NO: 48218 - DNA, 89 bp, Zea mays
  Clone ID: LIB3066-017-Q1-K1-C3
attcaattctgtatcatctcactttggcggaattaaaaaacgggaatataacaatacaaatggatatggttaaagaagaaggagagcat

SEQ ID NO: 48219 - DNA, 425 bp, Zea mays
  unsure at all n locations
  Clone ID: LIB3066-017-Q1-K1-F5
cggacgcgtggggcagggacgtgctgatcaaggacgtcaatgtgacggcgcccggggacagccccaacacggacggcatccacatgggcgactcgtccggggtcaccatcaccaacaccgtcatcggcgtcggcgacgactgcatctccatcggccccgggacctccaaggtgaacatcaccggcgtgacctgcggccccggccacggcatcagcatcggcagcctagggcggtacaaggacgagaaggacgtcacggatatcaacgtcaaggactgcacgcttaagaagacggccaacggcgtccgcatcaaggcgtatgaggacgccgnctncgtgctcaccgnctncaagatccactatgagaatatcaagatggaggactcgggctaccccatcatcatcgacatgaagtacttgcccaac

SEQ ID NO: 48220 - DNA, 267 bp, Zea mays
  Clone ID: LIB3066-018-Q1-K1-A7
gaaaatagtgggatcgagttgtttcactgcacgagcacatcctccggcgaccaccggcctccctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgac

SEQ ID NO: 48221 - DNA, 142 bp, Zea mays
  unsure at all n locations
  Clone ID: LIB3066-018-Q1-K1-B5
gttgattttgtcttgcaccggtctgaaccgtggccaccaaatatgttttggccgcttgtaaccagaaatgcaatcgcaaccattcaagggcctgtttgttttatcttaattcacattgatcggagaaaaaaaaaaannaaaa

SEQ ID NO: 48222 - DNA, 82 bp, Zea mays
  Clone ID: LIB3066-018-Q1-K1-C6
cccacgcgtcctcccacacaaactcacacacttcagacgccccacacacatcgtacaagaccgtacattctaacacactcat

SEQ ID NO: 48223 - DNA, 289 bp, Zea mays
  Clone ID: LIB3066-018-Q1-K1-G8
accattaaattttttttaataatttccctttattttattacaggttttggaaataaaaaaattagggggctaaaaattgggggtgggttatggcccttaaaaaaacgagagccggccctttaaaacgtttttagggaaaatttttcattgcctggtgactggaccattaataggcccgttgcctggtttttttggaccaatttaccaaattgggcaggaaattcttcaacctaaaaaggttcccccaggggttagaatccccgggtttttttggaaattttgttaacaa

SEQ ID NO: 48224 - DNA, 115 bp, Zea mays
  Clone ID: LIB3066-018-Q1-K1-H5
tacgtcggagctcttttatagggacacctaaattcaatttactggccttctttttacaacctctttactggtaaaacctctctctttacccaacttaactgttcttcaccacata

SEQ ID NO: 48225 - DNA, 86 bp, Zea mays
  Clone ID: LIB3066-019-Q1-K1-A11
acagaggactactatgagtcgattatatatatgagtatcatgtttataatacttcgggttagtgcataaaaaaggaactaaactac

SEQ ID NO: 48226 - DNA, 350 bp, Zea mays
  Clone ID: LIB3066-019-Q1-K1-D5
cggacgcgtgggctgctgatgactccgccggtgctgctgcccttggaagtggagctgccagggccggcgttgccgctgctgttgctaccatgatcttcttctactaaactcaccgacgatggtcgtgtcgcggtgagacattagggtggacacgtaattggctgtgctgtaatcgctctcgtctggtggggagggagggaccaagtgtttctttgctttgctcacttcgtttgctcttgtaacattatggggtcaaccgttatgtaactaatggatttgattaaaaaaaaaaaaaaaaatattataaaaaaaagtaatattaaaatatttattaaaaatttatatataaa

SEQ ID NO: 48227 - DNA, 380 bp, Zea mays
  unsure at all n locations
  Clone ID: LIB3066-019-Q1-K1-E4
gacgggcggtgcgcgcatgtgcacatcatgttcgcgcagatcacgctgcagaacgtgcagggcgtgggcctgcacaacctgcacatccacgactccaaggcgcactcgggcggcatgatccgcgactcgaagcggcactacgggctgcgcacgcggagcgacggcgacggcgtctccgtgctgtcgtacagcaacgtgtggatcgaccacgtgtccatgttcagctgctccgacgggctgatcgacgtggtgaacgggtcgacgggcatcaccgtgtccaacagccacttcaccgaccacgaccacgtgatgctgntcggcgccagcaacgacagcccgcatgacgcggtgatgcaggtcacggcggcgttcaaccactt

SEQ ID NO: 48228 - DNA, 65 bp, Zea mays
  Clone ID: LIB3066-019-Q1-K1-E7
cccacgcgtccgaaaaaaaaaaaaaaaaaaataaaaaaaaaaaaaaaaaaaaaaagaaaaaagaa

SEQ ID NO: 48229 - DNA, 213 bp, Zea mays
  Clone ID: LIB3066-019-Q1-K1-F7
tacagcgacaaagtagaagagaagaaggagctgatcaaggggataacgctcggtaacaaagacgaattccagcttacgcctctgccccaacaaggtcttgtgttatggggagagcacgatcagatattccctgtcgagaaagcatttgaagtggcaagggaacttggcgcaaatgctaggttggaggtgctcgaggacaccggccacatgccc

SEQ ID NO: 48230 - DNA, 363 bp, Zea mays
  Clone ID: LIB3066-019-Q1-K1-G4
gccatgcatcggcgacgtggcgtacggtgacggtgatggtcctgctgagggaccggcaggggctgagggctgccgtgcggctagcgtcggaagcggagctgccagtcgtcgcgtcgccgctgctgtcgctaccatgatcttgtactgagttcaccagctgggaccgtgtagtctacggtgggcacgtagttggctcgtgcggtaattgcatcgtctggtcgggagggaccaataacgcaagtgctgctttgctttgctcacttcgtatgctcttgtaactttatggggtcaaccggtatataactgaaacgatttgattaactgatactaatgctctctatctgtcatgtataagaaaactgt

SEQ ID NO: 48231 - DNA, 428 bp, Zea mays
  unsure at all n locations
  Clone ID: LIB3066-019-Q1-K1-H10
atgcagtatacttgtaaatagcttggactggtcgaaacttagaccaaatctcccgtggcttgtagaatcgggaggatgtgttttgctggattcttgtattattcttcagttcctttatttccattatcggaaacgaagggagccttcggatgagcacgacaacgcagacaaagcctgactgatatagaaactactgtttcttcttcggctcaaagaattgaagctgaaatgggtatcgataccgacctgcctnctacaacgggctctggatagcagcagcatcgttgttacctgaagatttggagcgtcgtttcactgggtgctgctttggagggtacttctcaccgcgtcatgtccctgtgagaggcttgtgaaactatnattgtctcgtagtgtccaaatgtcttggttttctattggattatatc

SEQ ID NO: 48232 - DNA, 218 bp, Zea mays
  Clone ID: LIB3066-020-Q1-K1-A3
atttttactttattcaggacacgacaagcaaatacatctccaaatacgaaatttaagatgatacgcaggactttattccacatgcactagcactaaacctgcactacacttatcttctctaacctgctattgacactaacaatatgatgaaacactttacaaaatcactcgatcacttttaaggtagatccccttacatttaccctctatacactttt

SEQ ID NO: 48233 - DNA, 281 bp, Zea mays
  Clone ID: LIB3066-020-Q1-K1-A6
cccacgcgtccggtgcaattcaccctcttaattttgtatatatagatctatagatcctgttgtaaatttgtacagattattattagtatgcatggtggggaggctcatgctgacaaatgtatgtactattgtactgtatatctcgagttcatggtaatacaacacacagattctgcaaaaaataaaaaatgaaaacaagaacgacaaatcacataaaaacagattaaaatcacacaaaatgaagtccctcaaacatatcaaatcttcaagtagcgatcact

SEQ ID NO: 48234 - DNA, 211 bp, Zea mays
  Clone ID: LIB3066-020-Q1-K1-C4
cccacgcgtccgcccacgcgtccgcggacgcgtgggcttgttcggaaaaaaatgccatgttgctccttgttaacatgtcgcatgaccataatcttttgtttaaatttttaaatatagagttccatggcaaatggcaaagtcgaaactagttactcctccaatatattggaagaacaataaatttggtgtaaaaaaaaaaaaaaaaaacaaa

SEQ ID NO: 48235 - DNA, 186 bp, Zea mays
  Clone ID: LIB3066-020-Q1-K1-E12
cacgtgccacgttatctctcttatatagtgacctctatatacattacagtgggcgtcgttacacaacgtcgactctgaaaaaactgtggcgtcacaaatcttaatcctcttgcaacacatccctttttcgacatgtggcataatcgcgaagaggcgcacacatatcgcttcttaaaacatgtgcac

SEQ ID NO: 48236 - DNA, 69 bp, Zea mays
  Clone ID: LIB3066-021-Q1-K1-C1
aaaaaaaaaaaaaaaaaaaaaaacaaaaaattaaaataaaaaaaaaaaaacaaaattaaaagggactga

SEQ ID NO: 48237 - DNA, 229 bp, Zea mays
  Clone ID: LIB3066-021-Q1-K1-D5
ctccgcctctttttgacccatacttataactttctcctcgcggtaacattccattagcctgggttaattagatccaccgctggtgcactccaattccatctcgcaataccctggatttagcccgacactaatccctacagcttattctacacctgtgacatctgattgttcctacttcgaaagcaatcaactagacttcacttactcaataacgcccataagatctctc

SEQ ID NO: 48238 - DNA, 301 bp, Zea mays
  Clone ID: LIB3066-021-Q1-K1-H4
attcggagttcgagggacgagtcaccgcgtgcgtgggcgattcgcaggcgggtggtcggcgtttcactatccaccaccgcgccgctgcggtggaatttctcctcgaccggccagcgcaattctgtgcctcgatcgatcggtcgtaaggcaagtgagcaagctatatatatatatatatatatatatatatatatatatatatatataggagattcttcgagcgagctaatagcgagatgggttccgacgtactgttttactgcatatgcatcgacggcgtcatcgcattgtcggcggacat

SEQ ID NO: 48239 - DNA, 398 bp, Zea mays
  Clone ID: LIB3066-023-Q1-K1-C5
agcttgaaccagttactataaatacttgacagcttcatctacttactatatatacttgacactatatacgtgctgtctatgactatgagtctatctactaatactattattctccatctgcgtatacatatgtgcatatttgtttacatgtcatcggaccagtcctgcagctcgccctcggagaagagcgcctcgacgatgttgtcgatgagggagtcgacgaaggcgttgcaccccagcgtgaacatctggccgatcctgttgcgcgctctggacgcccacgcgaacgccgtggcgcatgcgaccaccgtcacacacacccccgcggcctcctcgatctccatcgtgtccagcttcttgaacagcgagctgcccgtcgtcgtctccacggccactgc

SEQ ID NO: 48240 - DNA, 81 bp, Zea mays
  Clone ID: LIB3066-023-Q1-K1-C6
aaaaaaaaaaaaacaaaaaataaactataaaaaaaaaaaaaaaaaataaaaaaaaaaaagaaggaaaaatattataaaatg

SEQ ID NO: 48241 - DNA, 432 bp, Zea mays
  Clone ID: LIB3066-023-Q1-K1-D10
gatcgactcgcaggcggatggtcggcgtctcactatccaccaccgcgccgctccggtttaggggctcctcgaccggtcagcgcaattctgtgcctcgatcgatcggtcgtaaggcaagtgagcaagctatatatatatatatatatatatatatatatatatatatatatataggacattcttcgagcgagctactaccgagatgggttccggcgacctcttttactgcatctgcatcgccgccgccttcgcatcgtcgtcgtccatggtcgccgccaggtccgccgtcccgggggaaacccccaagttcatctcagcgagcgcacttgagtgctccggtaacgtaaccgaaatagcaaaggcgcgcaagctgatcgatgtccatggacacaggctgtgcccactgcggctcgaccacacgcgcagcatcag

SEQ ID NO: 48242 - DNA, 258 bp, Zea mays
  Clone ID: LIB3066-023-Q1-K1-D6
gctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttggttgctcccgctatgaaacgagacgagagaagaatgagcaaggtttttgttcgcagctatttttgtccaatgatattgatatgttgttcc

SEQ ID NO: 48243 - DNA, 374 bp, Zea mays
  Clone ID: LIB3066-023-Q1-K1-D9
gaaggtgatctcgttctcagatctaatgtatgtcaccaagcgcaaggtggcaaatgctgtttcaagcatgactaaacatttggagcaagtgcaaagttctcttgctgctgctaaaaggcatttgacacagcgcattgaaaagttggacgataaattggatcagcaaaaggctctatctggacatataagaaatgatgttactgatgcacgtctgaagcttgagaatattggttcagaaattaagaacatcaatgaattagtttggggactggatgggaaaattgattcaatggaagctaaacaggacttctcatgtgctggtgtgatgtacctctgccaattcatagagcaaaatggtggaaagcttacggatc

SEQ ID NO: 48244 - DNA, 398 bp, Zea mays
  Clone ID: LIB3066-023-Q1-K1-E4
ggcggctggagaaagagagccaggtcagcaggagattgagtgcgtgttgccttaatggtagactgcgcatgcgaggtgacaaagagcatgcactgcactgcaccacatatgtgcatcgaaggttgaagacgaccagcacctccggtcagaagagaggaaggagaggcggctggagaaagagagccaggtcagcagggtgttcaaaccgccggcggtaccaacgaatcttcctctttttcttctttagcttgaatttatgccttgtgacgtgcatctggaggcacgactgattacaaaagaatacgagttttcctaaagttaacaacattcttgactggcaaaaccctggtctttcccaacttaattgccttgcaatacattcccttttttccagttgg

SEQ ID NO: 48245 - DNA, 321 bp, Zea mays
  Clone ID: LIB3066-023-Q1-K1-E6
cccattataaataaaaaaaaaaacaaccccattaaggggggaacacaataaacaattttatcaccgaaaaatggctcagggagggaccttaaaattaaacattaatcaactaaagaacccctctaaaaatgatttttcaaaaaaacttacattgcacattggaggctttttattggtaggggaaaaaaaaataaagtcagccatttaaaaaaataaacgtccccctataaactgccagggtgagtttaattttacacggtttattctaaaaacaccggccagaaaaaaggggttaacctgcccccggaaaaacccttaccg

SEQ ID NO: 48246 - DNA, 215 bp, Zea mays
  Clone ID: LIB3066-023-Q1-K1-E8
caaagcaataattgtatcagcatgaacaaaatggtatgaccatacgatcataggttgtaatatgttttctttccttcactgtgtaagtagaatgcaggttttcactgtgtaagcgttcttttatactctgctagtaactgtaaaaaaaaaccaaaaatacaaaaataaaaaaaaccaaaacaaaaacaaaacctagataataaaaaaagcaaaac

SEQ ID NO: 48247 - DNA, 395 bp, Zea mays
  Clone ID: LIB3066-023-Q1-K1-G5
gtcaagcttgggttggtaaggggagagtacattgtcgatcacaatgctggtactggaactattttcttcagatttggtgagagattttgagtatgcaacattctgccactgtggaaggcagacttttgaggcactctgtttagcgatgcttgtggactgtgataggattcaatcggcactggagctctgctgaaataatgaagctattttctggggaagagtgatagctagtgtgaaattagtttttttctatgtaggatgtaagatctgttctttcagagtttggagctcataaatagatgaatattcacagaaaaaaaaaaaaaaaaaaaaaaaaaaaaaaaaaaaaaaaaaaaaacaaaaaaaaaaaaaaaaaaaaaaaaaaccaaacaaaa

SEQ ID NO: 48248 - DNA, 170 bp, Zea mays
  Clone ID: LIB3066-023-Q1-K1-G8
atcgaacccacgctagacgactgcaacccatgggcgaaccaactgaccgattaaccgaccaaggtgtatcctcgtctacgatatcttcctaggacaaagccggggccgttaagctggacgcaggggacgcaccggccagcactcatgaacggcataaaacgcaacggctg

SEQ ID NO: 48249 - DNA, 63 bp, Zea mays
  Clone ID: LIB3066-024-Q1-K1-A5
cccacgcgtccgcccacgcgtccgaaaaaattaaaaaaaaaaaaaaaaaaacaaaaaagaggg

SEQ ID NO: 48250 - DNA, 437 bp, Zea mays
  Clone ID: LIB3066-024-Q1-K1-H3
aagcatacaaccttggaaccggaaaaggaacatcagtgttggagatagtcaatgcatttgagaaggcttctggaaagaaaatccctttgatcatgggccaacggcgtcctggtgatgctgagattctcttttcatcgccggcaaaagcagagagagagctccactggaaagcgaaatatggcatcacagaaatgtgcggagacctgtggaactgggctagcaagagcccttatggatacgcggcatctgagtctccgaagctgaatggtagttcacgctgagcaacgccgattggcccgtgtggactcacttgtacatgagactgtagtgccagccaaccaggataaatgtagatctagtcggtcggtcatacagagagaagttctataggcctaggaaagaaatgttatcctgttcctcagcataagctcccatag

SEQ ID NO: 48251 - DNA, 391 bp, Zea mays
  Clone ID: LIB3066-025-Q1-K1-E10
agcaattctagcgactctgtctaatttggataggtcacattgctatttcttaataaatactgatgtaaagacagaagttggtatgagtacaacatgcacacacaaaccaaacgaccctacactagagattggaatccaagaataaacttaacacaagaccaaatggtgccggcacatacatgcgtacatgcatctgaaaacaagattaataatcacataaaaagaaagtggaacaccgaacccaacgcaagcacaaatcaagaaagaaacaaaggaactttgacagccacgcccatgcggcaactgcgccgatcgagctccggtcgacgttgtcccacggtcgtatgtagatatagtagtacggccggtaacgctgcgtggtgaggtgagt

SEQ ID NO: 48252 - DNA, 156 bp, Zea mays
  Clone ID: LIB3066-025-Q1-K1-E4
tagcgcacatgttagcaagatgagctcttttgttctatggttattttgtggaaccagaccacccaagaaataagtgatgctagatgtaccttctgaccttgttgtattgggttgatattattacataaactaaatacattatttatttaagatttt

SEQ ID NO: 48253 - DNA, 473 bp, Zea mays
  Clone ID: LIB3066-026-Q1-K1-B1
agaaatacttcatgatgatgaatcatcaggttaagatcgatctaaaccaatccattttatgtatacatacgacatgccaacggttaaacaacttattagaaatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggccaaaaagccaaaaaaataagtgattcgtttttagcccttataaa

SEQ ID NO: 48254 - DNA, 54 bp, Zea mays
  Clone ID: LIB3066-026-Q1-K1-F10
tcgcccacgcgttcgcccacgcgttcgtccacgcgtccggttctagatcgcgat

SEQ ID NO: 48255 - DNA, 259 bp, Zea mays
  Clone ID: LIB3066-026-Q1-K1-F7
ctgactcaccggtctatactacaggttgtttcagcaggctacactacagagtttctcttgtgacacgacataacataaggctgtacagtctgctagtattagctgctgaatgcagatcacataacgcaagacgtttgtaaatggacaattcctcaggccccttgtgttcggcttgaggaaggtcgctgtgtacgactgaacctgatatacccgggcgagccatgaattggattcctaatagtgactcctaaattcaatt

SEQ ID NO: 48256 - DNA, 72 bp, Zea mays
  Clone ID: LIB3066-027-Q1-K1-A6
tcgtctcgtgtgacgtatgacatccaccagtaattacaagtcgcgttgagatataactgaagcaaacagaat

SEQ ID NO: 48257 - DNA, 285 bp, Zea mays
  Clone ID: LIB3066-027-Q1-K1-A8
tgccgcgcctcaatgtgaccccgtgttcccacacgaccatcctagcgcgaggacacgtgtcatctgaaaagcaagttggtacctggaatctcaagtgccaggtcaagaacaggtaccacaggatgaggcacatggaggatgctgcgatgtgttcatgagaggtctaggccgtcgtctcccagtcaactttgggttgctggaccgttgtctccttataatgtaattatatatttattttgtatagaactcctgctatgaagtaaagatgtgacattcaaaagaaac

SEQ ID NO: 48258 - DNA, 242 bp, Zea mays
  Clone ID: LIB3066-027-Q1-K1-C3
tacactcgttcagatgcacttgatccggactaatgtacatcagcagcagaggacccagctggggtggtcgccacgcacgtcgtatcgcccttgttgtcgacatgcgccagtcattcggattccatgccaggcaagccggaatagggctgtcaaagcactgcatgcagataagtgtgcttgccgctgatgactgcgctactcgtgctatctgtggtcgtcgtgcacgcatgagtagcggccta

SEQ ID NO: 48259 - DNA, 396 bp, Zea mays
  Clone ID: LIB3066-027-Q1-K1-D1
taccattccgatgggatcatgtccgtgtcaaattgaaaaaggagatagtgacgtttggagacccaggtgttatgccaactaaaatcgttgggaaatatgttaagccaaaagactggaatgacttgataagtgatccagacactgtcatcattgatgtgcgtaacatgtatgagatacgcataggaaagtttaagaaagctgtcgatccacgtacaaactcattcagagagtttcctacttgggttgacgatcaatttcaattggttcaatcaggcaccctagggtcagggggagatgataatggaactcgtgaaccatcggcagaccttaatgccagcaaatccaaacagctaccaagagttgctatgtactgcactggtggtatccgatgtgaga

SEQ ID NO: 48260 - DNA, 216 bp, Zea mays
  Clone ID: LIB3066-027-Q1-K1-F1
gctacaacgacacgccatgaattcaggaagagtttacaggagcaacttacaaggagggaggaggacagttacaaatcttcccggtgaaaatgaaaatacgaacgaatctttacaaatatatatatgtgtgtggtttgtatttgtctgcaaaaaaaaacaaataaaaaaactgagtcgagtttacacggtgtagctctgctgaatggtgtcaatgtc

SEQ ID NO: 48261 - DNA, 233 bp, Zea mays
  Clone ID: LIB3066-027-Q1-K1-F7
gttttcgtctcaagagttcacttgtaaatttgtaatcgaggaagaaaagcacctctcgatcgattaacatgtctagctgctacgatcctgtgattcgacgatgttaattaatcggcagctttcattatgatgtgtagcagtatactgtatgattaattgtggatcttttcgaaaacaaagactgtaatattcgtgaaaaaaaataaaaaaaaaaaaaaaaaaaaaaaaacaaa

SEQ ID NO: 48262 - DNA, 357 bp, Zea mays
  Clone ID: LIB3066-027-Q1-K1-G12
ctgacgcgtgggctgacgcgtggtcggcggcttcctgcgtcgcgagctgtaggcctgactgggctggcatgccgcctcccggttggacgccgtcacgcggagggagatggctactcacgacacgggaccgagacagtgccgtcacgctgcgcgagttctacggagactggatcagcatgggacatgacagaatggggtgatggatgcacatgtctgcaagcgcggacagagactgagacggctcgctcaacgccgtcaaattcaacgacttcctgcatgctgatgacagcaatcaagatagcgtgatgctgaggctactcacggacacgctatgcgagatggaccacgacggagacg

SEQ ID NO: 48263 - DNA, 214 bp, Zea mays
  Clone ID: LIB3066-028-Q1-K1-A5
aaccgccaacactttacactccagtgtcgatatccatcagggccagtgtttacaatttacagacaatcatgaccaggaaacagaaaagaattacacatattgagtcctggtgaaggacacccatattcagaggagaaccagtgcatatatgtcgtccaaaaaaaaaaaaaaaaagatatttgagcataattattttataaaatttattgtaaaa

SEQ ID NO: 48264 - DNA, 349 bp, Zea mays
  unsure at all n locations
  Clone ID: LIB3066-028-Q1-K1-A8
acggagtcaagatcatagccatgctaatttcgatatggggntttcctttcatatctctatcgaaactatctcgacgataagaaggttaggaatgcttagggagattacttgggtctacaattttctttcatagatgtttagtttgtttcctgcgagatgatagatgttcattacttatgttaatttaagtacattttaccaggaggaaactatagcttttcagcatagctagaaaaatttccctgagttattattggtctctcttttttttttgcatatgcggcatatgtgtaagggtgtgggacaaggaaataaacatgatatatagntttataggtgttttttttct

SEQ ID NO: 48265 - DNA, 400 bp, Zea mays
  Clone ID: LIB3066-028-Q1-K1-A9
ccttctaatttctttcgaatttaacttggatcgaacacacctgtatcctgtcgttctaccctgtatgttgtaacacacggctcgtaggacgtacgttttgatcagctgcacatacatatacacattataatcacacacatgcacacacaccgggtctaggcataacgattactcttcctcgccagacaagcccaagctcaccggcgtgccagtctccggtatccagtccgcgccgtgcaagaagtgccccaccgtgaactgcagcgccctgtccttgcccatcacgtggaacccctgcatctccttccgcccggtgacgttggcgccgtcgccgccgttcctgaactctccgaagaaggccgtgcccaggttggccttgccctcccagggcatgtacccc

SEQ ID NO: 48266 - DNA, 369 bp, Zea mays
  Clone ID: LIB3066-028-Q1-K1-B1
aagcagcacacgagacgatatagagggagggatcatggctctcttccgtgccgccgcgtcaggagggttcgcgctgatccttctcgcgtgctgcagcctcatcatgctggcggcggcgtctggcggcggcggcgtggacgacgacggcgtcggtggtgacaggctgatgatggaccggttcctcagctggcaggcgacgtacaaccggtcgtacccgacggcggaggagaggcagcggcggttccaggtgtaccgccgcaacattgagcacatcgaggccaccaaccgggcgggcaacctgacgtacacgctcggcgagaaccagttcggcgacctcacggaggaggagttcctggacctgtacaccat

SEQ ID NO: 48267 - DNA, 450 bp, Zea mays
  Clone ID: LIB3066-028-Q1-K1-B5
tagtcttcaagatgatgatgacatgaaagagcaagcatgaatggtacatacaaatgtgctattccatgcattaaggaatgatgctcaaaattttgcatatcctcctgaagggaaatattattgtgccgatacttggcaccatataagggtcaaaggtaccatgttcaagattggaggaggggacccgcaccaaatggtgaacaacaacactttaaccatttgcattgataacccgtaatatggtggagcgagcatttagggtattaaaatgaagtggagagttctactgaaaatgtcgttttacaaaatagaagatcaaaagatcatcgttgcagctactatgtgtttgcataactacatttgagaaaaccatgttttagataaggattttgtgaaatgtgatcggaatcctaaatatgtgcccacatttctaaaaaggtatgctatatt

SEQ ID NO: 48268 - DNA, 431 bp, Zea mays
  Clone ID: LIB3066-028-Q1-K1-E10
cacggccaaatatggtagtgattggctagatgccaaggcgacatggtatggcaagccgacaggtgctggccccgacgacaatggtggcggctgcgggtacaaggacgtgaataaggcccctttcaacagcatgggcgcgtgtggcaacgtccccatcttcaaggacggtctaggttgtggatcctgcttcgagatcaagtgcgacaagccagcagagtgctctggcaagcccgtggtggtgtacattacggacatgaactacgagcccattgcggcgtaccacttcgacctagcgggcaccgcgttcggtgccatggccaagaagggtgaggaggagaagttgcgcaaggcgggcatcattgacatgcagtttcggaaggtcaagtgcaagtatggatctaaggtcaccttccacttggagaaggggtgca

SEQ ID NO: 48269 - DNA, 250 bp, Zea mays
  Clone ID: LIB3066-028-Q1-K1-G7
gcttcttggtttttaagaaactgagaatctaatttctataaacttagtcataaactagtatgtttggaaccacctcaatttctataaaccagtttcttaaaaactgggtgtttccaaacagggcctaagtcactgtagtgcttagccagttgtaacttaagagagttctgttaggttgccttgtggccacaaaaaaaaaaacacaaataaaactgtgcattacgaaaaacacaatgaacaaccacaaaaa

SEQ ID NO: 48270 - DNA, 411 bp, Zea mays
  Clone ID: LIB3066-029-Q1-K1-A12
gttcacttctccaggtaaggaaagggttcgtactcatggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaagaagaaatagagagcatttcaagttcatggagcctgccagagattatgtt

SEQ ID NO: 48271 - DNA, 251 bp, Zea mays
  Clone ID: LIB3066-029-Q1-K1-B12
ggtttctgatgtgccacatcaaacaccaatgctataccatacatgagaaagaccaaggcttgccaaaaaaaacaaaaacaagagtcaagaacacagaaaaagaccaaataccaaaacaaaaacaataaacaacaaaaaaaaaaaaaaaaaaaaaaaaaaaaaaaacaggggcggcccttttaaaaaacccaaatttacctaccctgcattacaacgtcatacctttatgatgcagtccccaaaattaaatt

SEQ ID NO: 48272 - DNA, 64 bp, Zea mays
  Clone ID: LIB3066-029-Q1-K1-B2
aaaaaaaaaaaaaaaaaaaaaaaaaatttaaaaaaaaaaaaaaaaaaaaaaaaaaacaagaaag

SEQ ID NO: 48273 - DNA, 219 bp, Zea mays
  unsure at all n locations
  Clone ID: LIB3066-029-Q1-K1-B8
gttggcttcatgggccgacccactaaggcttgcctgctcggacctgttggcttcatgggctgatgggttntttttatttcggtaaaaattccaaaaaaaaatcgggtacccgaccaaaccggccgtaaaatgaccttccggttttgattccggtttccattaaaaatttccattccgaatctggtttccaattattccggtacccgtgaattcgaaccg

SEQ ID NO: 48274 - DNA, 158 bp, Zea mays
  Clone ID: LIB3066-029-Q1-K1-D5
aaaaaaacaccctaaattcctcaacacaaaaatgtttataaataaggtgcacaccaaaaaaaagtgatgggtttctcaaaaccccaataaaatcgtaatagcacccataatcataaaccccttgaaaaacctgtgatcggatcaggcccaacaaggac

SEQ ID NO: 48275 - DNA, 54 bp, Zea mays
  Clone ID: LIB3066-029-Q1-K1-D6
cccacgcgtccgcggacgcgtgggaaaaaaaaaaaaaaaaaaaaaaaaataaag

SEQ ID NO: 48276 - DNA, 117 bp, Zea mays
  Clone ID: LIB3066-029-Q1-K1-H10
gattggcggccggagcgagattgttgatgccttgttgggaggaggaggggaattggaggaatatatcccaacaagaatttgattagtaaaatcggacgcgtgggttctagatcgcga

SEQ ID NO: 48277 - DNA, 379 bp, Zea mays
  Clone ID: LIB3066-029-Q1-K1-H5
cacgcagtacagcgagtacaagaactgggtgtggaagtcgcaggacgacctgttcctgaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccgtaattaatggtcaactctaacactgcttgcctttgcctgccggccagcaaaaaaaaaaaaaagaattgaataaaa

SEQ ID NO: 48278 - DNA, 167 bp, Zea mays
  Clone ID: LIB3066-030-Q1-E1-A8
gcagcattgcattaattaatgcaggtgagaattgtcgaataatggaattgatacaccgattttatcagtacacttgtttcctcgcataaaaacttaccattttggaagttccggaaaaatggactttggctccaattaagaaaatacaatgtcatcctacgctatac

SEQ ID NO: 48279 - DNA, 317 bp, Zea mays
  Clone ID: LIB3066-030-Q1-E1-C12
gtataggagcatactctagataaatcctttattgtactgtttccaaagaaacggacaagctatacattgcattcggaattattgaccatacgacagacgagtaattttcgacagatttaaagcacgatgggtcccagaaggtacccatgactcttgagctatcatgccctcttgaacagaacaactaggatgaccgctatggtcagagccatgaaggatcctcccacagccatctctgttgcagaaaagcccttctcaactgaagggcctgctccggtctgggcctcggctgagtcattgaacaagtccctgaaaaa

SEQ ID NO: 48280 - DNA, 97 bp, Zea mays
  Clone ID: LIB3066-030-Q1-E1-C6
accacgcatccggtgaaaaaaaaaaaaaaaaaaaaaaaaaaaaaaaaaaaaaaaaaaaaaaaaaaaaaaaaaaaaaaaaaaaaaaaaaaagaaaaac

SEQ ID NO: 48281 - DNA, 304 bp, Zea mays
  Clone ID: LIB3066-030-Q1-E1-D9
atttgcaagttcttgtgatcatttcgacaccacctgctacgatatttttatatgatgattggggcatgcctcatagagccgcggtactgaaattccccttcctctgggaggaagactgcttcgaagcaccaaaacacgaattcgacgtcacaagtgtttcctgcaatgtctctgcgtcatccatgatcctgctggactactaacattcacatgcactagtcgtaataaatccagtgcgcttttcatgtataaatctgtactgtggctcgctaaaatacaatttggcaatggtttatgacaaaaa

SEQ ID NO: 48282 - DNA, 74 bp, Zea mays
  Clone ID: LIB3066-030-Q1-E1-G2
aaaaaaaaaaaaaaaaaaaaaaaaaaaaaaaaaaaaaaaaaaaaaaaaaaaaaaaaaaaaaaaaaaaaaaaaaa

SEQ ID NO: 48283 - DNA, 435 bp, Zea mays
  unsure at all n locations
  Clone ID: LIB3066-030-Q1-E1-G4
gacaacccatcggccaacccgtcgggatatgcaaccaggttgctgtcaatatcgcccctccagaaacgcaatcaagtacaagttattgggtttggagggttgattcgacttatggaaggggacgaggaggacgagaaaggggatggttcagcccactttgggttgcatttgcaattctgattggtggtctcttattggatgtgctgatatctgtttttcttggtgtttccgcacttcctgtcaatataataattggtgttcttatagttctcggattgggcaccgcccttcatctagctcttgagtgctgtcacgaatggggctcaaggaggaacgtggccaatattccgaggctggagaacatagcgccgactgggtaccaccctgcagtagtataatcgttatgggacttgtaaatagcgtangaacatctaa

SEQ ID NO: 48284 - DNA, 116 bp, Zea mays
  Clone ID: LIB3066-030-Q1-K1-D12
cccacgcgtccgcccacgcgtccgcccacgcgtccgaaaaaaaaaaaaaaaaggaatggataataaaaaaaaaaaaaaaaaaaaaaaaaaaaaataaaaaaatatataataaatat

SEQ ID NO: 48285 - DNA, 382 bp, Zea mays
  Clone ID: LIB3066-030-Q1-K1-F1
gtataggagcgtactctagataaatcctttattgtactgtttccaaagaaacggacaagctatacattgcattcggaattattgaccatacgacagacgagtaattttcgacagatttaaagcacgatgggtcccagaaggtacccatgactcttgagctatcatgccctcttgaacagaacaactaggatgaccgctatggtcagagccatgaaggatcctcccacagccatctctgttgcagaaaagcccttctcagctgaagggcctgctccggtctgggcctcggctgagtcattgaacaagtccctgaaaaagtcggttatattgtggaccacatccatcactttcttcttcgcattgtccacgaaatctgcgaaac

SEQ ID NO: 48286 - DNA, 64 bp, Zea mays
  Clone ID: LIB3066-030-Q1-K1-F9
aaaaaaaaaaaaaaaaaaaaaaaaaaaaaaaaaaaaaaaaaaaaaaaaaaaaaaagaaaggaaa

SEQ ID NO: 48287 - DNA, 388 bp, Zea mays
  Clone ID: LIB3066-030-Q1-K1-H5
gcagcattgcattaattaatgcaggtgagaattgtcgaataatggaattgatacaccgattttatcagtacacttgtttcctcgcataataacttagcattttgggagttccggaaagatggaacttggcctccactaaagaaaatacaatgacatcatacgctatacacgatggttctcagatgacttgcctccgaaagaaacaagctgtctactctttgcacagcggtcaggagcgaagcaaaagcaaaacatgctgatactgtgatacaaaacatttgacgccattagcgcctgtacccgctactagccagatcacatactcctcgtctgcttattggccgattgctttccaaccttctctcggttctttcttgagctcctactc

SEQ ID NO: 48288 - DNA, 320 bp, Zea mays
  Clone ID: LIB3066-031-Q1-K1-A6
cacggacctaagccagtacaaggatcatggtaattggatcgagattctacgcgtggacaaggttgtcatcaccggcaagggaaagctcgacgggcaggggccagccgtgtggagcaagaactcctgcgtcaagaagtacgactgcaagatccttcccaactcgctggtgatggacttcgtgaacaacggggaggtgtccgggatcacgctgctcaactccaagttcttccacatgaacatgtacaagtgcaaggacatgctgatcaaggacgtcaatgtgacggcgcccggggacaagcccaacacggacggcatccaca

SEQ ID NO: 48289 - DNA, 293 bp, Zea mays
  Clone ID: LIB3066-031-Q1-K1-B12
caaactgaaagggcaaggcagaaagagctctggctcaacctggggaggggcgtgatagcatggctttggatttccagatagaagagaacagactcaaaacgacaccttatagcgatcgctgcacttaatccttgttccatgcgcagcaagcctcaagcttattacccttgtttgtcagcgttgtgtaaaaactgtaacccggatgctgtttcttcttcttcttcttggttccttcttttttctgagtcgtcctttgtggattcaaataataaataaagtcttgtaaaataaac

SEQ ID NO: 48290 - DNA, 64 bp, Zea mays
  Clone ID: LIB3066-031-Q1-K1-C10
cttgttcgcacaaaaaaaaaaaaaaaaaaatttaaaaataaaaaaaaaaaaaaagaaaaaagag

SEQ ID NO: 48291 - DNA, 70 bp, Zea mays
  Clone ID: LIB3066-031-Q1-K1-E12
aaaaaaaaaaaaaaaaaaaaaaaaaaaaaattataaaaaaaaaaaaaaaaaaaaaaaaaaacagaaacgg

SEQ ID NO: 48292 - DNA, 256 bp, Zea mays
  Clone ID: LIB3066-031-Q1-K1-F11
cggacgcgtgggcggacgcgtgggcggacgcttgggaaaaaaaaaaaaaaaaaaaaaaaaagagaaaggtaaaaaaaaaaaaaagaaaaaaaaagcctgcctatttatatgatccaagctttcgatcccttgcatgcgacttcttacctcttctctagtgccacctaaattcaattaactgcccctcctttaacaacttttaaactgtgaaaacccttactttccccaacttaatatcctttcagctcatccccct

SEQ ID NO: 48293 - DNA, 395 bp, Zea mays
  Clone ID: LIB3066-031-Q1-K1-F8
ccacaaccctgtgcagagttcttgcagtcttatcaaggtgacaggaacgacataggacatggaggccaccctgtgcccgaagccccatttcgtggtcatcccatggccagccaccagccacatgatccccatcgtggacatcggctgcctcctcgccgcgcacggcgccgcggtcacgatcatcaccacgccctccagctcgcaactcgtccagagccgcgtggaccgcgccgggcaagcctcagcgggggtcacggtcaccgcgatcccgttcccgggcgcggaggccggcctgccggacggctgcgagaggacggaccacatcccatcgcctgacctcgtgcccaacttcttcgtcgccaccgcgcggttcggcgaggccgtggcgcggcact

SEQ ID NO: 48294 - DNA, 419 bp, Zea mays
  Clone ID: LIB3066-031-Q1-K1-G2
cggacgcgtgggctaacccaagacaaaacatgggtgtgaatgtgagaaccatgtggtcgtcgatgcgggcacaggttgcgatggctgtggtgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgacaacggtggtggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgag

SEQ ID NO: 48295 - DNA, 345 bp, Zea mays
  Clone ID: LIB3066-032-Q1-K1-A12
ccgcgctgtggagcggcggagagcaatccttctcttgtcaggcacgcctctggcgctcttgtggaggagccgcgtgccgacgagccatgcagatacggggtaacaacctaaccgacatgtgctgactcgtgatcaaagcaagattatagttcaagttggaatcatggcactgtagtagatatagagctatcacatagacttggcgcacgaatctgactgcggctactatggcaagcgccttgacactgcctttggagacttcaccgagaagatcgtcaacattggtgctgcaaatgccccattccaggtccttgcaacgctaagaggccactataggaccgcgtg

SEQ ID NO: 48296 - DNA, 325 bp, Zea mays
  Clone ID: LIB3066-032-Q1-K1-A8
gagaacaagtccccaacaatatactcactgcattaatatatatagcggtgtaaacaggttgatcgttggagagtacacatgaatcaacaacccaagacacacacacacactctcccaactggcgactcgcgtgcgtgaagcgatcaaaacacacccaagatgaaaatactggtaaaattcaagtacaagaagcgatgaactggtatatattattatgtatcactccgggaccgggggcggcaacacgcgcgcggccggccctgcagccggaggagctcagctgaagaggtacccaacggcggccacagcgagcgtgccggcagcg

SEQ ID NO: 48297 - DNA, 279 bp, Zea mays
  Clone ID: LIB3066-032-Q1-K1-B10
cggaatggcagaatcgacccaagcgtcccgccacgcgtgcgaaatacaaccttgaaatgcttgatttgatgactgtttcccaatacgtatgcacggatatatacttaagccttgatactgctattcggtgagcaattgaactctctaagcatgtactatatctcaaaagaaagtatggcaggccgcatctatgaagtaaccaagacttatcgtacgctctgcatgctatcgtcataggctcttctattctgacatctcaattgaattaactgtccaacc

SEQ ID NO: 48298 - DNA, 189 bp, Zea mays
  Clone ID: LIB3066-032-Q1-K1-F10
agcgatccgggcagacgatactgcagcaggctgatgtgctgcgggtgacctggaacgagcctatgcgtttgagccggcatcacgctttgacgatccgtatcactaagtgcgcagcgtgtattgcatctgatccgatggctcacgtactaccctcatatcagacgctatcagtataacaacgtgagtggt

SEQ ID NO: 48299 - DNA, 57 bp, Zea mays
  Clone ID: LIB3066-032-Q1-K1-G12
acaacagattatctctactataaggccacctaaattcaattcactgaccgccagatc

SEQ ID NO: 48300 - DNA, 305 bp, Zea mays
  Clone ID: LIB3066-032-Q1-K1-H12
gactagttctagatcgcgatctagttttagttgtcctacgtggcgcggcgcgcccagtctggtgaaggatcatacgagcgtcggcttgtgttgtggtcgaataaataatgcgtctgtgtgccgatcccgtgtcgggttagtgggcccactgtcactgctgatgtggcctgcctttacagcacatcgatggagctggaccgcagagctcatgtgtcgattaaatatatgagtactctgaactggaccaactattatgtagtgtcagtgtgtagtaagcatatttgtgtccacaacaacaatgatgc

SEQ ID NO: 48301 - DNA, 327 bp, Zea mays
  Clone ID: LIB3066-033-Q1-K1-A12
caagatgcaagctaatgtagccataaatgggcaaagataatacagcatttctttggtatacaagtttatccttccgtatgacagaattccagcttatgttggaacacttctaagtttgtgccgcaatcaacactgcacatctcatttaaaaaacgaaggcctaatagatgtagaaattaaactaaaatctgaaagcttcacaaaatgtttgtatccgctcctctagcatttttggtgttgtaaaccacacctctggttaccttaactagaaacaagcaactaaccctgatattaatctgacatcaccaattcacagtcatgcacctg

SEQ ID NO: 48302 - DNA, 367 bp, Zea mays
  Clone ID: LIB3066-033-Q1-K1-A2
acagcgaacgggcctcgcaggcctcgtgctttcagctcatgtattacagtattccctatggcccgtgtcaagcacgcacgcactatataaaatacacttatatacatacatgacgtgtactacgacaacgacgaagaagaatgaacagctagcagacgtaccggcggccgattcacaagtgtacagaaaacgatcgactccactccaactatacatatcctactatggcttttgctacaacccgatggatcagaaagcatgcatgcatgtacaggcaggcatggccatggcgatgcctgcaggctgcaaacgaatttgatcagatggctgacacctttgggacggcgacggggtacctatcgatgtc

SEQ ID NO: 48303 - DNA, 367 bp, Zea mays
  Clone ID: LIB3066-033-Q1-K1-B3
cggacgcgtgggcggacgcgtgggcgctcgacaccaaggccccgctcaagtaccccctttgcatccgctttgctgtcaagtccggtggctaccgcatcgctgacgacgtcatccccgctgatttcaaggccggcaccacctataagaccacactcagcatctaatcagcctctgatgatgaattatatttcaaaagagctcacctggtgctcatgttagcaagacaatattttttctatggttattttgtggcaccaaaccacccaagaaatatgtgatgctacatgtcccttctgatgccttgctgtgttgggttgatattattacataaactaaatcaattatttatttaagattttaaaagaaa

SEQ ID NO: 48304 - DNA, 296 bp, Zea mays
  Clone ID: LIB3066-033-Q1-K1-B5
taaaaatcagaattgaaaacggtttgattattgtttttgtttgaaaatacatgatatcctattttattgacactcgtcagactgctcttcattccccgttgctgcattagggcatgcccccgtcatgtagcagtatttgatctgcttctgcttcatgggtccacatcctggtatctttattccataatgatatatatattaattaacaaactaaaacatgtatttattttacgggtttgtcgacggatgagcttgctctggcttgtgcatggatggaagaaccgagatcagctgac

SEQ ID NO: 48305 - DNA, 393 bp, Zea mays
  Clone ID: LIB3066-033-Q1-K1-E7
gagcaccaccaccaccaccagtacgggccgcctccgccgcagccgatgtacgcgtcggcgtacgggcagccgccgccgccgccgccgatgtaccagcagccgtacggacagccggtgtacgcgtcgccgtacggccagccgtcgccgccaccggcgatgtacccgccgccgtacgcgcagccgccgcctccgccaccacggaagaccggcgcatcgttcgcggaaggatgctgtgcagggtttgccgcaatctgttgctgctgcctcatggacgcgtgcttctgatcgtgtggtcgaccacaagcccaagatacgacgtcttacttctggcctgggtcagggtgcccatcagcgaggagctgagatcaaccaccgtgttgagcagctggtggt

SEQ ID NO: 48306 - DNA, 93 bp, Zea mays
  Clone ID: LIB3066-033-Q1-K1-F6
aaaaaaaaaaaaaaaaacaaaaacaaataaaaaaaaaaaaaaaaaaaaaaaaaaaaaaagaaaaaaaaaaaaaaaaaacaagaaaaaaaaaaa

SEQ ID NO: 48307 - DNA, 178 bp, Zea mays
  Clone ID: LIB3066-033-Q1-K1-G10
ccacgcgtccgcccacgcgtccgcccacgcgtccgtctagatcgcggctggccacgcatgcgatgaccatctgatatggacggaactatatattgtattcctattaatctggcattttctaagctaattgttttttttccaaataagaaaaacaagaaaaaaggacaaaagaaaaaga

SEQ ID NO: 48308 - DNA, 389 bp, Zea mays
  unsure at all n locations
  Clone ID: LIB3066-034-Q1-K1-A7
tacaagcactggtacgagcagtgctcctaccggagcaaggacgacccgaacggcaacaggatgtgcaaccagacgtgcggccagacctacaagggcgccgacgacggcgcgcccgcttgatcgacccgttgttcatcggcgcgcggattcaggtgcatattaagatcattttcaatatcttatacaatggttacgtcagcccatacatgagctcatgaatgagctcattgaatgttctacttatactatagcatatactagatgctagccttggtgctcatacatggattcactcatctatccactaattcctaccataaagtgagatgacctatgtgtagacatatatatgcatgaatatatgcattaaacagnattttaaaagggcg

SEQ ID NO: 48309 - DNA, 345 bp, Zea mays
  Clone ID: LIB3066-034-Q1-K1-F8
gcagaatgcaacatcggtttccaccattttcctctttacagaatactactgctccgtgtatacggagaaactacatttcacggagtagtaaataaacagggattaattagcgccgtgtgcatgcatgcatacggcgttgggctggccgacatgatcataacaattaattaattaattaaggcgaagacacgaagcgtggaggatcgatgcgtccccgccgccgcagtatgttttaagctgacttgcggtagatgtgttgtggcctgccggcggcggcgtccttctgggtgtctatgacagtctcgaaagcgccgacgagcgccttgaccctgctgcactggcgct

SEQ ID NO: 48310 - DNA, 345 bp, Zea mays
  Clone ID: LIB3066-034-Q1-K1-G12
attccgaaggacccattttattccggaaacagatgcccaggctttctccgggtcctctgatagaagcaaacataggttcacagttcagacttgacttacaaacagtcgcacaaaacatacagcactctgttctaactcgggacacgaaatcctctctttctctctccctctccctctccgctcactgcctcaatctaggaagactgccggagctccgggcgcacaaagtcggcgttggcaggcacagagatgtcgacggtgggcctcagctcggcgcagacctcaatggcaccatggacagggtccgacaagaagttgctgatgaggtcctggttgatcggggcg

SEQ ID NO: 48311 - DNA, 345 bp, Zea mays
  unsure at all n locations
  Clone ID: LIB3066-034-Q1-K1-G6
gaatgtcctggcatggaattgatacaaatatagtacaacatacacaatactgtgtcaatttatcagtatcaacagtgcagaatttccttagagttgcaataattatatccccaatagctcaattgaagcaatttaagcaacaaggacaatggggagccggacgtttccataaccataataacaaggttaaccttgtatagtaagaattgaacctttggatctaacaacaaacaacacatccaccggatgaggaaggatttcacctttgaagccaatcctcacaccgcggaaggttcctcgacgtccctcccccgttcgccgncaacgccaccgagcctgggcaca

SEQ ID NO: 48312 - DNA, 86 bp, Zea mays
  Clone ID: LIB3066-034-Q1-K1-H3
ccgggtcgacccagcgtacgatcaatttgagacccccatgattgacaacttttgtgcaaaaaaaaaaaaaaaaaaaagggataagg

SEQ ID NO: 48313 - DNA, 189 bp, Zea mays
  Clone ID: LIB3066-034-Q1-K1-H5
tgttgatgtgggtgtttcgtcaactctgtactgtacaacacgactacagcgtgcgtgctgggtcgatcctatgctctcttgttgcaggattcaagtttgttgttgtccgttccttccctttggcaaaaaaaaaaaaataataaataaaaaaaaaaataaaaatgaaagtaaatttacaaattagaaaat

SEQ ID NO: 48314 - DNA, 65 bp, Zea mays
  Clone ID: LIB3066-035-Q1-K1-C11
aaaaaaaaaaaaaaaaaaaaaaaaaaaaaatttaaaaaaaaaaaaaaaaaaaaaaaaaaaagggg

SEQ ID NO: 48315 - DNA, 134 bp, Zea mays
  Clone ID: LIB3066-035-Q1-K1-G6
cggacgcgtgggctgacgcgtgggcggacgcgtgggcgacaggcatccgacagctatattatgttcgacggtgtaacaccctgaatttgagggtataaaatttcttctctaaataccaaccaaattcaggtgtt

SEQ ID NO: 48316 - DNA, 303 bp, Zea mays
  Clone ID: LIB3066-035-Q1-K1-G9
cccacgcgtccgctcttggtgctgatcacctcaccgcggggcagcctgtgggacccgaacgctggcttcatggttgagggtgctacactcgagacagtcactcctattccttatgatgcggtcaacgatctcaagggcggttactagagagaattcttgtaccttcagcagttcaaacgagctggcaaacttatctgaatctttttgataattggctagttcttctgttctggtgttatgaactcatgtggctattgctgctggcgtcaaaagattccttttattgccatggttgagataaac

SEQ ID NO: 48317 - DNA, 453 bp, Zea mays
  Clone ID: LIB3066-035-Q1-K1-H4
agaccgtacccgtgacgcgtgggcggacgcgtgggcggacgcgtgggtttatgatgatggcactgctaagggagagttgcctgaaacagtttattgctttgatggtgtcttctataattactttagcataggaatggatgctcaagtggcttatgggtttcaccaattacgtgatgaaaagccatttcttgcacgcgcaccttcatgtactacggcaatttacgcaggatatacctgcaagcaaggatggttctttacacaatgtattagtgatcctgagttaaggggattgaggaacattatctgtttatcaatcaagaggatggacagctctgagtgggagaacattcctgtcccatcgagtgtgagggcaatcgttgcattaaatcttcacaattatgcaagtggaagaaacccttggggaaatttgaagcctgaatatttggagaaaag

SEQ ID NO: 48318 - DNA, 249 bp, Zea mays
  Clone ID: LIB3066-035-Q1-K1-H7
gttctaagggacctgtaaatgcttgtgccctatattgtgtgcctccacatattggggagcttgaagcatcgacaagttactagtcattgcttacttatataagaacataagtagtatttgctattgtcaagtgtgccttgcttgatgcaagttgtgttttcgtatcattattattatgcacggccatcgtacgtgtatggcttgtatgggttattgccaacttaataaaagcacactctgtttgcctat

SEQ ID NO: 48319 - DNA, 325 bp, Zea mays
  Clone ID: LIB3066-036-Q1-K1-C2
gtatcttcgttaaaaattatagcagtacaaatcatagcacattgtgtaggtgtaggatacagtatcacagcagctgaacatcaaacccatctcctgccaggctctgagcaaacgccaaagccttcaacgtggcacctacgtaccgtaccccagtcacccacctcacacgctacctcgctcgcagtcgcagcttccgctgtacgcacactactgcgcggtgcacgcaccgacgacacggtggcgcagcttatgtatgagtaagtatagggactcggcatacacgttgtaattgcagcgtgccaccccgtctagcgatcgaacacag

SEQ ID NO: 48320 - DNA, 299 bp, Zea mays
  Clone ID: LIB3066-036-Q1-K1-E3
tgtttttttttgacaccgttggtctttctctttcgctctgtttaaaaaaagacattattatgatagccacttactgataacccctggtgacaatcttgtgagattatgcttggtgagcaccaccctaccaagtggcagttgctggataaactacagcctataagcggccccttgaacaacatggccttcttaactgggacaataacatcgcggaaccaacgtcagacgggtattcacatgctaacttactggtcacctaacattacaggcgaaacttttatctttacaatggctgggcg

SEQ ID NO: 48321 - DNA, 265 bp, Zea mays
  Clone ID: LIB3066-036-Q1-K1-F8
tagcgctatacatggttgggccccatcttgtatcaagtccgccgaatcctgttcacttatgattgaaaaagactgataaggccattgctttttcacgaccagacataccaacacctgtgatccatagtccggaactgtcacaggagtatcgtctgcctctgattgaatgtaacagtgcaaaatgctccactacactctctggcagaggcacaccgttagggctacggccttctaggctgcagcgagctcattggcgtacagtttt

SEQ ID NO: 48322 - DNA, 455 bp, Zea mays
  Clone ID: LIB3066-037-Q1-K1-B1
taattaggttgacaaaagagaaggaggattatagaaatactattatgaatcttaagcaggaatttgaatcattaagatcgtcatatgaggagagatgtaagttgttagaatctaagaaggaagatgtagttaaacttgtcgcagacaaggaaatgaatgacaacatagttttgcaactcaggcaacaacttgaggcaacaaaaaagttccatgaggcagagacaaaagagaaggaggattatagaaatattaatatgaaacttaagcaggaattcgaatcattaagatcgtcatatgaggagagcagcaagttgttagaatctaagaaggaagatgtagttaaacttgttacagacaaggaaacgaatgacaacataattttgcaactcaggcaagaacttgaggcatcaaaaaagttgcatgaggcagagactcagcaattagagaccaaagct

SEQ ID NO: 48323 - DNA, 143 bp, Zea mays
  Clone ID: LIB3066-037-Q1-K1-B11
taattatttaactattttgtatagaactccattatatattaaggatgtgacgttcatttcaaaaaaaaaaaaaaaaaaaaaaaaaaaaaaaaaaaaaaaaaaaaaaaaaaaaaaaacaaaaaaaaacaaacaacaacaaaaac

SEQ ID NO: 48324 - DNA, 433 bp, Zea mays
  Clone ID: LIB3066-037-Q1-K1-H11
tttttgtcaataaaaaagatctatttggcccgatggaaaaaaatatacagcatactgcatacaagttcaccacgtaatcgagatgacgtgaaaggtcggacacgaaccggacgaaactgcagcttttattagtatagtacgtactagctgtagctgtagcgagtacgaaaaggtagcgaaaccctgctgctcggaggaagtacatctgacatataggaggagcacaagagagcaggccatcatccagcccacacacggcggcgaccacaggccgctcttctaccgttggtcggacccaaaacgatccagcgtcacatcacatcacagggcacagcgagtcagcgacccgcaccgagaagagagaagacctcgctcgcgctctacaagaacgttccgggcgtcacagagcgcgcccgcgtggcttaacacgccg

SEQ ID NO: 48325 - DNA, 386 bp, Zea mays
  Clone ID: LIB3066-038-Q1-K1-A12
acaaaggaggggacacacacacacactttctaccgtctccgcccgcccgccgcgacgctgcatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcaccccgcgccggctggccgagctgctcgtgtacgtgtcggccgatgtgggcatgaccgtggccgcgttcgcgcaccacgagctcaacgccatcaaagacgacgacgttctgtacaagtgcatcgacacct

SEQ ID NO: 48326 - DNA, 178 bp, Zea mays
  Clone ID: LIB3066-038-Q1-K1-A7
cggaatttgagttccaataaacggaatataccttcttcgatcaccttgaaggattgtatcattagaattttcatacagggctggccttttgagtctctgcctacgcacgcagatgttgtggttcttgtgtttgtagcctatatgtactccctgagtcgattatagaaatgtttatgcc

SEQ ID NO: 48327 - DNA, 282 bp, Zea mays
  Clone ID: LIB3066-038-Q1-K1-B3
acggctgctacgcgtacatcctgatcgactctatgtctaaccaggcctccgagaaggagggcgggcccaacatctccgtgaagggctccgacctgatcgaggagatcaagacggagctggacaagaattgcccgaacgtggtgtcgtgcgcggacatcatctcggtgagcgcccgcgactcggtgaagctgacagacgggcccgagtacgcggtgccccttggacggcacgactcgctcgtgtccaaccgtcaggacgccgacaacctgacgggcccggaca

SEQ ID NO: 48328 - DNA, 279 bp, Zea mays
  Clone ID: LIB3066-038-Q1-K1-B6
aatatgacaacgcagacgcgtgggtctagtttcacctctcgaggcgcagagtcgtcgttggcgaatgaaatcaaactgtgtgtttttagcggtcaagtgattgtacgaaatgtaaaaaagaacgaatccagaacagcagcgcgaaaaaaaaaaacaattcacgattctttcgagtcactgcaaaaagaaaattgtaaattggtagcaactcgtttcttgcccttggtggcaggattgaataaactgatcgatacggggagctgttcaatcgaaaaataa

SEQ ID NO: 48329 - DNA, 77 bp, Zea mays
  Clone ID: LIB3066-038-Q1-K1-B7
gacccactcgtccgaaagaaaaaaaaaaaaaaaaaaaattaaatttaaaaaaaaaaaaaaaaaaaaaaagaaaaagg

SEQ ID NO: 48330 - DNA, 323 bp, Zea mays
  Clone ID: LIB3066-038-Q1-K1-D9
ttagccggtcatggcgccgtcgtcttccctggggcggagcgccagcgagctaccctacccgccgtcaccgttcagctccaacactgctcaccaccccgtctccgtgcccaccacacctaggttgtccttatcgtgctcgtcgttcggccacatggtgaccacgtccactgacacaccgtcgatcacgcccaccaagaagcaggacgacatgccgaagccgtcgccggaggccgtcaccgcggcgaactacgcgtcgatgtggtcgcccaagcgcctcatgcagtgcgctgcccgcactttccgacgcagcacgtcgtgcgccc

SEQ ID NO: 48331 - DNA, 203 bp, Zea mays
  Clone ID: LIB3066-038-Q1-K1-H12
attgagcaccttctactcctccgtcgtgtaacaactcaacccccgcaaccgccacatcggccattttcacctgctcaaccaagcccaacaccctttacgggcaagccccagcttaagcctctctttacacacccaaagttgcgccccaagccactccaatctccgttgatgttgccgctgattaacaagtaactgaaaaagtt

SEQ ID NO: 48332 - DNA, 127 bp, Zea mays
  Clone ID: LIB3066-038-Q1-K1-H9
attgaagaggcgaagtggtcgccgaatgttcgcatgaagtcggcgtagcactggatgggggtgcgtcccttgagcactggcatcgcgtctcatcccatggagacgtactcgtagttccatcggtcaa

SEQ ID NO: 48333 - DNA, 333 bp, Zea mays
  Clone ID: LIB3066-040-Q1-K1-A4
ctcgaccatccctgcaaattaccgcgatggctcccaagatcctagtcatccttgtgtgcctcgccgtggcctcaccggctgctctggctgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaagtgcggccggcggtggagaaccacgtccttctcagttacttcgaccccatcaagctggacgagatgaagacacgca

SEQ ID NO: 48334 - DNA, 55 bp, Zea mays
  Clone ID: LIB3066-040-Q1-K1-C11
cgtggagatcaaagagcacgggggcgtttacttctcctttacgctcaaggagggt

SEQ ID NO: 48335 - DNA, 259 bp, Zea mays
  unsure at all n locations
  Clone ID: LIB3066-040-Q1-K1-C6
gcgacgcgtccgaatatgctnaccagatatgagcgacacgtcaatagcaccgatcacgacacatttaacaaaggcgacagccaccacgcgaaccccagccgtgtacctactgggggcggctgtcgcggcactcttagtcacgcctgctgccgtggacgcaacaacactggcggcaatatggaggggaaccgcttttccagacatcagcaccaccacagtggggaccaagtcccagagctccgggttcttagacaccatg

SEQ ID NO: 48336 - DNA, 395 bp, Zea mays
  unsure at all n locations
  Clone ID: LIB3066-040-Q1-K1-G10
ctcggcgtcaagtccgacgtctactctttcggcgtcatgctgctgcagatcatcacggggaagtcgcccatggggctgtcgcaccacgtcggccgcgccctggagcgcggcgagctgcaggacatgctggaccccgccgtgcccgactggcccctggaggaggcgcagtgcctcgccgaaatggcgctccggtgctgcgagctgcgccgcaaggaccggccggacctcggcgccgtcgtgctcccggagctcaaccggctgcgcgcgctcggcgaggacaacatgcagtactgcggcgccatcatcagggggggcagcggcagcggcngcngcatgcacagctcgtcgccgttccacagcaacatctcacggtcacacgccgagatgatgatcga

SEQ ID NO: 48337 - DNA, 305 bp, Zea mays
  Clone ID: LIB3066-040-Q1-K1-H11
ggcggatccgcctccgtaccatggagtcccgacggcgccacctcatggtgttcacgggggcgttcactgataggtggtggtcctcatgtactagatctcacgcctgcagggcaggctccctaacatgggtcgtcgcatcctcatggtactcacggtcgcgctcgtcgctcgcggcgcggaggccttgatctgcatctacgatcgggaacccttccgagaggtatacagagcctcctactctctggcccatagtattctgccagtcatctgctcccgaacgaagggacactcggatacgagccccc

SEQ ID NO: 48338 - DNA, 70 bp, Zea mays
  Clone ID: LIB3066-040-Q1-K1-H6
cccacgcgtccgccgacgcgtgggaaataacaaaaaaaaaaaaaaaaaaaaaaaaacagaaacttttaaa

SEQ ID NO: 48339 - DNA, 367 bp, Zea mays
  Clone ID: LIB3066-042-Q1-K1-B12
gtcaggctgactggattgctgctccattggtacagttgcacccgcggagatttaaagcagcgtttgtttggttgttcggtacataaatgcagactcgtctcgtgcaaaatatcaccctcagccaggcccgtccgagacggtcgccaagcacgtagtgcaacggcacgtaaaaagaggagagttgtagctatgttattctctgctatatctcttaattagaatatttaatcacagtactgattttatatctgtgtttctggtattttttaaacaaaactagaccacatatattgtataatatttaaagattttttgtacaatcttatctaatacacgttctgatacagacaaccaaacacgagctatt

SEQ ID NO: 48340 - DNA, 312 bp, Zea mays
  Clone ID: LIB3066-042-Q1-K1-E4
tatgtcgtctccaattcggcgataataacatacggaagagggaggaacagatttctcctggctatccataattgcggagttcgtcgtgatccgccatgctcgacgaccatccctttgctcaggatggcatctcgagccccatagcagcgcacatctttgacttctgcgacaatggcagcggcggcgacctcttcacggccgtgaacgtggcctcagacctgttcacggcgccatcagaggatgcctcgtcgtcgtccgtagtgacgacgcctttcgtgccctgcggccacggcgactacatgccgttgggca

SEQ ID NO: 48341 - DNA, 283 bp, Zea mays
  Clone ID: LIB3066-042-Q1-K1-F4
catgcatgcatgtatgcatgcgccggggtgacgtggcgttcagctcaggcgctgagcgaggctatacgtacgtcgtcaccggctggccacgcatgcgataaccatctgatatggacggaactatatattgtattcctattaatctggcattttctaagctaattgttttttttccaaatataccgtcgatggaactccaaatgtaatgtcacgcaaatgtgtgtttttcatcgattgaatggataataataaaaaggcatgctggcagttactactagaaaag

SEQ ID NO: 48342 - DNA, 103 bp, Zea mays
  Clone ID: LIB3066-043-Q1-K1-A8
aaaaaacataaaaaaaaacaaaaaaaaaaagaaaaaataaataataataataaaaagaaaaagggaacaaatataaataataaaaaaaaataaataaataaat

SEQ ID NO: 48343 - DNA, 435 bp, Zea mays
  Clone ID: LIB3066-043-Q1-K1-C7
caaagtcgcaataacttgtcttctcgaatcggctgcaaccccaccccagaccccaccgccgccgccgctagggttttggggtgaggatcgccgatgtcgacggctcccaggcgtcccttccgaggccgcggcgccatgccctcgggcaccggctacgtccgccgcggccccgccccaggctccgccgacgccgccaagcccctgcgcaagcccgtcttcaccaccgtcgaccagcttcgcccccagacacacggtcacactctcacagcccgcgtcattgccgtccgcaccgtcctcgacaagccctccacgcacctcggccgcacccgcgtcgccgagtgcctcgtcggagacagcaccggcaccgtcctcgtcacccgccgcaacgaacaggttgaccttttgaagccagatacaacagtgatcttccgcaat

SEQ ID NO: 48344 - DNA, 413 bp, Zea mays
  unsure at all n locations
  Clone ID: LIB3066-043-Q1-K1-D6
cccacgcgtccgggactgccttgacccagcgtttgctcctggggtctctcacatcgaacctggaggcctctccttccgcaatgtcctcaacatcctccagaatttgcagggtgacgttgtcgccgctgatgtggtggagttcaacccacagcgtgacacggtagatgggatgacagccatggtcgccgcgaagctggttcgggagctcactgctaagatctccaagtgaaacggtcaggattgcaccactcttcttgaagcaaagcgaaagggtgggttttgatgtcccggtggttattggtcatggtttctatgtatcgagcaccaaattgttcgacatgtgacaggtttatatgttaattaggttgcaataacaccataatggtttatttaaaaaaaaaaaaaattnaaaa

SEQ ID NO: 48345 - DNA, 266 bp, Zea mays
  Clone ID: LIB3066-043-Q1-K1-F12
gggaaataaattacctaatataaatttgctgatcaagcccaaaatggcttcattctcgtgcgatccacacgtcaacacacaaaagactgtgaaaatagattacggagatcactagaagctagcggaagactgtttggcatataggccttactctcgctaattcacatattcattgcccttatcacaatcctacatcaactgcttacactacactcaaaaacctctttaatctatgtaataacgaacagccttttctatacactctg

SEQ ID NO: 48346 - DNA, 279 bp, Zea mays
  Clone ID: LIB3066-043-Q1-K1-H4
cccacgcgtccgagcggctcttgtccgcgccacaagataccaattgttgcgctgggaatattcagttacgatgacccgctttagttcagttttttttttgggggggttggttcgatcatttggctgtagcgtgaatcgcatggacaacagactccaattactaagcaaatatttttgttctgcatatattggaagaaccttgttcaggcccccctttcgaaatgaaatgcgtgaaattttgttcttgttcaaacaagggctctgcgtgctgcaccggat

SEQ ID NO: 48347 - DNA, 351 bp, Zea mays
  Clone ID: LIB3066-044-Q1-K1-A7
gagctcgagagcatcgccagcacgtccgccgaggcaaaccgccagcttctcgcggcggaggagctccccgacgagctcgccggtaagcgagagctgctgtcccggacgctcatggggatcgacgaggcggccaccgaggccaagcgccagcttgatgaggcgacgacggagaacaccatgtccggcgaccacagggtactgaccacgggcctcatcggcacgttcgatgagatccaagacgggcgcagcgggtgcgccgccagcgacttccccaagtggctgccggccacccagcggaggctcctgcagcagacccagaagcctaacacggtggtcggccaggacgggagc

SEQ ID NO: 48348 - DNA, 222 bp, Zea mays
  Clone ID: LIB3066-044-Q1-K1-B10
cccacgcgtccgcttttttcccctagttggaagttttcttactcaattgaatgaacgagggaacttattgcatactatcaaaaaaaaaaaaaaaaaaaaaaaaaaaaaaaaaaaaaaaaaaaaaaaaaaaaaaaaaggacggacaatataaaagaatcaagctataagaacacatgcatgcaacgtcatagctcttaatatagtgttacctaaattcaatta

SEQ ID NO: 48349 - DNA, 237 bp, Zea mays
  Clone ID: LIB3066-044-Q1-K1-B9
acataataaatgaataaggcttttattgattgcgtttcttcttttcatgcatgtaacaaggccggaaccggaaaccctagaacatatttatatacgtacgtatccaacagcagcacatacatatacctgtaaggaaattaaaataattcgatatattccgtaccccttggaaagacctttttgcatccatctgcatgcatattataatctatattatattgatgtagatcccggccc

SEQ ID NO: 48350 - DNA, 83 bp, Zea mays
  Clone ID: LIB3066-044-Q1-K1-C7
aatataacaaaaaaattttttatattcaattaatttatattaatcaaataatttaattttaatgtatcacattttcatactta

SEQ ID NO: 48351 - DNA, 339 bp, Zea mays
  Clone ID: LIB3066-044-Q1-K1-C8
gtatcttcgttaaaaattatagcagtacaaatcatagcacattctgtaggtgtaggatacagtaacacagcagcagaacatcaaacccatctcctgccaggctctgagcaaacgccaaagcctccaacgtggcacctacgtaccgtaccccagtcacccaccccacaccctacctcgctcgcagtcacagcttccgctgtacgcacactactgcgcggtgcacgcaccgacgacacggcggcgcagcttatgtatgagtaagtatagggactcgccatacaggtagtcatcgcagcgtgccaccccgtctagcgatcgaacacagtcgacggggaacgc

SEQ ID NO: 48352 - DNA, 359 bp, Zea mays
  Clone ID: LIB3066-045-Q1-K1-B6
cctgatttctctggttccttgtgactattactaccgtttgtgcgagcacgcaaatgtatgggttgcattattgctgatagcatctgttcgttggccagatgagtagagagctgaaaaaatgttaagaacaccatagagagaagtccatccgttctctctcaacttaaggagcaaacagcaacacttaattttttttctgctttactgtttattagtcgcgttacatttgtgaacagttattgtaatatctttttttaactctgtattcgtagtgagatgaaattcgtgtgtgggcaacaaaaaatacaaagataacgaacgaatgcatgcaacgacataacaataatatagagaaaact

SEQ ID NO: 48353 - DNA, 347 bp, Zea mays
  Clone ID: LIB3066-045-Q1-K1-D10
cggacgcgtgggcggacgcgtgggcggacgcgtgggcggacgcgtgtgcggacgcgtggtgtgatgggtaccaggatgagaaacggattatgaagatattagtttcattttcatccatgaatagaagctaaaagtggtatcatatctatgaatggtttcaattgcttttctgttacaaccacattatttgctatatacgattcacagtacctgccagttgattccattggttgtttctgtaaaacaaatatcaatttgtcactagaatctgtgatgtttgtatgtaaacaggtactctattcatgtgagacatatatgtcttttctatcacaatgaagatgtcagaa

SEQ ID NO: 48354 - DNA, 315 bp, Zea mays
  Clone ID: LIB3066-045-Q1-K1-D11
cgctcatggtcggcaagaggagcaccaaggtgggatccccacgagcagagtgcttcaaggggggcgtgttcatcacatgcaactactatgccacggacctcaagaagaagaacaagaagaagaagaagagcaccaccaactgaactcatgatttccagctagcttcttccagttttgagccaagcatggatcttgtacaattaattgatctcagtataccttcaaaattatcatcactacaatatataattcgcccaagcatagatatataataatcaatcagttcatccaaaataaaaagcgctcaccgtacaa

SEQ ID NO: 48355 - DNA, 465 bp, Zea mays
  Clone ID: LIB3066-045-Q1-K1-G10
gcggaagtgcatcattctgacatgcagcttcaccccaggatcttgctcgttgactgcatacaaggtgacgccaagcggttacgagtggggacgcagcaacaaggacaacggaagcaatccacatggataccttccaactcactacgagaaggtccagatgcttctgagcgaccgcttccttggattctacatggttccggataacgctccttggaacttcaacttcatgggagtgaagcacgacccacagatgaagtacaacatgaagctgggcatgccccgggacttctatcacgaggaccacaagccaacacacttgctcgagttcagcaacattgaagatggtgaggccgctgaaagcgatagggaggacacattcacgtatgcgcctgttagaaactgctctgttttaacggcagtgtgtgtagctgtaaactgacttgacgggtgtcatctgttcgcctg

SEQ ID NO: 48356 - DNA, 327 bp, Zea mays
  Clone ID: LIB3066-045-Q1-K1-H4
cccacgcgtccgcccacgcgtccgcgcctaccaggaggccctcggcgggctgcacaacctgttcggcgggccgagcgtggtgcgcgtgtcccagtgcgacgggccccactgcttcgccgtgacgcgcgccgccgcgggcccgttctgcgccgacgtgctccgcgcgatgcatcacgagcccgaggtgatgtacgaggtgctgaagcagaggaccgacggcgccacggccgtcgtcctcgcccgggccttcggcgcaatgccgtacctggtgttcgaccccgaggccgccgtgatgtccggcggcgagagcagcgactcggagcggtc

SEQ ID NO: 48357 - DNA, 366 bp, Zea mays
  unsure at all n locations
  Clone ID: LIB3066-046-Q1-K1-C7
cggacgcgtgggcggacgcgtggggtttgttgaacacatactgcagctttccatgtgccagtattcggtagacccatgatttttcgctcagtgaagcatacgctgtgggaccaggtgccgaataggccaagactacagctttcaagaacttgtattttacaaactatccatccatcttgagtgaactcagccgtcttgttctttgatcaagctcagccaggacaacagtctcctgctttttcctttcctttgtgattggatttgttggcattgaaccaatcttgtcaaacgcgaatgtcaagagttcatcagggtcatatagatgatgtgtggttgtttgcaaacccacgcgtncgtagatcgcga

SEQ ID NO: 48358 - DNA, 87 bp, Zea mays
  Clone ID: LIB3066-046-Q1-K1-D1
cccacgcgtccgcccacgcgtccgcccacgcgtccgcccacgcgtccgcccacgcgtgcgcggacgcgtgggctagttctagatcgc

SEQ ID NO: 48359 - DNA, 176 bp, Zea mays
  Clone ID: LIB3066-046-Q1-K1-H8
gcgagaggcaagggacgtaagaagtcttctaattctatatcattcagttcgggtccgtgaacgtagcatctccttgtaaccatatatacatgcccgcgctatctatgagcattgcagacattcggataacgaacgttctcatctcaaaactcttctcctgatcctggctcaccggc

SEQ ID NO: 48360 - DNA, 219 bp, Zea mays
  unsure at all n locations
  Clone ID: LIB3066-047-Q1-K1-C12
acgcaataattttactaatcaaatacttgttgcgatatattcatccaattccactcacgcgtcctgagcaagcaacaacaatatgttccggccgacaaacaaaaccaaaaaaaaaacacactgaacccaataatcccactccacaaaaacttttatctcaagccattcgatcgatcacagncgtgtcgttctgcagacaccattaatacccagaaccat

SEQ ID NO: 48361 - DNA, 300 bp, Zea mays
  Clone ID: LIB3066-047-Q1-K1-C4
cttctggtgtttttttacaatactacctttcccatattttttttcatttcaaaaaatactaccactttaaacccatcatcttcaatgtctcgtacaatcccattcccaaaaagcattcccaacaaatgactgcgatatcattaatacccacttcgagttcaacaacccacataacaccaacagtagcaaattcattatacccttcaaatacatccacacccaccacatggccttcctatcacattcatggtcaacatccaccaaagttgacaaacgatcttcaaaatccaaacttacata

SEQ ID NO: 48362 - DNA, 337 bp, Zea mays
  Clone ID: LIB3066-047-Q1-K1-D4
gagtgtttatcttcgttcgtctcgtgtttgttgttgcccatctgtgtttttggttgaaggtcgctctgtgtcagttgttagtgctgtgttcatcctctgctccagcagacccatgcatcaaccagcatggactgcggatcgatgggtgctgttacccccgtcaggctttattctaagttaaatcctaaggaaaaaaatggtgcttcttggtgctgcaaaatggttgtgctcatttgaaaaactacatactctcgctttgagtgcgaatcaaggcaaaggttgccagtttttcaaacagctaatagcaacagctgattacaacaaacttatgccataa

SEQ ID NO: 48363 - DNA, 131 bp, Zea mays
  Clone ID: LIB3066-048-Q1-K1-A3
atgaatcgcagatcgtggattaatagaagaggtaaattttttttcaactattcacattaattagtgctgtactaggatcgattcaccgtctgtccgatcgaggcattccgccaaaaaaaaaaactgagata

SEQ ID NO: 48364 - DNA, 131 bp, Zea mays
  Clone ID: LIB3066-048-Q1-K1-B2
acggctcatgacaatggcgaatttggcatggaactgggttaaccttgcggaaaaaatggaactggggaaacaaaaatggtaataaatggttctaaccaaaaaaaaaaaaaaaaaaaagaaaaagaaagaaa

SEQ ID NO: 48365 - DNA, 312 bp, Zea mays
  Clone ID: LIB3066-048-Q1-K1-G10
gacctggccatgccaggtcgagctgcctgcatcctatttcatgtccaaacgcacgggtggatcacaggctacgcggctgttaattaatctacatacgtctgccttcaattactgaatctgcacgttgatacccatgatatgtcagactggtcaaatgagcttttcacaaacgaagtcctgatctgatttaatcatagatttaatgccatactcgtgtatctacttatacactttgtctaccactaaccacctttgtttgccaatgctctactgctctctatactacttatatactgtaacgagaacatgcgt

SEQ ID NO: 48366 - DNA, 244 bp, Zea mays
  Clone ID: LIB3066-048-Q1-K1-G11
gggcgagcgacagctggctcgggttttttttgctactacatacacgtagtatcctgatccaaggctagaactgtagagccatgcatgctgccggatcggagagccgtgggccatggaccgatggcgtctctctcccccgcttgttttcggcctctcgtattttggctgtagttcttgctctctcgttctcgtggaatgaaacacgtacgtatggattatcctaccagcagatcgactaagaaaa

SEQ ID NO: 48367 - DNA, 359 bp, Zea mays
  unsure at all n locations
  Clone ID: LIB3066-048-Q1-K1-G5
cgggcctcttctcgcagctgtgcgtcgaaggcccgctgggcctccagtgctgatcaacaggggcctgctgccgcccaccgcccggaatatatctatctccttgtaaacctacatcagacgatgccccagcgcgtgccgctgatttgatgcaagtatgcggttttaatttgtaaatcagagtcgacccatactacgcgacacccagtatcaattttcacttgtaatgaaaaattacacatgtactcatttgttgtacacaaacaaacaaaaaacgttagaatataagaggatgtttctcaatcgatcgttagacagaatgaatactcagattcctcanaaaaaaaaaaaaaacagatcaa

SEQ ID NO: 48368 - DNA, 332 bp, Zea mays
  Clone ID: LIB3066-049-Q1-K1-B5
cccacgcgtccgccaaacaaaaaaaacaaaggggctcaagacttcatcatgcatgcatgcataacacctcgagtaggagttgaagtacatgatcattgatggtatatatatagaggaagcatgtctatctaataagtccctcatccaaaattgttctttatgtcatgtatatgtacgtgcatatatatatatataaaaatacgtctccttttattaagtgtctttcgctttcgcgccgaactctgtaacttgagatatggatcaaatagattgtcatcactgcatatctactatggggctatggcttcccgttccagctcacatagaaaagc

SEQ ID NO: 48369 - DNA, 403 bp, Zea mays
  Clone ID: LIB3066-049-Q1-K1-B8
aaggagtcctgggcgctctcccatcagttcaacctggtgctgtacggcaggatccagggcaagggcaagtgcaccgagcagaacggcatcacggcgccggccatgaaggtctgccaggaggagtgcgacaaggcgtacgtggtgaaggcggtcgaggtcaccaacgcctgcagcgtcacctgcgccaaggacaagaacccgcgcctcatcgagaactgcaagaggtcctgcacccctactccttcttgaagcgaaaccccttgaaatgaatgaaccatgcatgcatgcatgtatgcatgcgccggtgtgacctggcgttcagctcaggcgctgagcgagtctatacgtacgtcgtcaccgactggccacgcatgcgataaccatctgatatggacggaactat

SEQ ID NO: 48370 - DNA, 350 bp, Zea mays
  Clone ID: LIB3066-049-Q1-K1-E7
cgacgagaggctatccggctgctccatggcggggcggcggtgggaggcccgtgcccggcagtgacagtggcctcctccgtccgtcggccctccccagcaccgaggacacgtcccctcacactcaacctggatcgttgtaccgcaaccactttgtgtttgagcgcctctagctggccatgcgcggcggatttgagcatcgcgggctcgcggccagaatataaccacctgttctgcttgctcatcgatgtgtctaattcaaaagggaaagtcctacaatgattgggcatttctttcaaaaaagaataccacggagaaaacgccatactgaacagacaagatcaccgaagcac

SEQ ID NO: 48371 - DNA, 247 bp, Zea mays
  Clone ID: LIB3066-050-Q1-K1-A7
ctcagagagggtaacatcctctgcaataaaaatacttcacgagcttgtcctgacaagttctaactaattccgacaggaaggtcgatttgaagcatacaaaatgtcaacgtaaaaaatccaatcacacgtactcacacgtaaaccgaaaatgaacacctcagaacgtctctgcatcacgaatggcattgtgttattcctcctcatcgcactatcccatcaccacaccatgcttgtcatgatctagcta

SEQ ID NO: 48372 - DNA, 353 bp, Zea mays
  Clone ID: LIB3066-050-Q1-K1-D7
tttttttttgttgtttttttttttttttttttttttttttttttttttttttttttttttttttttttttttttttttttttttttttttttttttttttttttttttttttttttttttttaaaaaaaaaaaaacatttttttttatttaatcagacccatttttttttttaaaaaaaaaaaaaaaaaaatttttaaaaaacaaaaaaaaaaaatttttttttttttaaatcctaaaaaaaaactaaaaaaaaaaaattttttttatttgtacacttatttttaaaaaaaaaaatcccttgtaaaaaaccttaaaaagttttttttagaaaagtgcttatatttcctttgat

SEQ ID NO: 48373 - DNA, 287 bp, Zea mays
  unsure at all n locations
  Clone ID: LIB3066-050-Q1-K1-G3
cccacgcgtccgcccaggcgtccgggctccccaaagatagcatagcagcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgnctgcaccaagatgtgcaaccaggcgtgc

SEQ ID NO: 48374 - DNA, 101 bp, Zea mays
  Clone ID: LIB3066-051-Q1-K1-D11
aaaaaaaataaaataaaaaaaaaaaataaaaaaataataaaataaatataaaaaagggaggaaaaaatataataaaaaaaaaaaaaaaaaaaaataaaata

SEQ ID NO: 48375 - DNA, 310 bp, Zea mays
  Clone ID: LIB3066-051-Q1-K1-E6
cggacgcgtgggcggacgcgtgggtttttttttttttttttttttttttttttttttttttatattgggtggtgtctttttttatgtgtctttcttatttactctttcttgctacccaacagctgacctatacaacacacgaaccaaatacaccggcccccgcattacaacgactagacgcgggaaaaccgtggcgaaacccaaattaatcgcctagcaggacataaacctgtaaacaggtgaaagcaataccaacacgaccgaaccgatcgaccttcccaacagctgttcaacatcaatggaaaaaggc

SEQ ID NO: 48376 - DNA, 115 bp, Zea mays
  Clone ID: LIB3066-051-Q1-K1-G8
aaaaaaaaaacccccccaatttaaaacacaccggtgcccccacaaaaaaaaacaaaaattaagggccaattgttttctcaaggaaagaaaaaccggtcctgcggaactttggggg

SEQ ID NO: 48377 - DNA, 183 bp, Zea mays
  Clone ID: LIB3066-052-Q1-K1-B3
ttatttttttttttatctttttttttttgggctcgtttttttattttttatagcggataaccatctattggcccatatatcaattttcacaaaaaatatcattaccaaagcgaaacaaaaaataaacatctaaactgaaacatgaaacacattcactgacataaacctgactgtaaaaaaaca

SEQ ID NO: 48378 - DNA, 68 bp, Zea mays
  Clone ID: LIB3066-052-Q1-K1-B7
tgagatttaatatcgagttgactggtggattaaaaaagaaaaaaaataaaaaaaagaaagggaaaaag

SEQ ID NO: 48379 - DNA, 430 bp, Zea mays
  Clone ID: LIB3066-052-Q1-K1-C9
gtaggtgcattgcttcggtggtccaccatggcgcagcgagcggtggccacgatgacgactaataagccccttctcctcctcgccctggcgtccgcgctccttggtgcggcgccggccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcggcaagggcgactacaccaacatcaccgcggcgctggaggatatcccggtgagcaacaccaagcgcgtgatcctggacctcaagcccggcgctcagttccgcgagaagctgttcctgaacatcagcaagccgttcatcacgttccggg

SEQ ID NO: 48380 - DNA, 375 bp, Zea mays
  Clone ID: LIB3066-052-Q1-K1-E12
cggacgcgtgggcggacgcgtgggttcgccagttctttcctcttctcgctgggctcataagctgcgagcatggttctagtgaagtacaggtggccctgagtgatatgttcagcacttgggttggcccactcgttctccagtcctgctgatgctgaacatcatgttatacatagtagtatacatcccattgtgttcctcctttcctccattatgttatgttaatcttttagtcgctgggagttcatattgttgtgctgaactgatcatgcagatcaaattttcgttgacgttattttcttgttcgtatcgggaggagtgtatgtcactatagagaactgaattatgtacggtagtttaaaaaaaaaaacacttaga

SEQ ID NO: 48381 - DNA, 371 bp, Zea mays
  Clone ID: LIB3066-052-Q1-K1-G1
tcgcccacgcgttcgatgcggagattgaacaggagcatcatccagcagggctcagaccatgttcgctatgttgtcctctttgcactgctgtgcttctctattgtctacctcttgtcaaagttctctagaagatagttccgtctttggtgggcaaatctaggataccatgacttggatgtaatctaaagaaaggaaaaaactatcgtacttctgcctggccttgtatgctcagtcttttcgtcgaaaatcgaatcacactagaaatacccttcaaagatttatgctaacgtcatccactgatccctatgattggaactgttgggattgaattttttctaccgaataaaaagctactacgactgttacactca

SEQ ID NO: 48382 - DNA, 155 bp, Zea mays
  Clone ID: LIB3066-052-Q1-K1-G7
ttatctctttttttttttcttttatgttgggttttttcttttcttcattctttataaaacgcaaggggcctccttagagcatccaattttacatacccatgcattccaagtccaagctcttctatagtatcacctaaatcctattaactgccccc

SEQ ID NO: 48383 - DNA, 115 bp, Zea mays
  Clone ID: LIB3066-052-Q1-K1-H12
tccagtgatatcaaagatggatgtacgcgtatggaaatacgcgatgaaccgaggtctggggattatttgcatgcacgactaatcatcactggcaccaccgaaacatctatctggg

SEQ ID NO: 48384 - DNA, 94 bp, Zea mays
  Clone ID: LIB3066-053-Q1-K1-A7
cccacgcgtccgcccacgcgtccgtttttttctctcaaaaaaaaacgtcaggtaacgatagggggactaaaaaaaataaggacaacaacaaaat

SEQ ID NO: 48385 - DNA, 391 bp, Zea mays
  Clone ID: LIB3066-053-Q1-K1-B4
taattgtactaatcaaattcttgttgggatatattcctccaattcccctcctcctcccaacgaggcaacaacaatctgttccggccgccaaacaaaaccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgtcgccgcggcgaccgtcgcgccccgcacccctcgccctgctgcgtccgcgtacgtctccttctccgcgaggaagccggcgggcggcagcctgcagctgcagcggcaggcgtgctgcgagccgtcggtggcgccgtcgcgggcggtgttcg

SEQ ID NO: 48386 - DNA, 80 bp, Zea mays
  Clone ID: LIB3066-053-Q1-K1-D10
aaaaaaaaaaaaacaaaaaaaaaaaaaaaaataaaaaaaaaaaaaaaaaaaaaaaaaggaagggaaaaaaattaaaaaaa

SEQ ID NO: 48387 - DNA, 408 bp, Zea mays
  Clone ID: LIB3066-053-Q1-K1-G7
gcgagatgaaaggcaaccgtggtcatgcatctctgttccatacttccattccacagattggttccatactgtgcattaccacttatacagattataaactactacatggtactagaatcaacaagaccagatagccccttgtaagccatactcatattctgataaagatccacattaaactgctagtatgaagcaatgaggtgagtaacttacccttgtcctatgcttcaatctcaaaggttctccatctggatattgctcttgagtggcacgtactccccaaggtaccctccaaggtgctcatacaacgcagtccggtcaatctgctggttgtggaaggccttgcaagcgtagtagaagacgctctgcacgagcagttccagcaaattgacacagactagaacgcac

SEQ ID NO: 48388 - DNA, 198 bp, Zea mays
  Clone ID: LIB3066-054-Q1-K1-A9
gttccaccattatcctgtttacaaaatactactgctccgtatatacggagaaactacatttaacgtaatcgaaaacaaacagctattaattagcaccatctccatacctgcataccaccttggcctaaacgacctgatcataacatttaattaattaattaagccaaagacctacaagccctaggatcgatgcctccc

SEQ ID NO: 48389 - DNA, 208 bp, Zea mays
  Clone ID: LIB3066-054-Q1-K1-B10
acggtttgtgtaatccgaccgggctgtgttgggctcattggtattgttctccccttttgtaatcggcggggtgctttgtgtaatcctacggcccattttgagccattgatctaatgaaatcaggtggtgtcaaaaaacaaaaaaaagataataaaaacaaaaaaaaaaacaagataatataataaaaaataaaagaaaaaaaagaaaa

SEQ ID NO: 48390 - DNA, 145 bp, Zea mays
  Clone ID: LIB3066-054-Q1-K1-D3
cggacgcgtgggaaaaaaaaaaaaaaaaaaaaaaaaaaaaaaaaaaaaaaaaaaaaaaaaagcgcggctcgatcagaaggggccggactaacatactcttgcatccaaaaatatatctacatctatagtgtaccctaaatcaaat

SEQ ID NO: 48391 - DNA, 121 bp, Zea mays
  Clone ID: LIB3066-054-Q1-K1-E6
tcgcccacgcgtccgcccacgcgtcctaaaaataaaataaaaaaaaaaaaaaaaaaaatggaaagtaaaaattaaaaaaaaataaaaaaaaatatttaaaaaataaaaaaaaaaaaaataa

SEQ ID NO: 48392 - DNA, 262 bp, Zea mays
  Clone ID: LIB3066-054-Q1-K1-F11
cgattcacgatccttgtatattgcgcattattgaatccttgggcataccataccggcagtgggaggcatcccaaattcaaaagggagtcatctggtaactgatgttacaacttttctgtatgggaatgctgtgaacaatgtggtgcagagtttcacacactaactaaccttacattatgctagacagagatcctacttcctttgcttcagttcctcgaatctatgcagatgcagacactcgcagagagagctcatcaactgg

SEQ ID NO: 48393 - DNA, 388 bp, Zea mays
  Clone ID: LIB3066-054-Q1-K1-H7
cccacgcgtccgctatgaccgaaaatgcataaatatgatgccctctggatatctccactcgatttcgttgattctgaatgttatgttgggtctccctatgtacttcaaaaaacatagttttgatgctaaagttgcctaggaatttggtacggtgaagtggcagtggacgtgaacaatgttaagttttgagcatttaaattaaacctttgccctgataacgttgcgagttatttaatttcttgctttgttcgcggcttgtcagtctgttaaactgtttattttatttggcatagcctgaaagagtgaaatcaacagttgtcgtaattgtaactggtttttcttcttgccatgtcatataatacagtatgtttcaataaaatctcttagg

SEQ ID NO: 48394 - DNA, 388 bp, Zea mays
  Clone ID: LIB3066-055-Q1-K1-B5
gaaggtacgctatagagaatggttacactattacgcaggtacatttgtgacaccctagcccccttagacaaaagaacagaagaagcacctccgagagaacgttcagggacgctaccaagacgcctcaacaataggcaggcaatcatgtatggtactacgacaccaagacgacatactccagctaaggtacttgactcggcgaaaccaactgaaacagcggcaccacggcgcctgtcgccctactattgcagctatcctacaacatgtctgatatacgcaaaagactcgggttttttctccccacccagcatccttcaattggtcatgctcaagctcaattagcttcagcgtccttctctcgacctgacctgatctatgccgatttctg

SEQ ID NO: 48395 - DNA, 395 bp, Zea mays
  Clone ID: LIB3066-055-Q1-K1-G11
cccacgcgtccgcccacgcgttcaggacgaccacgagtactactagctctcgggcagcatcggagctggatccgtctctgcacaggttgaggacatcacagacactcacaacagacatgtagtgaactcatatttgcatgagtgtacatgcctcgagtggcagcacaccggctaaccttgcccacatgcattggccttgattataacacacgatagcgtggatgtggaattggacgatcctgtgcatgaatactactcagtgcaaaggatcaaaagtgcatacaagagaatgactgaaccacttccagataggtctcaatggccattagtggacccgccctatgtggttggtgcaccacttgacaagataggtagcacaaggtacaacttgactg

SEQ ID NO: 48396 - DNA, 444 bp, Zea mays
  Clone ID: LIB3066-056-Q1-K1-C12
ccagcctggatcctctccaaatcagagagttcatggagattcagtcagtaaattacaatggtgatacctaccatttgataagtaaaaactgcaaccatttctgtgaggatatctgcaaaaggttgacaggaaattttattccaaaatgggtgaatcgacttgctagaatgggtgctgtttgcaactgcattctaccagagtccctcaagatcaacgcggccggtcatgacccagcttctcgagctgaagatagcgagagaaaaatgctgacaagttccttcagttgcttctgttcaatctctctatgccaaagacatttctcaacatcttcgccgtctctgcgttccttcgcgaacggcacttcttgggataccaagcaatccaattctacccgactgaagaagagcttacagttgaggtcctgtgtatcatatttaactcatg

SEQ ID NO: 48397 - DNA, 443 bp, Zea mays
  Clone ID: LIB3066-056-Q1-K1-D11
tacacgcgtgcggccacgcgtgcgtgcacgcgtccgctcacgcgttctgctacgcgtgcgtgcactcgtccgtgcacgcgtcctcgcacgcgtacgagcatacctgcagtcatttactccaccaggaccagcgagttcaacagcagacagatcgggactattatgacgagccgcaggatggcatcatcggccgcactgtcggtgctagccctagcgctagtggcggccaccgccccacacgtagcggcggcaacgacgacgagagcggcggagagcggcgaggcggcctatgccaagacgatccaggacgacttctgctcaacgctgtgcgacggcaagatggggaccgacctggtcgcgtgctaggagtcctgcgctctctgccagcagtccaacctggtgctgtacggcaggatccagtgcaagggcaagtgcaccgagca

SEQ ID NO: 48398 - DNA, 360 bp, Zea mays
  Clone ID: LIB3066-056-Q1-K1-E11
cgccgggccccagtaaccggggaaccaatactagcttccatgccggatgatacgtgctggtgttagatgtattattaacatgtcgagcagacaagactgattaacattatgtaatgtaatctcaaagtggtgtaaatggatggatcaaggtataggatcccctggagtgtccaaccggcaatccaaaccaattccttttttcgaattatcatgatgtaattcccaaatgtataaaattcagtttttagtttttccttaaaaaaaaaaaaaaaaaaaaaaaaaaaaaaataaaaaataaaaaataaaaaaaaagaaaaaaaaaataaaaaagcttaataaatatataaatataaaaaataa

SEQ ID NO: 48399 - DNA, 372 bp, Zea mays
  Clone ID: LIB3066-002-C3-F1A
gatataaactgtaatattagatctccggacccgggggccaacccgggaatcccggcccggaacccgaaggggaaccaactcccccaaaaaggaccccaaaaaaaccaaggggaaaccagggaaaaaccagtcccccggggaaaacggaaacccccccaaaaacccacaaaacaaacaacccggaagcaaaaagggaaaaacccgggggcccaaaagggggaccaaccccacaaaaaaccgggcgggcaaaaggcccgaatccaagggggaaaacccggggggacaggggcaaaaaaaaaccgcccaaccgcgggggaaaggcggatagcaaaatgggcccaaaggggggtccccccaccaccagggaaacgg

SEQ ID NO: 48400 - DNA, 482 bp, Zea mays
  Clone ID: LIB3066-005-A7-F1A
ggcgccaccaaaactgaaacctcattgtttattctttaacaaagcacaaaagaactaaaacttgcgaattcgttacaggacggcagcagataagttaaacacaaaaagacagcgtgtccaaaaccagcatggatccagcgtccaggggcaccgttcacatttattctcagcatagacaagcagcaaagatggtctgcgaccaaaggccattggggacgacccacgatagggaggcagaaatctatctctctactagcctactgggtcttgaacatgtggcggatcaggtcgacgacgcggttgctgtagccccactcgttgtcgtaccacgagacgagcttgatgaagtggtcgttcagggcaatcccggccttggcgtcgaagatgctcgacctgctgtcaccggtgaagtcggtggaaaccagatcctcctccacgtagcccatgatacccttgagtgggccctcagaagcggccttaat

SEQ ID NO: 48401 - DNA, 80 bp, Zea mays
  Clone ID: LIB3066-006-B8-F1A
tcgcgatctagaactaagcggacgcgtgggcggacgcgtgggcggacgcgtgggcggacgcgtgggctagttctaatcgc

SEQ ID NO: 48402 - DNA, 476 bp, Zea mays
  Clone ID: LIB3066-006-B8-R1A
ctggagcatcctctacgtgctgaacgtgatctacagcctcctgacgggcaggctggtgcgcgagaaggtcgacccggcggtgcagcgggtggtccgcagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggctgctccgtctgcctccaggatttccaggtcggggagaaggtgcggacctgccggactgctggcacgtgttccacgtgcagtgcatcgacggctggctcatcaagcacggctcctgcctgctctgcaggaggaagctgtaggcggatcgaccggacgacgccatgaacgatgttcttctctgcgatcgagccgattatgtgtgtgtgtgtgccccgccgcc

SEQ ID NO: 48403 - DNA, 484 bp, Zea mays
  Clone ID: LIB3066-010-E5-F1A
ggagaacaagaacgaacattcttctttccaccacgaaaattgtacacccattaaaggagcctctagcagggcacctcgccacagatatcacagcttccttggtcaccaacagactaccatgcccatctccagcaaagtgtggatataaacatgcaaaacattgtcttacactatagactgtactgtttatagagtaaaatttaaaatagggagtaagatagagaataggatagagaggctgctggagatagcctaagaacatcagttataccccatcaatggatcgacaacgacaactagttgcggctaatccacatggtgtgagcaggaccagccccatcaaggtgatcatgcgacaggagggcacgcctcgctgtccttcgaggtgtcgacctctgaaggcggcatgaactgccacattgggtaccctgggtagccgacgaagggcatcatcagcttctgccctgcagcttggccctgggca

SEQ ID NO: 48404 - DNA, 477 bp, Zea mays
  unsure at all n locations
  Clone ID: LIB3066-010-E5-R1A
gacccacgcgtccgcccacgcgtccgcacgaatatacccatcccattccccacaaggctccgtcccttcggcggcggcggcgatgtctctcccccctggcccggcggacagtggcaccggcaccggagacgactggttcctcgactgcagcatcctcgacgacctgcccgccgcggcctgcggagccttcccgtgggacgcgtccccgtcgtcttccaaccccagtgtggaagtgggcagctatgtaaacgccaatgatgcattcaaggagcccaatgatgtcttcaaggagcctggcagcagtaaacgtttacggtcaggatccagtgatatgccaacatctaaagcttgcaggganagaatgaggaggaacaagctgaatgacaggtttcttgaactggggtctgcattagaacctgggaagccagtgaaagctgacaaagctgccatcctaagcgatgctactcgcatggttat

SEQ ID NO: 48405 - DNA, 484 bp, Zea mays
  Clone ID: LIB3066-019-A5-F1A
aaccaaaaaaaaaacggggctgtacatctccggtagcaactcaatttacagaactttgatcccggcaggaagttaggagaaacaatcacagcgcctgaggcagtgccatggattttataaatcgaagtaggtcaactgaaaaaaaaacgacgcctaagatgtatatccagaccccggtggggatcccagaaggcgtcgcgccataggtacattagtcgaagcggatgcaggggaagcagacgcggagaaaccatacgcatagaccattggagcaaccactgtaggatggtcgaatttacagttggcgccgaacttgcagatgccgtaacgagaatagaatttgcacagttcttcaccccggggatgatggaacttgcacactgcaccgaatttacaatctcctgtcttcatgtaatattggcattctggttcatcaggtctctcaggaaatacattctctctctgcagcgcatattgaggcacg

SEQ ID NO: 48406 - DNA, 476 bp, Zea mays
  Clone ID: LIB3066-019-A5-R1A
cccacgcgtccgcctcttcatagagcgcgtcggggtcgggggaggacctgtcgatttggcatgagctgccgattcaatcatcctccggataggaatctggctattgcctctgccagaatgaagggagaatatcctgagagagcgggacagccagagtgtcagtattatctgaagactggaacatgcaagtttggccctacatgcaaatttcaccatcccagggaaaaggctggaattgcagggagggtgcagctaaacacatcaggatatccactccgcccgaatgaaaaggagtgtgcatattatttaaaaacaggacactgtaaatatgcaaatacttgtaaattccaccatccggaacttttcaatgtggtgccttcgtcacgtggttctcctatttatacctctgtacattcctctgcgagtgctggtccgcagtcctatactggaactatgccaagctgggcttttccacg

SEQ ID NO: 48407 - DNA, 163 bp, Zea mays
  Clone ID: LIB3066-025-D10-F1A
cttcaataaactatagtgtcaacactatagatgcgggtaatcatacccataacgatacataagagaaaaagggtccactcacaattcgacgcaacatacgagacaaaggcatagagtgtaaagccgaggatgcatgataaataaacgaactcacattaagtgc

SEQ ID NO: 48408 - DNA, 351 bp, Zea mays
  unsure at all n locations
  Clone ID: LIB3066-035-F7-F1A
cttctcttctttcctttttttctttcgcgaacggcaaaatttttttgatttgcatttatgtgcaggccaatcccaggtcatatccatttaaggcacattatcttaaaggacatttcaggatgtaggggggcggggcgaaatgcgggagtataatggaagcaatcatcgaggaaggatcagtgcagaaagttcagggacaagagggaaacgatggccagccacaagagcgcctttntagagttccgactccacgccgagcaggcatccttactagnttctggcgncggtgtgtagccggtgataacacttttaaatggacgaagcggtgggttcacacagtcggagggttgg

SEQ ID NO: 48409 - DNA, 486 bp, Zea mays
  Clone ID: LIB3066-043-D10-F1A
gcaacaacaacgtttatttgtaagtgtagataacattaacaggaattggacaacaaagcaacccgaggtttccatccaaactcatatgaacaccgaaaggtgtcctcattaacagcttggttcttgagtcgatggagaaccttgttgtgccactattgaccccaaagtcgatcaatcatattcaataatggtgtcactttccagatgaacaactccacaagtgcatggttctccgggttctcttctgaattgatcagaagggtgcaaaagctgaatgacccacatgttcagaaaagcctccaagcagaacaatgcaaatccaatgaagtagaagatcccgacaatgatgatgtcgcctatcaagctgattgctgggaaaatcccaattaatgttttccccacaaagagaattgaagaagaaacaactacatacacgcagaagacgatatgaacctgcctggcgctgagatccacctgccgtccgag

SEQ ID NO: 48410 - DNA, 476 bp, Zea mays
  Clone ID: LIB3066-043-D10-R1A
cccacgcgtccgcaccttccatcgacaaaatggaggtaccgcgcctcccccagggtgcccttccatccatggcgttgccgcggccgtccccgcaatcaactcccagatctcgtgctcacctccccgcaatcaaggtcgtcacgcccgatgaggatggccgcgagtcgccgcacggcggtccgggccccagcgatactccggcgcaggcgcgaggaagaagctccggctcaccaatgagcagtcgacgctgctcgaggacaccttccgcgcccacaacatactctccaacgcgcagaagcaggagctcggacggcaggtggatctcagcgccaggcaggttcatatcgtcttctgcgtgtatgtagttgtttcttcttcaattctctttgtggggaaaacattaattgggattttcccagcaatcagcttgataggcgacatcatcattgtcgggatcttctacttcattggatttg

SEQ ID NO: 48411 - DNA, 432 bp, Zea mays
  Clone ID: LIB3066-045-G6-F1A
tttttctgttttttttttttttctcctttttcctttttcctctttttttttcctctttcttttctcttttaatcgcaatcattattaaaaaagacggcacatcacgactttgatttgctcgtcaaggcattatcacaagagccaacatatcaccggccaccaggaacttcatactctatttggcactacaggaacgggccgaaaaaaaaaagggcaaccgtatccaaagggtcccacgctgggtgggacttaagctttgcgcacaaaacttccatcgaaaacagttgctgggttcaagacacggcggcttctcggtgtgctcttccgcggccaaaagcttacaccataaatttctgacggtacagaatttacgggctgcccctctcattgattcaaggattcacggccaacgggcacttttttatagggttt

SEQ ID NO: 48412 - DNA, 478 bp, Zea mays
  Clone ID: LIB3066-045-G6-R1A
cccacgcgtccgctgctgtttatgctcctgcaacaatgaatatgctccaaactcctccatttcatagcaacagccatgaaaaagagtcaggtgcagttttttcaaatagctttaacatggccccatcagtgacacctacctccccttttcaacttatgtctccaagctcaaccaactacacttccactcaaatcttcgaggaaaccaacaatttagaggacacttcaagagtctttggaggtggggataacgaaagcaacaacagtgaggaaccggatcccaagccggctgtggagatggaagacctaaaccaaggcaatgatcatacttcgaataaaacagctaactgtcaagattaccgtatggtcctgcgcaaggacttgacaaacagtgatgttggaaacattggaagaatcgtgctgccaaagaaagatgcagagcctaaccttccaatcttggaagataaggatggcctgat

SEQ ID NO: 48413 - DNA, 273 bp, Zea mays
  Clone ID: LIB3066-048-E2-F1A
tcgcgatctaaaactaatgggagcgcgtgggcaaacacgataggcgagcgcggtggacggacgagtgaactagttctaatcgcgaacaagcaccctttagtttttattttaaaacgaaagccctctctatgaattagggatgcgagagatgacagacgcatatgcatgggacccgcatgcgaacgtgtgagcagcaatcaggagtgagaagggggacagacacaggagcatcatcggagcgaacgcagagaagaacatcgatcagtaggtggt

SEQ ID NO: 48414 - DNA, 463 bp, Zea mays
  Clone ID: LIB3066-048-E2-R1A
gcagcgccgccatgatcgagacaggatgacgtccccgccgacgccgctgccggcgcttgccgccaggccatgcagtcgccgtcgccgccgacgaaggtgggaccaccgccgctgccaccgccgccgctgccggccgtggacgcggccgtcatcatgggcgtgctcacggccgtgctgctggcgctcttcctcttcctcatctacgccaagcactgcaagcagcgcggccccggcgagctgcccggcggcctgggcctcggcttcgcgccctcctcgtgcgaccgctgccgctcggggctcagcagctccgcggtgggcgcgcttccggcggtccggttcggcgacggtgacgtcgacgtgggccgcgccacgagtgcgccgtgtgcctgggcgccttcgacgccgccgagctgctccgcgtcctgcccgcctgtcagcaagcctttcacgccggagtgcatcg

SEQ ID NO: 48415 - DNA, 259 bp, Zea mays
  unsure at all n locations
  Clone ID: LIB3066-052-D12-F1A
ggcgaacttatctatttaaaacattctacatttgtagtttaataacaaatgttattgctgtacattttcaggaatctgagtactcccattcacaacaatgtgaacaattaatacatggatcgccantgtctatcacttttttatatacaatattgatctgaacgtntgtcaaattatataaccatcaggcttctccantctcgctcactgtctttgtcatctgttggcagataatgctgtcgtcttgcagatggggcac

SEQ ID NO: 48416 - DNA, 100 bp, Zea mays
  Clone ID: LIB3066-052-D12-R1A
cgcttcccccttccacccggcgatcggcctccggtcgctccaccgcggcgggcgattgctcatcttcccctaaccttccccggtcgcgatttccgaggcg

SEQ ID NO: 48417 - DNA, 521 bp, Zea mays
  unsure at all n locations
  Clone ID: LIB3066-037-D7-R1A
cccacgcgtccgccgttcctcgtcgtctcgtgttgtactcgcgtgccatgcccagctgtccgccggccgcgcaatggcaggcggcgtggtggtgaacgcggccgggggcaagacgtaccccggccgcatgacgccgttcgtgttcttcacctgcctggtggcgtcatcgggcggcctcatcttcgggtacgacatcggcatctccggcggtgtcacgtccatggcgtcgttcctcaaggagttcttcccttccgtgtacgccaaggcggcggcgaacaaggacacgaaccagtactgcaattcgacagccagctgctgacgctgttcacgtcgtcgctgtacctggcggcgctggcgacgtcgttcgtggcggcgtccgtgacgcgggtgttcgggcgcaagtggtccatgttctgcggcggggtgaccttcctggccgggtcggcgctaaacggcgncgccaccgacgtgatgatgctcatcatgggccgcatcctgctgggcgttggcctcggcttcgc

SEQ ID NO: 48418 - DNA, 154 bp, Zea mays
  Clone ID: LIB3066-037-G12-F1A
ctcaaaggaacaaaagtttactactttcaattaatattagaaaaatcggaatggaaagcaaattctaacgccaactaaacttaaaaacatgaaaatagatggcctcttccaagggccgtatcccacaacgggggcatcccagcacctccaagca

SEQ ID NO: 48419 - DNA, 399 bp, Zea mays
  unsure at all n locations
  Clone ID: LIB3066-037-G12-R1A
cccacgcgtccgcccacgcgtccgcggacggcntnggtgagagcttcgcgctcggcctggccatgaaccactgcatgttcgacggcatcggcgccatggagttcgtcaactcgtgggcggagacggcgcgcggcgtcgcgagctcaccgtgccgccgttcctggaccgaagcgtcctgaaggcgcgcgacccgcccgtgcccaccttcccccaccacgagttcgccgagatccccgacgtctccgacacggcggcgctctacggcgcgcaggagctgctgtaccgctccttctgcttcgacccggaccggctggagcgcgtgccgaccttgcgctcgccgacgggccctgggccgctgcaccaccttcgaagcgctgtcggggctggtgtggcacgcgc

SEQ ID NO: 48420 - DNA, 361 bp, Zea mays
  Clone ID: LIB3066-040-B5-F1A
gaatcaagcactctgatacattttttattttccttttcttccttttctttccgtagatactgctatccatgccatgcgttcgctctgtatcgttgtagttttgtgcagcatgtccgcgacgccgccgtggtatagtttactggtcgtcgtcgtcgtccgagtccagctgcttgagcagcgcggcgcagacggggagcggcacgtccttgaagtagcctagcgggttggcggggcgcaggctgtcggagatgccaacgttcctggtgagcaggacgccggcgcggtccctgagcgcctggacctcgtcgcagtccttgcgcgggctggccaccagcaccacgaggaggacatctgccaggtg

SEQ ID NO: 48421 - DNA, 361 bp, Zea mays
  Clone ID: LIB3066-040-B5-R1A
cacctggcagatgtcctcctcgtggtgctggtggccagcccgcgcaaggactgcgacgaggtccaggcgctcagggaccgcgccggcgtcctgctcaccaggaacgttggcatctccgacagcctgcgccccgccaacccgctaggctacttcaaggacgtgccgctccccgtctgcgccgcgctgctcaagcagctggactcggacgacgacgacgaccagtaaactataccacggcggcgtcgcggacatgctgcacaaaactacaacgatacagagcgaacgcatggcatggatagcagtatctacggaaagaaaaggaagaaaaggaaaataaaaaatgtatcagagtgcttgattc

SEQ ID NO: 48422 - DNA, 75 bp, Zea mays
  unsure at all n locations
  Clone ID: LIB3066-040-C4-F1A
cncngcagctcatggagatggtggaggacgcgcagatngttctgctggcgangggcaagcagaagttcgcgcgca

SEQ ID NO: 48423 - DNA, 274 bp, Zea mays
  unsure at all n locations
  Clone ID: LIB3066-040-C4-R1A
cgacctnatntctccctccttctcctttttttctttcttttttttttactccaccactacaggtccatttatttactcgcaatataaaattaccgatcggtacttaactacacacgcaagcaattagttcatgcgcttattaggctgtgccactggccaccactacactacattacactagcacaagcaagcagctacacatacttgtccatatcacataaacgaaacagcatatataagacgatgtcccaacatctttgcaccacgcgcgaga

SEQ ID NO: 48424 - DNA, 242 bp, Zea mays
  unsure at all n locations
  Clone ID: LIB3066-042-D12-F1A
tctnaatattctatatattattatgtaagtggccatcatcatacactgcatagtaaacanagcttaactcgtcgggacatataattaaggaagcgatagaaaaaaaaagaattcctatntcacnactagcagtactcactcatggcagtcatcactattagctcgatgaagctgagtggtcagttcgaataacactgtaatccccgtgaccgctctacgctgacggctggtcgancaaaacc

SEQ ID NO: 48425 - DNA, 506 bp, Zea mays
  unsure at all n locations
  Clone ID: LIB3066-042-D12-R1A
cgacggcnnggaccgtgggcggacggtggccagcgccgggacaggcgttgacaccgttcggcggcactggcgcgtacggcccgtcagggcaggcagcacggactacaacgacgccgtcgccccgcgcgccgccgggctgcacgtggtggctgccctcgctctcgccgtcgccgtcgccgcacctctccaccgctaagggcggtgccatggcaactgggagctggcgggcacgacactcgcagacgggatcccgcctcggcagcccgccagcgcgggctctggtcgatgtccggcgttagtgcgtgcgcgtacctgatgaagtgatgatgggttttgatcgaccagccgtcagcgtaatggcggtcaacgggtttacagtgttattcgaactgacctctctgcttcctcgtgctagtagtggtggctgccatgtgtgtgtgctgctggtagagaactagggattctttttttttctgtcgcttccttgcttataatgtccgtcgtgt

SEQ ID NO: 48426 - DNA, 133 bp, Zea mays
  Clone ID: LIB3066-042-H8-R1A
aaatccgccacgcgtccgcccacgcgtcagaccacgcgtccgaagggggtcaaagccggcgccatcgacctcatcaacaaatggcagcaagtggcgacgtccctcaccgatgacctcatgatccgaatcatga

SEQ ID NO: 48427 - DNA, 228 bp, Zea mays
  Clone ID: LIB3066-054-C3-R1A
agcacctcctcttcccccgacgggcaacaactcagccgccgcatccgccacatcaaccatgggcgcctgcgcaaccaagcccaagacacttgaggggcaggccccagctgaggccgccgtctccacacccaaggttacgcccgaggccactccaatctccgttgaggttgcggctaatgaacaggtagctgagaaggtagtagtggaggagccggctgcggcggacga

SEQ ID NO: 48428 - DNA, 573 bp, Zea mays
  Clone ID: LIB3066-054-D4-F1A
cgctccaataagaaataaaactcataataaaaaaaaacaatatacaagtttattagatacacataattaaactcacggataatctctcctcttctactgtactactacactttccactagctttggcccataaactccagtaggttgcaataccggatggagatacccaaagcgtttctcccttcgacttccacacaacacaacagaaccgcccaaaaagtgcaaacaggctgtgagtacctctcagtacaactatatgtacacctacagcaagataatcactgaactaacagacgtgctctctgcttggagcccttcttgctcgctggcctgacgatattcaggtagagagccgtaggctaccagttcagatgcctggctagcgacctggttcagtaagcgcggcagcagacagtttgctgaacctagtcctgtctcgttttggtgcgcaccgcgctggctcatgctttcttgaagaatgacataatgctcccttgcttgggttcagccttcgcgggtttctttgttgctgctgccgttttgcttggagccttgattttgtcggtgcttgtg

SEQ ID NO: 48429 - DNA, 544 bp, Zea mays
  Clone ID: LIB3066-054-D4-R1A
aatagattttgtggtgttttgaattcttttgtcaagcgaacatccaatgggaagcatgtgagttcattgccaccaaagcccttaaacagtgctgcagtggtcgaacagtctaaacctagtgttactccaaaggagcagtttgttactgctccgcagcaagatttgcttgtaagttcaaagcatggagtaggcaataagtctgagaaggataattccacattattagataaagctggcaatgctcatgttgtcaaagaacaatcaattgatgcccatgcaagcaaaagtagagctcaaaatggaaagaccatgcctaataatggtggatctctggctaacatgtggggccgtgcatcagttaaacctaagcctccaagtaccactaattctacagctgtagaaagtgttgcagctactcttgatgcacaaatatgtgcaaaggaagaagcagatggagatagcagcgatgatgaacaaggaataaagtacaagagggaatccaccaatgcaaataacagaaagcgaagagcagtatttgattttt

SEQ ID NO: 48430 - DNA, 426 bp, Zea mays
  Clone ID: LIB3066-055-D10-F1A
atactgtagtagtttctggtgacgaaaatagtctaacatgcatgttacatgtaatacagtatccataaaaatgggagcaacaattatttatacaacgaaattgagcaatgaaatgcagcttcgcagaattgttatgttgttgagtaatacatagtcaacaaaggattattattattactacatataatattgcaacacctacatctgccgccaaacataatttcctccagctatgcaacaggagaaaattaaagcgggaaggaagaaaccaaccccacatggagggatgggagcttcatgagagcgaactgaaactttccactggatccgattcctctagcatcaccgctgcctggaaacagtcggcagcgtcagagatcctcccatcagacctgtgcacttttcctagggaaagccaagccatcc

SEQ ID NO: 48431 - DNA, 535 bp, Zea mays
  unsure at all n locations
  Clone ID: LIB3066-055-D10-R1A
gaaagatgtggcgctgaatttcctgaggaagtccttaaacaagcttgagaatccaaatgacgtcctcgccttattgttagctgctaagatatgcagcaaggagcgccatcttgcctctgagggtgtcgaatacgcaagaagagtaatcgcctgtgccgaatcatcggatcctcatctgaagagcgtcggcctccatttcttggggagctgtctaggcaacaagtccaaggtcgtttcgtcggactaccaaagatctctgctgcagacggagactctcaagtcgcttgcagagtcgattggccttaaccgctacaacgccgacctcatattcgacatgggagttgagtacgccgagcaaaggaacatgaatgccgccctgagatgcgccaaggagttcatcgaggcaacgggcgggtcggtttcgaaaggatggaggctgctagcgttgattctttctgcgcagaggngttctcggaagcggaagtcgcgacggacgctgccttagatgagactgcgaacatggatcaaggatctt

SEQ ID NO: 48432 - DNA, 560 bp, Zea mays
  unsure at all n locations
  Clone ID: LIB3066-056-B3-R1A
ccacgcgtccgcggacggggnngnagatatgccgccacgcacgaggaaaatcgcgcgtaagtccactggaccgattggtgtacctcggcaccagctggctccgagacatgaggagagcagcagcggcagtaatgaccccattggagacctagaagcccaggtggagcaacttcgaatggagctacgtcatagaaactaggtgtgggtagaagatggtcagcgtataaatgagttaagagctgacatctgccatttgcaagacgagcttgttgaacgggatttggcaatcgattcggctatcaactcatgttccattgcttgggatcgagaagccaaagctcgagcccgtgtggaggagcttagcacggtcgtcgacaacttgcaagtgtactgcaatacattacatgaagaagttcatgaattgtattcatgactacacccagacgtacctgccgacccctgttgaatgggagccggaccttctggaacaacagacgaagcacttggtggggaattgcacattttcaagccccctcctttctatgaaccctggctgacga

SEQ ID NO: 48433 - DNA, 68 bp, Zea mays
  Clone ID: LIB3066-056-B9-R1A
cagacggctgcgagtacggcatcggagaagatgggctccaccggaagtaggtcatctaagtgcagtta

SEQ ID NO: 48434 - DNA, 491 bp, Zea mays
  Clone ID: LIB3066-056-F5-R1A
gtcctctgttatatggctatgtatctcatctttgtggagtttggaatttactggatgcacagggagttgcatgacataaaaccattatacaaatatctgcatgcaacccaccatatttacaacaaggagaataccttgtctccatttgctggacttgcatttcatccactggatggtattctgcaagcaataccacatgtgttcgcgctcttcctctttccaacgcacttcaggacacatattgcactcttgttcctagaggctgtgtggacaacaaacatccacgactgcattcatggcaagatatggccagtcatgggtgctggatatcacaccattcaccatacgacttaccgtcacaactatggccactacaccatctggatggactggatgtttggtacgctcaatgagccagaagatatcctcaagaaggcttgagtttctcggagctgtgggtatcctatggtgctgctgctggaactgctcga

SEQ ID NO: 48435 - DNA, 678 bp, Zea mays
  unsure at all n locations
  Clone ID: LIB3066-044-Q1-K1-G3-116a
gtgatctcttacctccaacgcaaggagcagcagcttctgggagctcaagttcggatcttgttggatgcgagacagataatggagagtgtttggatccaataatggctgttttggatggcgcactcgaactagaagctgataccttaaatgagttgcttcctgaagtccaagattctttttgggaacagttcattggtgagagcccagtgattggtgagacagatgagttaatctcaggatcagtggaaaatgaactgatattggagcaactagagttacaatcaaccctgagtaatgtgtggagcaagaatcaacaaatgaaccatcttactgaacagatgggacttctcacatcagatgctctcagaaaatgagattgccacaggccacaatctttcctcacgagatgggttaagattttgtggagccgcaacaacaaaaagaatatgaccaaaggaggtactatgtatgtatgtatcaaactgttgtaactctaattcttgtcaatgtataataaaataagagaaatattgccttaaaagatttttgcattgcaatatctttgtttgttactgacagaatgaaaaggagatgcttcaaagtgagagatattcttctgttcttgtgtatgtctttagagantcctnngttattttgttacattaagtgcaaaaattg

SEQ ID NO: 48436 - DNA, 617 bp, Zea mays
  Clone ID: LIB3066-048-Q1-K1-F2-119a
cggaatcggaaggctcgattacgatctctttaacgaggcgtttcccacggcgccgagtctgggatgctcctccacgctcctccgtgtcttcttcgctagaagaatcggtggcttctgcgtcggtgaatgagattctgataatacgcttcatagtgaatttgcggaaattagggttccgtcttcgtctccattaaaaggaaagcatttgagagaaagaatatgtttttattctttcagaatctctttttctgatgcttttcatctttacttatttacttctctatttttttctaaccaatcctatgtgggccgtatgggcctcagagctgaaaatgcagtaaaatccatgaaatttctcaacatggcttgaagcccatcttctaaaggaaaaaacgctttactcttttttccttcatctatgtaataagaagcagaaatttaggaataagtttgaaaccttaatcacacataagagtaagtgcaaaaacatgaacaatgttcttgccttccgtgtcaattttgtatatatatatatatatatatatatatatatatatgtgtgtcagtatataatctccttttatatgattataaactcatttgtcccaaaaaataat

SEQ ID NO: 48437 - DNA, 651 bp, Zea mays
  Clone ID: LIB3066-048-Q1-K1-F2-120a
aggataactttggcgacacatagctctcggaattcgattcagatcaagtaaggcggacaggcttatctgggagcatatgacagtgaagaagcagcagcacatacgtacgatctggctgctctcaagtactggggacccgacaccatcttgaattttccggcagagacgtacacaaaggaattggaagaaatgcattttgtgtctgtggaagaatctttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgtcatttctgcgattgagtatcgaggcgcaaacgcggttactaatttcgacattaggtaattacattgaccggttaaagaagaaaggtgttttcccgttccctgtgaaccaagctaaccatcaagagggtattcttgttgaagccaaacaagaagttgaaacgagagatgcgaaggaagagcctagagaagaagtgaaacaacagtacgtggaagaaccaccgcaagaagaaagaggagacggaagaagagaaagcagagc

SEQ ID NO: 48438 - DNA, 445 bp, Zea mays
  Clone ID: LIB3066-035-F7-F1B
ggtgcagggtaaactttttctgacctgtatttatgtgcaggttaatgacaggttatatctatttaaggaacattatgttacagcacattcgaggatgtaggggggagggggacatgcgggagtacaatggaagccatcatcgaggaaggatcagcgcagaaagctcagggacaagagggcaacgatggcagcccacaagaggccattccccgcgttggagctggacgccgaggaggtattgtcagccgcctctggcgccggcgcgtcggcggtgatcacagctttaactggaggcagcggcgggtccacaacgtcggagggttggagcaaaggtgccggtgctcccgccggagccagcgtcccgggggctgccaggttcaccagagcgccaggttgtgcaggcaggatcgagtagctcaggttcaggttcatgtcactgcatgga

SEQ ID NO: 48439 - DNA, 610 bp, Zea mays
  Clone ID: LIB3066-035-F7-R1B
cccacgcgtccgtctctttcctctcaaagaaagaaagaaagaaagaaagaaagaaagaaggaaggaaagaaagtagcagatcgcttgttgctgcgtttttcaggagctcacgacattaatgcgctgtaatgtagggtgctcctcctggccaaatgggagcaagttatcctcgcatgtttctggtcctcctgctgcttcatggagccagtgctgctttgaatcctccaacagcagggccaaaatggcagactctgagcggtcgtccccctcaagtcatagctcgaggaggattctctgcgaccgcataggcttctgtaagacagggctgacccttgataactcgacgactgtcgctgagatcttccccaagatggacaggacgtacaagctgtagggagaggatgtccatggctggttctccctagatttcaccgcggagcagctggttcagaacgtcactttgatccagaacatcttttctcgcccgagcacattcgatgcctcctttgggatgtacacgctcgatgatgtcgttgaactccacccccctcaaatatggctgaatgtagagtacaattcattctttctggagcacaagttaagcagcgag

SEQ ID NO: 48440 - DNA, 443 bp, Zea mays
  Clone ID: LIB3066-048-E2-F1B
aatattaaacttcaggtggcccaatctctagccaagatcaaattacagtttacaagcatcttccagtcttcaccctaccatgctctctctctcatcgtcctagcgacgtgtgtccccaactatgtacatgcacgggaccgataggtgaacgagcgtgactacctaggattcagaagctccatcgatctcggagcagcagacgagcgcatccagctacctagcaggacccgtcggcggtgaccaccaggacgccgaggtcgtcgctccgatgcctggcggcctcgaggtacgcaggccgggccaacaaagcttccgtggaataacggttgttccaagggcgggtcacaaacactttgaacttcgggttcgtcggcgagcggcgggcgtgctgccgcgtcgccgccgagtcctccggctcggagtcgtccacgtggcccccggtg

SEQ ID NO: 48441 - DNA, 587 bp, Zea mays
  Clone ID: LIB3066-048-E2-R1B
gcagcgcggccatgatcgagacaggatgacgtccccgccgacgccgctgccggcgcttgccgccaggccatgcagtcgccgtcgccgccgacgaaggtgggaccaccgccgctgccaccgccgccgctgccggccgtggacgcggccgtcatcatgggcgtgctcacggccgtgctgctggcgctcttcctcttcctcatctacgccaagcactgcaagcagcgcggccccggcgagcagcccggcggcctgggcctcggcttcgcgccctcctcgtgcgaccgctgccgctcggggctcagcagctccgcggtgggcgcgcttccggcggtccggttcggcgacggtgacgtcgacgtgggccgcgccaccgagtgcgcggtgtgcctgggagccttcgacgccgccgagctgctccgcgtcctgcccgcctgtcgccacgccttccacgccgagtgcatcgacacctggctgctggcgcactccacgtgccccgtctgccgccgccgcgtcaccgggggccacgtggacgactccgagccggaggactcggcggcgacgcggcagcacgggccggcgctcggcgg

SEQ ID NO: 48442 - DNA, 486 bp, Zea mays
  Clone ID: LIB3066-021-Q1-K1-A4-F2A
ggtgttaccacaatattacaatgtataaatttgaagctatcaagacattcagaaatgccttcttcgctgtgtaatctgaggttgtgcttaatgactgaatgaataagaatgacgacaacaaaaaatgcctaaacttaaacaaagagagcatgtatcttatatcgttgaccacatcacatctccgcaaatgagccgaaccacatcaatttctgggagaatgcaacaggcacaagcttttgttatgttcagttccacaagccattaaaacggcacatgttgcccccttggtaagcttcacagggtagaatcgagcttctagtaacgccgtaagggctctactgcatgttcctgaggttgctcttgacaccctcaatttgctggaaatcatccccatctagggacataaatggagcaaaattgctgtgagcttgaacaaatggaaggtcactgtgatggttctgaatgccatcaggcagattctgtgat

SEQ ID NO: 48443 - DNA, 499 bp, Zea mays
  Clone ID: LIB3066-021-Q1-K1-A4-R2A
cccacgcgtccgcccacgcgtccgggaggagctgaaagctactgtacaaggtgtcctcaattgttgctcacactatttttgcttcgcatgcatcatggaatggtctagggttgagtcgagatgcccattgtgcaagcagcggttcactacaatcaccaagtcatcgaaggtagatcttggtcttggagtgagaagagctgtaatcaaggtcgaagagcgtgatcaggtttatcagcccactgaagaagaaataaggcgttggctagacccatatgaaaatgttgtttgtatagagtgcaatcaaggtggcgatgataatctcatgctactatgtgacatttgtgattcctcagcacatacttattgtgttggcttgggtagagaagtgcccgaaggaaactggtactgtggaggatgtagactcggtgacgagggaccatcatatactggaattcagcgtacagtagcttatgaaagacaaaattacagaagtcatgtc

SEQ ID NO: 48444 - DNA, 726 bp, Zea mays
  Clone ID: LIB3066-010-E5-F3A
aaagctgacaaagctgccatcctaagcgatgctactcgcatggttattcagctccgttcagaatcacagcaacttaaggagactaatggcagcctcgaagaaaagattaaagaactaaaggccgagaaggacgagcttcgcgacgagaagcagaaactgaaactggagaaggagagtctagagcaccagatgaagctgatggcatcggctccagcctacatgccccatccgaccctgatgccggcgcctttcgcccaggcgcccctaactccattccatgcccagggccaagctgcagggcagaagctgatgatgcccttcgtcggctacccagggtacccaatgtggcagttcatgccgccttcagaggtcgacacctcgaaggacagcgaggcgtgccctcctgtcgcatgatcaccttgatggggctggtcctgctcacaccatgtggattagccgcaactagttgtcgttgtcgatccattgatggggtataactgatgttcttaggctatctccagcagcctctctatcctattctctatcttactccctattttaaattttactctataaacagtacagtctatagtgtaagacaatgttttgcatgtttatatccacactttgctggagatgggcatggtagtctgttggtgaccaagggagctgtgatatctgtggcgaggtgccctgctagaggctcctttaatgggtgacaatttc

SEQ ID NO: 48445 - DNA, 659 bp, Zea mays
  Clone ID: LIB3066-010-E5-R3A
tcagcttctgccctgcagcttggccctgggcatggaatggagttaggggcgcctgggcgaaaggcgccggcattagggtcggatggggcatgtaggctggagccgatgccatcagcttcatctggtgctctagactctccttctccagtttcagtttctgcttctcgtcgcgaagctcgtccttctcggcctttagttctttaatcttttcttcgaggctgccattagtctccttcagttgctgtgattctgaacggagctgaataaccatgcgagtagcatcgcttaggatggcagctttgtcagctttcactggcttcccaggttctaatgcagaccccagttcaagaaacctgtcattcagcttgttcctcctcattctttccctgcaagctttagatgttggcatatcactggatcctgaccgtaaacgtttactgctgccaggctccttgaagacatcattgggctccttgaatgcatcattggcgtttacatagctgcccacttccacactggggttggaagacgacggggacgcgtcccacgggaaggctccgcaggccgcggcgggcaggtcgtcgaggatgccgcagtcgaggaaccagtcgtctccggtgcccgtgccactgtccgccgggccaggggggagagacatc

SEQ ID NO: 48446 - DNA, 745 bp, Zea mays
  Clone ID: LIB3066-019-A5-F3A
ggattctggttcatcaggtctctcaggaaatacattctctctctgcagcgcatattgaggcacgggaaacgaactgggtctgtatggtgacagcattccctgatttcctgtactagcttctccttgttgtgaacttccataagtttgttgagccccaggtgactgcagctgaccagtatatgaattccagctctgcatttgaacaaggccctgaggtacaatcatcggcgcataatttgaaggactttgccacctagggcttggtataaaagaagctcgtggaaaagcccagcttggcatagttccagtataggactgcggaccagcactcgcagaggaatgtacagaggtataaataggagaaccacgtgacgaaggcaccacattgaaaagttccggatggtggaatttacaagtatttgcatatttacagtgtcctgtttttaaataatatgcacactccttttcattcgggcggagtggatatcctgatgtgtttagctgcaccctccctgcaattccagccttttccctgggatggtgaaatttgcatgtagggccaaacttgcatgttccagtcttcagataatactgacactctggctgtcccgctctctcaggatattctcccttcattctggcagaggcaatagccagattcctatccggaggatgattgaatcggcagctcatgccaaatcgacaggtcctcccccgaccccgacgcgctctatgaagaggcgga

SEQ ID NO: 48447 - DNA, 723 bp, Zea mays
  Clone ID: LIB3066-019-A5-R3A
actggaactatgccaagctgggcttttccacgagcttcttttataccaagccctaggtggcaaagtccttcaaattatgcgccgatgattgtacctcagggccttgttcaaatgcagagctggaattcatatactggtcagctgcagtcacctggggctcaacaaacttatggaagttcacaacaaggagaagctagtacaggaaatcagggaatgctgtcaccatacagacccagttcgtttcccgtgcctcaatatgcgctgcagagagagaatgtatttcctgagagacctgatgaaccagaatgccaatattacatgaagacaggagattgtaaattcggtgcagtgtgcaagttccatcatccccggggtgaagaactgtgcaaattctattctcgttacggcatctgcaagttcggcgccaactgtaaattcgaccatcctacagtggttgctccaatggtctatgcgtatggtttctccgcgtctgcttcccctgcatccgcttcgactaatgtacctatggcgcgacgccttctgggatccccaccggggtctggatatacatcttaggcgtcgtttttttttcagttgacctacttcgatttataaaatccatggcactgcctcaggcgctgtgattgtttctcctaacttcctgccgggatcaaagttctgtaaattgagttgctaccggagatgtacagccccgtttttttt

SEQ ID NO: 48448 - DNA, 710 bp, Zea mays
  Clone ID: LIB3066-045-G6-F3A
aagaaagatgcagagcctaaccttccaatcttggaagataaggatggcctgatactggaaatggacgattttgaactcccggttgtatggaatttcaagtacaggtactggcctaataacaagagtaggatgtatatattggaaagtactggtgaatttgttaagaggcatgggcttcaagctaaggacatcctcatcatttacaggaacaagaaatctggcagatatgttgcccgtgcggtgaaggctgaggacatagcgccgccagaatgcgagtgcgtcgaggcaggaaaccctagagaagagtgcggcttatccgtcagtccttcgatcaatacgaagatcatcacgtagatggctggagcatcagaaatgtatggtgtaagctgtttgccgcgcaggagcacaccgagaatctgcggatgctgggagccaagcaactgtttcgatcgatggttgtgattcaaagctgaattcccacccgacgtgcgtaggtctgtactatacggggtccctggcttttgtctgccgtgtcgagtttttcgagataaatgatgagtgcgtgtttgaaccttgatatattactgacactgataatgtgccgacatataaggaaaggttgccttattccggcttttgaaatagccttactccttatccgaggatgattgaatcggtagctaatgccaaattgacaggtccttccccga

SEQ ID NO: 48449 - DNA, 542 bp, Zea mays
  Clone ID: LIB3066-048-E2-F3A
ctccgcgtgctgcccgcctgtcgccacgcatgccacgccgagtgcatcgacacctggctgctggcgcactccacgtgccccgtctgccgccgccgcgtcaccgggggccacgtggacgactccgagccggaggactcggcggcgacgcggcagcacggccggcgctcggcggacgacgcggaggtgcaagtggttgtgcaccgcgcgtgggaccagcggtagtccaccgaaggcttggtgggccgggccgcgtacctcgaggccgccaggcatcggagcgacgacctcggcgtcctggtggtcaccgccgacgggtcctgctaggtagctggatgcgctcgtctgctgctccgagatcgatggagcttctgaatcctaggtagctcacgctcgttcacctatcggtcccgtgcatgtacatagttggggacacacgtcgctaggacgatgagagagagagcatggtagggtgaagactggaagatgcttgtaaactgtaatttgatcttggctagagattgggccacctgaagtttaatatt

SEQ ID NO: 48450 - DNA, 641 bp, Zea mays
  Clone ID: LIB3066-048-E2-R3A
aagcctttggcggactaccggtggtcccacgcgcggtgcacaaccacttgcacctgcgccctgtacggcgagcgccggtcgtgctgccgcgtggccgccgagtcctacgactaggagtcgtgcacgcggacccctgtgacacagcggaggccgacggagcacgtggagtgcgccagcagccaagcgtggatgcactctgagtggaatgcgtggcgacaggcggacatgacgcgaagcacctcggcggcgttgaaagcgcccaggcacaccgtagcactcagaggcgcggaccacgttgacgtcaccagagccgaaccggaccgtcggaagcgcgcccaccgtggagctgctgagcccacaccggcagcggtcgtacgaggagggcgcgaagccgaggcccaggccgtcgggccgctcgccggggccgcgctgcttgcagtgcttggcgtagatgaggaagaggaagagcgccagcagcacggccgtgagcacgcccatgatgactgccgcgtccactgccggcagcggcggcggtggcagcggcggtggtcccaccttcgtcggcggcgacggcgactgcatggcctggcgcgcaagcgctcgcagcggcgtcggcggggacgtcatcctgtctcgatcat

SEQ ID NO: 48451 - DNA, 731 bp, Zea mays
  unsure at all n locations
  Clone ID: LIB3066-052-D12-F3A
gtgcgaagttactatgatatgagcataaatcatcaccatcagtctgttcataacccacccccgaatttaggtgttgattctggttttgtcttcgcatcaaatatgtacaatccctgcatgtcatcaacatcaatgaacagacatgtttctcatgctcagagctttggatcagggaatcaagtgttgcctcaaaaccaagtcccaggaactatggatgagagtagcagaaatgacagtattggtgaaagtgctagagagcatattaaaaggaaaaatgctgcagttgctggaagctatcattttgttaatggatttgcaagctcaagctcatcttctcatgcacctcaaaatcctatgcttgggccttgggacccttcttttgaatcaactgtttcttctaatgttgcaccattcaacccatcagaatatcatggacacaacaacagttggccgtccttagaaggatcttccataacaggaagtaatggattcaactcaatggttgttcatccagactcagtacagcgtgggaactatacatttccacccactcatattagccattcatggatgtcccatgctacaaatggtattgctgatggagttccccagtgggaatatgccaatgcaactgctaatattcaaggcagatttgcccattcaggagccacagaaatcgcanatgttggttntcatgaatatcagaatggcccttcaactatttgtcgggg

SEQ ID NO: 48452 - DNA, 737 bp, Zea mays
  unsure at all n locations
  Clone ID: LIB3066-052-D12-R3A
tatctacaatgtgactttttgtcagaccagtattgacatctccaatctgctcttctaatgctaaaagctcctcatacgtcatgctgtctatatctagacgcatatctctatgctcatctacagtatttgacacttcatacaatctcgaaaaatccattattgtagcatgctcgggtggtagaatccttatgttgcggtggttaactggatttgccaggaacggatgctgtggaggcccaaaagcacgttcagaactggtgaagagaactggatttcgtggacctaattggagacggtttccagggtaattaataccaccatgcaagaaaccattactgtggcattgttgataaggaacttgcatttgagtaggatcaagagcttgcatgccatgcatcgcatgctggtggaaataaggtactggtccccgacaaatagttgaagggccattctgatattcatgaaaaccaacatttgcgatttctgtggctcctgaatgggcaaatctgccttgaatattagcagttgcattggcatattcccactggggaactccatcagcaataccatttgtagcatgggacatccatgaatggctaatatgagtgggtggaaatgtatagttcccacgctgtactgagtctggatgaacaaccattgagttgaatccattacttcctgttatggaagatccttctaaggacggncaactgttgttgtgtccatgatattctgat

SEQ ID NO: 48453 - DNA, 540 bp, Zea mays
  Clone ID: LIB3066-028-Q1-K1-E9.F2
ggataatgaaggtggaccagatcaatatatttctccccaaaaaacttaaataaaagtgtagtttaatctatgtaatcatgcatatcaacctaacgcaacaaggcgtgagacgggacatgtagcataacttttttcttggctcgtgtggtgcctcaatatatccaaagaaaaaaaataaatattagctcgctggcacatgggccggatgagctctcttgaaaattattcgtcataagaggctaatcagatgctgagggtggtcttgtaggtggtgccggccttgaaattggcggggatgacgtcgtcggcgatgcggtagccaccggacttgacagcgaagcagatgcagagggggtacttgagcggggtcttggtgtcaagcgtccaagtgccagtcggaccctccttgagcgtaaaggagaagtcgtcgccaccgtgctccttgatctccacgtcagagatggtggcaacgttgggggtgaggaccaagtggccgggcttggagcccttgccgacctgaaggtgagcggggtggtgcac

SEQ ID NO: 48454 - DNA, 543 bp, Zea mays
  Clone ID: LIB3066-028-Q1-K1-E9.R2
gtgcaccaccccgctcaccttccaggtcggcaagggctccaagcccggccacttggtcctcacccccaacgttgccaccatctctgacgtggagatcaaggagcacggtggcgacgacttctcctttacgctcaaggagggtccgactggcacttggacgcttgacaccaagaccccgctcaagtaccccctctgcatctgcttcgctgtcaagtccggtggctaccgcatcgccgacgacgtcatccccgccaatttcaaggccggcaccacctacaagaccaccctcagcatctgattagcctcttatgacgaataatatttcaagagagctcatccggcccatgtgccagcgagctaatatttaattttttttctttggatatattgaggcaccacacgagccaagaaaaaagttatgctacatgtcccgtctcacgccttgttgcgttaggttgatatgcatgattacatagattaaactacacttttatttaagattttttggggagaaaatattgatctggtccaccttcattatcc

SEQ ID NO: 48455 - DNA, 144 bp, Zea mays
  Clone ID: LIB3066-044-Q1-K1-G3-F116A
cagtactacacacctcagtgtcctacttagaacacgcgtagaggagtattaacggagaaccgacgggacccgaacatgtttattcatcaggttcggaaccctcgcctacgccggcaccaccagacgaaccacgaacctgcagga

SEQ ID NO: 48456 - DNA, 715 bp, Zea mays
  unsure at all n locations
  Clone ID: LIB3066-048-Q1-K1-B3.R2
ggcttgctccaggctggnnagctgatggnatnnctagggtnnttgggttnngcggtgatnnggtccnntgcagcgcaggnaggggagctcatggcnnnggaagctccgnngcgagccnnctggcggcgnnngcggcgggnagcccacgnagnaagcgggnnagccctcagggtgaatggcggnagnggcggtnnggcagnncgtcatggggagcgagggagcgaggttcctttgcccnnatcgccannacatcagtcgcattcaattgaagaagnngccatcccggcttttaacgggaagaaatcgccaaggnacgctttaaggagaaccgtgnncaggagnntgcgtctccgagttcattctccttcatcacttagcgaagcgagtgacaagtgccagagggagaagcggaagaccatcaatggcgacgatctgctgtgggccatggccacgctggggtttgaagactacattgaacccctcaaggtgtacctacagaagtacagagaggtgcgtacggtgtttgggaatttgggggtcaggtcgtgcaatcgccaatctgtcaccttgtcgatcgtacctctgattgaacttaaataatcctgttgggcatcagcacgctaataagtgataagtgagctatccacttcccttccaatgcttcggccacatatttatacttctttagttgaggacataaagagaccccctgttc

SEQ ID NO: 48457 - DNA, 667 bp, Zea mays
  Clone ID: LIB3066-048-Q1-K1-F2-F119A
acagtaccgacaatctgtttccccaccagccacgcatggatgggtccgaaatccgaatcgacgtctccggttttataatggtcccatggtacagcagcagcatcagcaatgaagaatgaaagacgacgggaggtagcaagccgaggccgaagccgacgactaccgaattactgcgcggctctgggcgacctcttggagcacttggcctgcacggcgagcgtggcggtggtgccagggcagttgacgtcgccgccgtagacgtcggcggacacgggcagcgtgcagatgcgcttgccgaggcaggccttctccaccagctccttggcgcgcggcgtgtggcagctgccgatggtgtagttgccgcagatgcccatggggttgccgtagctcgcgaacaccacctgctggatgagcttcttgggagagcacgtcagcgtggcccggggcttgaggtcggcggcggtcaccgtgatctggctgtccttgcgctcccacgacttgatgtgcgccgggttcctctccgagatgaaagtgcagatgttgtcgcgcttcaccgtcaggatcatgatcgcatccggccgcccgaactcctcctcgaacagcaccagcacgttgtccttctgccgcaagaaggaccgtggaatatggtacagctgctgcgatggcc

SEQ ID NO: 48458 - DNA, 548 bp, Zea mays
  Clone ID: LIB3066-048-Q1-K1-F2-F120A
aagaggccctgctctgggggaagacatcgacggagaagctgggcaagcagttttaggcgagggtgttcgagatcccggagcagaaggtgtgcgtggcgttcctctccaaccacaacaccaaggacgacgtgacgctgacgttccggggccagtcctacttcgtgccgcgccactccatcagcatcctcgccgactgcaagaccgtcgtcttcggcacccagcacgtgaacgcgcagcacaaccagaggacgttccacttcgcggaccagacgacgcagaacaacgtgtggcagatgttcgacgaggagaaggtgcccaagtacaagcagtccaagatcaggctgcgcaaggccggcgatctctacaacctcaccaaggacaagaccgactacgtttggtacacctccagcttcaagttggaggcggacgacatgccgatccgccgcgacatcaagacggtgctcgaggtcaacagccacgggcacgccagcgtggcgtttgtgaacaccaaattcttaggatgtgggcacgggaccaagatgaacaag

SEQ ID NO: 48459 - DNA, 447 bp, Zea mays
  Clone ID: LIB3066-024-Q1-K1-F6-F2B
aaaacaagttaggattttggtacagatgtattacttcagatttcagttcttcctatatcagaggggggggggaacacggactccattacaacctacagtaaccttaaacattatgtcattatgtagaaccataaacacttcggaaatccagcagtttatagcacgccattcatagaacaaaagatggataaggcagactaaaagatgggaggtttcaagagcaaaaaggatacatggatgcacatcttaggacctcaagattcaagacattaaccagggtgaatggtaagcttaaatgaaggccaaaaacccattggtgaagatattccacgggttagaatgtattcctttaagaaacacgagggttagaacttacaaccaacagaagagatgcccacatctcccccattgtcttctctggtgcatcggtactattgtccaactctg

SEQ ID NO: 48460 - DNA, 563 bp, Zea mays
  Clone ID: LIB3066-024-Q1-K1-F6-R2B
cccacgcgtccgccaaaattattgcatgagctatggtcattgttggagttcatgatgcctgatatatttgctactggggatgttgatctgaagaagctgctgaatgcagaagatcgcgaactaatttcacagataaagtccattttagggccatttattcttagacgtttgaagtcagatgtaatgcagcagcttgttcctaaaatccaacatgttaagtttgttgtcatgggcacagagcagtctgaagcttacaaaaatgccataaatgagtaccgtgctgcttgccaggctcgtagtgccaagtcttcagatggcatttccaataatgttgctggattgattccaaagcgaccaatatcaaactattttacacagtttccgtaagattgcgaatcaccctttgcttataaggtgtatttatggtgacaaagatgttgatcgaatttgacggttgctgtaccctaaaggtgcatttggcttccaatgctccttggagagagcaatacaagagctaaagaactacagtgatttcaatatccaccaactattattggcatatg

SEQ ID NO: 48461 - DNA, 614 bp, Zea mays
  unsure at all n locations
  Clone ID: LIB3067-025-Q1-K1-B4.R3
ttgttgtnacggtggtngatgaaaactgagnaccgtttgtatctctcccagcattggccatggacagaaggcctggtccagtgtgcttgatcttgaagttctcatcagcaaacttcatgccatagatagattcaccacccctcccatccccaagagtgaagtcacctccttggagcatgaagctgggaatgattctgtggaatgtacttcccttgtagtggagagctttgccactcttgccaattcctttctctcctgtgcaaagagcncggaagttctctgctgtcttaggaacagtcttcccaaaaagccccatgacaatccgacctgcgggcttgccgtcaatctcgacatcgaagtagaccttgtgggtaacctccgttaggtccttcttagcctgggcgagcgtcagtgctgctgcggcgagcgcgagccacaggtacaccgtggcggggctccaggaggcccgcgccgccgctctcctcctccacccgcttgtctccatctccgatccgcacgctcttcgccgccgccgatgaggttgagagaattctgctagatccgatcgttctgctgcacttctgcggttccggacgcgtgggcggacgcgtggg

SEQ ID NO: 48462 - DNA, 307 bp, Zea mays
  Clone ID: LIB3067-025-Q1-K1-B5.F4
gtataccaacatgtatcctgtaaaaacgacagatttcaaaagctatcggctgtgacaccagtttcaggtgtttgggtgatccaagaaggcatcatcacacagtaactccaacctgtttgagggttgtgtggccatatggtgttccttccctcccatctcttcgggggagggctccagtccatgccgagaggcagcggcgaggtaccgtcgtggcggtgcttcggagggctcggcgccttcctgcgcgatcccgccgccgccgacgttgccatcgccgccggtccgacgtcacccgcggggcacggtg

SEQ ID NO: 48463 - DNA, 328 bp, Zea mays
  unsure at all n locations
  Clone ID: LIB3067-025-Q1-K1-B5.R3
gttgctgnaggctcaacttctagcacgagnagatgaacaaggctcttctgatggtggcgacgattctgatagtagatcctcattaactatgagcagtgaagatgcaaaagttaccgatgaagatactactaaaatgctttctgatctgctcattgacaatgcgcagctgagactacgcctcaatgctgtcatccgcaatgctgtaaatacttccgtgaagccagagaaagaaggtagtggcgaggttctccccaaaaagacagtccttaactggttgttggacagatgagagaaccaccaatatatatttatgtggattanttattna

SEQ ID NO: 48464 - DNA, 475 bp, Zea mays
  unsure at all n locations
  Clone ID: LIB3067-025-Q1-K1-D5.F3
tcggtatgnagtcattctggnaggagcttgatggtgtcaagcaggtatggaagaacaggaggacctcaggttgaggaccttgggattgcgactttatttggagttgagctttatgcatggttctgcgtaggcgagattgttggcagaggtttcaccttaaccggctataaggtctagttgatttccagtgatttaagacctgctttataaatcgacactttagctgatgcttgtcgaaacgacgatgatacctgccttccttcacaattttgtttcttgtaagagtctacctagtgctgaatgccagcaaagacgggcacatggttgcaacattgcctcaataatttgcccgcgcaattcttgattttgatgcatgtaattctttgtcagttgcatgtgctgcagtccctgcgtgcagactcatttcgtgtctttcgttctgcccacaaaataaattctttctgcgttacatatg

SEQ ID NO: 48465 - DNA, 255 bp, Zea mays
  unsure at all n locations
  Clone ID: LIB3067-025-Q1-K1-D5.R4
tactgcttgttcttctccagnagctccttgtagtaggagccgccgtgcttcgaggcgaactccgccgcctgcaccgcctgagcgcgcagctgtgccagcctcgccgccatcgccgccgatcctaaacccttggtggatcgaaggggagaggtgccgccacgaggtgcgaggagatcgataaggacgaaaacggcgggcgagatggggcggacgcgtgggcggacgcgtgggcggacgcgtgggcggacgcgtggg

SEQ ID NO: 48466 - DNA, 311 bp, Zea mays
  Clone ID: LIB3067-028-Q1-K1-B10.F3
gccctggggcgtgcagggcacccgccgcctccaggtccgccagcccctgggtcagcgtgcagcacggcgtcctgggcggcggcgaggtggtggggtacagcgtcgtcgcctctgctggggttggggtcggcgcggaaggcgacgaagaagtgtggcacggccgcgcgtcggcagcgaggagggacgcagcgacaacggcgaggaccaggagggggaggcgggcggccatggcggcggcgaggagccggatctgtgcctggggaaagggcttcctcggagaaaaaataaatggaacttggcggacgcgtggg

SEQ ID NO: 48467 - DNA, 217 bp, Zea mays
  unsure at all n locations
  Clone ID: LIB3067-028-Q1-K1-B10.R3
tatgtcctgcttttcgtcgtctatcgcatgatgctgttgttgttgttgtttttcgatgatcctgtctctgttataaatatcattnttattacaaaaaaaaaaaaaaaaacaaaaaaaaaaaanaaaaaaacaaaaaaaaaaaaaaaaaaaaaaaaaaaaaagggtcttcctttctttnnagcccctncctttccttcccccttcttccttttttttt

SEQ ID NO: 48468 - DNA, 393 bp, Zea mays
  Clone ID: LIB3067-028-Q1-K1-B4.F4
cccaacgcgccaagcagttcttatcgtcatttgcagcagcagcgtaatcgaccgcgggtggaacctctcattctgcggaccgaacaccacgtgtggtgccaccttgggagacagcgcattgtacacgaaatcccagtggacgtagtcgaggcagaaggggatggcgagcctgaaccgatcggcagggcgaccgttgcggcagccggaccagatctgtaccaccctaatgggcagcttggagtgcgagaggaggtagttgagctgcgcggcgatgaggggcgcgagcgggggcgccgaggcggaggaggccggcccgggggcgtcggcggacggaaacatcgttggcgatgaattccggacgcctctctctctcttctcgactcactagcaaac

SEQ ID NO: 48469 - DNA, 484 bp, Zea mays
  unsure at all n locations
  Clone ID: LIB3067-028-Q1-K1-B4.R3
acgtcgcctccgtaaagactatccctgngtcctanagggaccggcagagaggttgaacggatctacgacttcctgaccgacgagtgccaaaatttcaagaagttctgcagcgatgctatcactcagcagaagtagctgacatcgttctgcagcagaaagccgtggtgctgattttctcagcaacaggctttcttattcccagcaagcggcacacgtgtctacttgtgcgcccgccccaagcctgcaaccgttgatgctgttctctttcttggcatgtgagaggacgcaacctcaggcgttggttaggatcggcataaaccaagcaggacaacacaagacctgttggttgtttacgatgtcgtacccctgtataagctgccgacatggggactgtttgggatatggtatagatggatacaatccacttcttttgtaaatatgatatgacagatggggggcctcctacccaccctgcacactcctc

SEQ ID NO: 48470 - DNA, 674 bp, Zea mays
  unsure at all n locations
  Clone ID: LIB3067-028-Q1-K1-B4.R4
gttcacatggtgggnatgacgcgngnctagcgtttgactaancacagttctctctaagaggggattgaagtctgcatggtaccttctgctgataggccagatgaggccaaatttgctgtaccacttctggagtctgactttgactttgccaaactggtgccaggatgtccttggagattacctcaaaagatccatctccaggtcatttttcctatcagcaggagttcaagctactcttctatgccttctgctccacgactcaaactaatctcaacaccagatttgaggtcacttctctcagttgaggatgtgaaactccctccatggtcaaatgggatgtgtttggcggagtatcttcctgctttagaagacagtcttaacggtctgcttgtagatgcgtcggcttcaattggttccagaagacgctttattgaggcactagctcccatctttgggagaccattagaggctgatccgattttttgcaggagggctacagttctttccatttctggaatgttcacatttctggttcactttgccatcccccttcaattcccaaagcaacaacctgtcgtcacactgcagagttctcagcactgtaatgccgatgggatgcctatcacgtcgcctccgataaatgactatccctggagtcctagatgggaccaggc

SEQ ID NO: 48471 - DNA, 273 bp, Zea mays
  unsure at all n locations
  Clone ID: LIB3067-028-Q1-K1-B9.F3
tcaaaaaaaagataagcctcttcaaccttttcatggctacacagaacctttcaatatcacatagagcaaatagccatccgcanacaaaaaaataaanaaaanaaaaaaanaaaaaaaaaannnaaaaaaaaaaaaaaaaaaaanaaaaaaaaaannaaaaaaaaaaaaaaacnaaaaanaaaaaaaaaaaaaaaaaaaaaaaaaaaaaaaaaaacaaaaaaaaaaaaaaaaaaaaaacaaaaaaaaaaacaaaaaaaaaaaananncaanana

SEQ ID NO: 48472 - DNA, 108 bp, Zea mays
  Clone ID: LIB3067-028-Q1-K1-B9.R4
tccacttttgggacgttcctcttaatgccaagatgggaagtgaaagcaggaatttttcaaggcattgaaggaaaactttccagacctgctgctactgatgtttcaagt

SEQ ID NO: 48473 - DNA, 151 bp, Zea mays
  unsure at all n locations
  Clone ID: LIB3067-038-Q1-K1-F12.F3
tttcctttgnatttgnaacttatatcttcagnactaattgccactgggnaaaacccctaatacaatggcatgaattgactccttcccgagccggacgcgtgggcggacgcgtgggcggacgcgtgggcggacgcgtgggcggacgcgtggg

SEQ ID NO: 48474 - DNA, 465 bp, Zea mays
  Clone ID: LIB3067-038-Q1-K1-F12.R4
tgataaggttttctgtcaaaaggtggatacagaaatgagttgtcatattactggatctttaatcccacctcacactggatgcatgcgttggttgtcagtacatgatcctaaatatgcatcagaactcaaaagtggtgaaagtagatcaagggatacaagcatcaaaattgagcagaatgaacaagaacatagaatactcaagaatgaagatggtatggtgaaatctgaacggccatataaatcccgaaagagggggcggcacattgagaaatgacatttcattgaggccgtgaagatacaagaatgtgaaagtcatgttcgcttcaatggttctgctacctgtttatgtttcttgtggggggagaaggtgcctccagttggagatcccggtagcttcatagaaatgtacgatgattttgtaaaacgaattgagggttgcatttgcaaattatcaccttttttgac

SEQ ID NO: 48475 - DNA, 264 bp, Zea mays
  unsure at all n locations
  Clone ID: LIB3067-043-Q1-K1-A5.R4
gcctcccactccgcaccttagccactgccgctttcanatagcatggtccccgtcactccatcgcgcctggcttccagatgctgttgaggggcagcttgtgccatcttcgagaagattccatggatctacctccatttcaggatcatgcgaaggcaacgccgccttgcttctgcctgagacgttagtgggcacccagctcacagaacaacttttctgttgcggacctacaccatatgtactgctctggagtggtgttaatgcagc

SEQ ID NO: 48476 - DNA, 268 bp, Zea mays
  unsure at all n locations
  Clone ID: LIB3067-052-Q1-K1-D2.F3
gggtggcaccggaaccgggcctgccgtgcttgaccggcttgtaggagaaggagaactcagcaaggtagtggccgatcatctcaggcttgatctcaacctggttgaaggtcttgccgttgtagaccccaacaatgcttccaatcatctcagcggacgcgtgggcggacgcgtgggcggacgcgtgggcgggacgcgtggacggacgcgnggggagtattcctagtaaanccaagnnnnctcnnccnnnnacctnaaaaacnacnacnat

SEQ ID NO: 48477 - DNA, 228 bp, Zea mays
  Clone ID: LIB3067-052-Q1-K1-D2.R3
ttctacttctttatatcccaaaacattgtgttgttccattccagctcaaaaattcaaagctaagcattgcacaattatgctgttttgttggaagtatttgagttaatcatatctaagctgagttgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcg

SEQ ID NO: 48478 - DNA, 213 bp, Zea mays
  unsure at all n locations
  Clone ID: LIB3067-052-Q1-K1-D9.F3
ttgtggtgngagcataacctcgtagcacagtaataatagtggatatatgtgcccaggaacaccagcatgctccagaagcctcctcatattgtccactgtggatgaatcaaaaggcgcctgcccgggtaccactctcctgttgaaggatttgggcgatctctaccaccactccgcgcaatccaaattatctgcgaaccaccaatgttattgtaa

SEQ ID NO: 48479 - DNA, 635 bp, Zea mays
  Clone ID: LIB3067-052-Q1-K1-D9.F4
cttgtcagcaccggagaaacaagtatggggatattacttgtcataccaagaatgctgatgagggaagggagctattcacaaatactttgtacaactcagttgttaatcagtacaatgtcctcaaatctgctatctttagagatcgtggagcagctgtatcaaacaatgccatctcactgtcacaaccatggcgatgaatgttagctttcccagtccagattcgatactgaagttaccttttcagaagaacaggtgaactgcaattgtgcaaattttctgggaaaaactcttgaagtttaatctttctgatatcactggactttaccaatcatggtggagcttattactctaatgcagatcctcgttaagatgtctggctggtcaagggtgattcgtgattctgcagatagggatcctcgtaacattgcatgccgtcgtccgcaaattactgctccctcaggttgttcagtaatgtgctggttgggcactgaggaatccatcaggttgcatccttttgtctagacgtcgatttgtgttgttggaagtggaaaacattttcatcctgggctgtatccgcatcatgtatagataggctcgagtctctctttttttttttggctccacaatttttttgg

SEQ ID NO: 48480 - DNA, 235 bp, Zea mays
  unsure at all n locations
  Clone ID: LIB3067-052-Q1-K1-D9.R3
ttgcatccttttgtctagnagtcgcattgtgttgttagagtggtaaacattttcatcctgggctgtatcgtcatcatgtatagataggctcgagtctctctctttttttttggctccacaattttttggagatataaaagcggcaggagttatgacatgcccacagtcggccctccttgtagaaatcctttggatgtaacctgtctctttcttatacatactagaaagtcaaggc

SEQ ID NO: 48481 - DNA, 574 bp, Zea mays
  Clone ID: LIB3067-052-Q1-K1-D9.R4
aatttgcggccgacggcatgcaatgttacgaggatccctatctgcagaatcacgaatcacccttgaccagccagacatcttaacgaggatctgcattagagtaataagctccaccatgattggtaaagtccagtgatatcagaaagattaaacttcaagagtttttcccagaaaatttgcacaattgcagttcacctgttcttctgaaaaggtaacttcagtatcgaatctggactgggaaagctaacattcatcgccatggttgtgacagtgagatggcattgtttgatacagctgctccacgatctctaaagatagcagatttgaggacattgtactgattaacaactgagttgtacaaagtatttgtgaatagctcccttccctcatcagcattcttggtatgacaagtaatatccccatactttgtttcttcagttgctgacaagcctactccatgggaaggatatcaccctctgttcaccaatctctttctcgacctgttgtggtggaggcataacctcgtagcacagtaataatagtggatatatgtgcccaggaacaccagcatgct

SEQ ID NO: 48482 - DNA, 182 bp, Zea mays
  Clone ID: LIB3067-054-Q1-K1-E3.F3
gttctgccgggctgccatccggcggggatgacgttgctggcgacgaggaccctgccggagcccgaggtgaggcggacagacaggggggcctgcagattggtggagccggacttgtactgccacacagcgccccaggagcgttgcatgggcgcccacgccgccgcgccgctctgcttcacctc

SEQ ID NO: 48483 - DNA, 214 bp, Zea mays
  unsure at all n locations
  Clone ID: LIB3067-054-Q1-K1-E3.F4
gcgccgccgttcgcacgccacgtcctgggcacggcggntgcgcaggnacggaggcgagagcggtgatggcaatgaagcaggtcaagactccgatctgcttggaagccatgccggaagccaggttagacgacgagcgcgctagctagagctgtttcgatatgtgtccaatgatctagctcggacgcgtgggcggacgcgtgggcggacgcgtggg

SEQ ID NO: 48484 - DNA, 131 bp, Zea mays
  Clone ID: LIB3067-054-Q1-K1-E3.R3
caccatactcacttccctgcaggctgctgctgactcacgccaatgaaaaaatcatttccatcgtccgtgcgagaaattcaacatatataatagtgcaagcaccggaaaataaaattctactgtgttctgag

SEQ ID NO: 48485 - DNA, 214 bp, Zea mays
  unsure at all n locations
  Clone ID: LIB3067-054-Q1-K1-E3.R4
ggcaanggctgcggcacctgctaccaggtgaagtgcaccggacacgcgtcgtgctccggaagcccgnnnnaaannnaanaannnnannnaaaaanaaaaaaaanaaaaaaaaaaaaaaannaaaaaaaaaaaaaaaaaaaaaaaaaaaaaaaaaaaaaaaaaaaaaaaaaaaaaaaaaaaaaataannnannnnnnannnnnaaannanannaa

SEQ ID NO: 48486 - DNA, 115 bp, Zea mays
  Clone ID: LIB3067-039-G9-F5A
aaatgtgatatggagttcacagaggccgctcaacatacgattctcgacgccggagtggctacccttgccggctggattgcttatctgcttcgcctctcgctcccggacgcgtggg

SEQ ID NO: 48487 - DNA, 258 bp, Zea mays
  Clone ID: LIB3067-039-G9-R5B
tgaatctacagttctgtttccataagctctctgttgggatggctcgtgatacatcggttccggcgcccggcgcgcggccggctggcacgaagtcggcgatgccagcgtcgggcgcgctgtggtgctgcccgtagcgaaggccgccatggggtgataggagtcgtcgaggcgctcgccctaggtttctcgacgccggagtggctccccttgccggctggcttccttatctgcttcgcctctcgctcccggacgcgtggg

SEQ ID NO: 48488 - DNA, 569 bp, Zea mays
  Clone ID: LIB3067-045-B5-F3B
ttcaagacctgccgaggacacgaaggaggacttggaggcctacttacgagagttcgagcgcggtctctgcaaggatgacgtggacagcgacggtgaaagcggtgacccctaggtccaggagctttcttcgccggagccgacgaggtttggctatgccaccgcggtcaaggcagcagttgagggcgtgatgacgacgactccaaaggatgtgcaacgagatagagcagtaaaaaagagcagtcgcatgaacctgtacaggggaatcaggcagcgcacttggggcaaatgggcagctgaaatcagggacccaaccaagggcgtgcgcctgtggctcggaacctacaacaccgtctaggaggcagttacggcatacgacgccaaagctcgcaagatccgagggaagaaagcgaaggtgaatttccccgatgacgacgcgacaggcactcgacacaggccaacgaacgccgtgaacgcagcgaggctagtagatccacccccacccgctgaggcctgcgccgatgagatgattaacaaccttgagaacgacgacggcgacaacaacaacaacg

SEQ ID NO: 48489 - DNA, 631 bp, Zea mays
  unsure at all n locations
  Clone ID: LIB3067-045-B5-R4A
tcggggaaattcaccttcgctttcttcccgcggatcttgcgagcttcggcgtcgtatgccctagctgcctcctcggcggtgttgtaggttccgagccagacgcggacgcccttgttggggtccctgatctcagctgcccatttgccccaagggcgctgcctgattcccctgtactggttcttccggccgcgcttttttactgctctatctccttgcacatcctttggagtcgtcgtcatcacgccatcaactgctgccttggccgcggtggcgaaggcaaacctcgtcggctccggcggaggaagctcctggacctcggggtcgccgccttcgccggcgctgtccacgtcatcctcgccgaggccgcgctcgaactcgcggaagtcggcctcgaagtcctcctccttgtcctggggagctcccttactgccgggccccggccatagcaggtccgcagtcacacggcaccgctgctgctgcttcttcttggccgccgccgccgncgncgnncgcaccccggacggcgggatgaaacccgagaggatggcgccgncgcacatcgccgcaacggngtggtggtggtggatggatcgatggattattgggttgggcggaccgggagtgaaggaca

SEQ ID NO: 48490 - DNA, 108 bp, Zea mays
  Clone ID: LIB3067-047-C2-R3B
cgctaaattaatccatagctcaaggacatatatgagttcgagcatcggaagtatgagtggcacaggcgagatgaacatggaaactatccacttaattctcgaatagtc

SEQ ID NO: 48491 - DNA, 435 bp, Zea mays
  unsure at all n locations
  Clone ID: LIB3067-029-Q1-K1-F10
tgtcgagctcgtcgccgtgaacgaccccttcatcagcaccgactacatgacctacatgtgcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcactagaaaggtggtgccaagaaggttgtcatctctgctcctagcaaggatgcccccatgtttgtcggtggtgtcaacgagaaagagtacaagtctgacattaacattgtctncaatgctagctgcacaaccaactgccttgctcctcttgctaaggtcatcaatgacaagttcggtat

SEQ ID NO: 48492 - DNA, 341 bp, Zea mays
  Clone ID: LIB3067-056-Q1-K1-B4
cccacgcgtccgcatcaccatcctaaccacattaaggcttttcggttagctctcaatccatgtggattgagtgggattggatgagtttgaatcccaaacaagtcaaactttttaagaatttttttcaatctcatccaatccatgtgtattgggaataaccgaacaaggccttagatgtctcgtgagcatggatcggctatggtgattagcatgaatgtgttgtggtaactagttggaagactaaatttcctgacgtttggatgtttgcaactgctatgtactataaagactcctcgtgccacagatgtttttgttaaattagtaacgcttttgcatcttgt

SEQ ID NO: 48493 - DNA, 431 bp, Zea mays
  Clone ID: LIB3067-005-Q1-K1-A12
cccacgcgtccgggttattcccaatacacattgattggacgggattggaaaaaattgtgaggaagtttgacttgtttgggattcaaacccatcgaatcccgctcaatccacatggattgagagctaaccgaacaagcccgtaatgtattccttggtttctgctttcccggacgcgtgtgtgcggaagccaaactggatgaggcacttcaaattgatcccaacacgtccgatgcactctggtgcttgggaaatgctcagacctctcatggattcttcactccagacaatgcaatagctaatgagttctttacaaaggcaaccggatgttttcagaatgctgttgatgtggaacctgcaaatgagctgttcaggacgtctttagacttgcaaatgaatgcacctgaactgcatttggatatccaaaagcaaat

SEQ ID NO: 48494 - DNA, 233 bp, Zea mays
  Clone ID: LIB3067-016-Q1-K1-F10
accggtgtcttcactgacaaggacaaggctgttgcgcatctgaagggtggtgccaagaaggggggtatctcagccccaagcaaagatgcacccatgttggttgttggagtcaatgaaggcaagtgcaccttggatgtgaacattggttccaatgctagtcgcaccacaaactggcttgctccacttgctaaggtcattcatgacaactttggcattattgagggcctgatgac

SEQ ID NO: 48495 - DNA, 431 bp, Zea mays
  Clone ID: LIB3067-046-Q1-K1-A9
ggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatg

SEQ ID NO: 48496 - DNA, 339 bp, Zea mays
  Clone ID: LIB3067-007-Q1-K1-E6
ggtcgatatcctcatccttggtggtggtatgatctacacattttacaaggcacaaggatattctgttggaaaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagttgttgagtt

SEQ ID NO: 48497 - DNA, 137 bp, Zea mays
  Clone ID: LIB3067-004-Q1-K1-A5
ctcgagaagggcgccaaggtcatcctcgccagccacctgggtcgtccaaaaagtgtcaccccaaagtacagcttgaagcctcttgttccacgcttgtctgagctccttggagttgaaagtctgatggccaatgattg

SEQ ID NO: 48498 - DNA, 418 bp, Zea mays
  unsure at all n locations
  Clone ID: LIB3067-027-Q1-K1-A8
gctagctcgatctactactactactactagctggtacacatactagccatcctgccagccagccagcttgccatggcgcccaccgtgatgatggcctcgtcggcaaccgccgtcgccccgttccagggtctcaagtccgccgtcagcctccccgtcgcccgccgcagcaccaggagcctcggcaacgtcagcaacggcggaaggatccggtgcatgcaggtgtggccggcctacggcaacaagaagttcgagacgctgtcgtacctgccgtcgctgtcgacggacgacctgctgaagcaggtggactacctgctgcgcaacggctggataccctgcctcgagttcagcaaggctcggttcgtgtaccgcgagaaccctcacctcncgtgctactacgatggccgctactggaccatgt

SEQ ID NO: 48499 - DNA, 399 bp, Zea mays
  unsure at all n locations
  Clone ID: LIB3067-001-Q1-K1-B11
gctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctncccgtgctactacgat

SEQ ID NO: 48500 - DNA, 428 bp, Zea mays
  Clone ID: LIB3067-018-Q1-K1-F10
cccactcgttcggactagctctagttgctgaggaatattttactggtacatggacaactggttcgactgatagactcaccagcctggatcgttacaaaggacgatgctatcacatcgagcccgttcctggggactcatatcaatatatctgttatgtagctcatccataagacctatacgacgagggctctgatactaacatgtttaattacattgagcgtaacgtgttcgacgtcaaagccttacgcgctatacatacgtaggatctactaatttccactgcttattcaaaatctttgcaagcttcaatctacacggtatccaagttagaaacgcttaacttgaacaagtaccgttgttctttattgggatgggctatgtaacctataatgggatcatcctcgaaaaattacggtacagcgtgctat

SEQ ID NO: 48501 - DNA, 412 bp, Zea mays
  Clone ID: LIB3067-035-Q1-K1-H12
gtaccgtatcagtctcccggattctctccggttcgtgggagggccaaagcttcgagttaggaaaaccgtaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcccgtgatcgcgtcgggggtgtggttcgcgtcggcgcagggcgaggagtgcgcgcgcctggcgcggtggcccgtggccatcctgggcgggctgctcctgctggccgcgctggcgggcttcgtgggcgcgtactggaaccggcgcggcctgctggccttctacctcttcgccatggcgtcgctcgtggtgctcctcatcgcgctcctc

SEQ ID NO: 48502 - DNA, 413 bp, Zea mays
  Clone ID: LIB3067-034-Q1-K1-B4
cccacgcgtccgcggacgcgtgggctttggagcccagaagacagtgcaaagctggcaattgtgcttatgtgtggcggttggtctctgggctggcttagtcattggttttattactgagtactacacaagcaatgcctacagccctgtataagatgttgctgattcctgcagaactggagctgccactaatgtcatttttgggcttgctctgggttacaaatcagtcattatcccaatttttgctattgcgtttagtatcttccttagcttcagccttgctgccatgtatggtgttgttgtggctgctcttggaatgctgagtaccattgccacaggccttgctattgatgcctatggccctatcagtgataatgctggaagcttaagtctgtatgggtgcatcttatcatata

SEQ ID NO: 48503 - DNA, 424 bp, Zea mays
  unsure at all n locations
  Clone ID: LIB3067-010-Q1-K1-A11
cccacgcgtccgattggcattgcgctcatgttggcttggtcttccatacaccttcaccattgataactttggagcccagaagacagtgcaaagctggcaattgttcttatgtgtggcggttggtctctgggctggcttagtcattggttttattactgagtactacacaagcaatgcctacagccctgtataagatgttgctgattcctgcagaactggagctgccactaatgtcatttttgggcttgctctgggttacaaatcagtcattatcccaatttttgctattgcgtntagtatcttccttagcttcagccttgctgccatgtatggtgttgttgtggctgctcttggaatgctgagtaccattgccacaggccttgctattgatgcctatgggcctatcagtgataatgctggaagc

SEQ ID NO: 48504 - DNA, 472 bp, Zea mays
  Clone ID: LIB3067-058-Q1-K1-C8
ggttaataggtacatggagttggctcaccgagttgacgaagctttggggttcatgtcaggtgctgggctccctttagatcaccctataatgacaacagcagaattttggacgtcacatgagtgtcttcttctaccttatgagcaagcgctcactcgtgaggattccaccacgggcctctattatgactgctctgcccacttcctatgggtcggagagcgcactcgccagcttgatggtgctcacgttgagttccttcgaggcattgccaaccctcttggtatcaaggttagtgacaagatggacccagcagaacttgtgcggttgattgatatattgaatcccgaaaacagggctgggagaataaccatcatcacaagaatgggacctgaaaacatgagggtgaaacttccacacctgatacgcgctgtcccgtgggccggtcagataggtacatgggttactgacccaatg

SEQ ID NO: 48505 - DNA, 400 bp, Zea mays
  Clone ID: LIB3067-014-Q1-K1-C5
aggatgttgaacttttggcaagggggcgccatgacccctgtgttgtccctcgagctgttcctatggtggaatccatggctgcgctggtcctgatggaccagctcatggcgcatattgcccagtgtgagatgtttccgctgaaccttgccctacaagagcccattggctctgctagcagtgcatctgaactgtcaccaaacctatcataatgtttgtcgtggaacatgttccagctttccttctatcgaaattctggtctttgctaagcagtttgcaattcggaacccccataaaccctcgactattgtacctagagataaagtgaacggatatcatgatagaaatgcatttatgtttttgtgatgtggtattttactgttattttacccctttttttttt

SEQ ID NO: 48506 - DNA, 440 bp, Zea mays
  Clone ID: LIB3067-017-Q1-K1-D9
ggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggaggttactccaaaaacattggctgatgttaaaggcggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattatttcaaaccccaaggaagttgatggtgtgaaagtccttcaact

SEQ ID NO: 48507 - DNA, 464 bp, Zea mays
  unsure at all n locations
  Clone ID: LIB3067-027-Q1-K1-D12
gttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttggtcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttatcatcaccagttttcccaaggacatgtcacaggaactgccaagcctaatcactcctactgagctctatattntgtaattttcatgtgcattccg

SEQ ID NO: 48508 - DNA, 400 bp, Zea mays
  Clone ID: LIB3067-059-Q1-K1-G12
cccacgcgtccggcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaaga

SEQ ID NO: 48509 - DNA, 349 bp, Zea mays
  Clone ID: LIB3067-018-Q1-K1-A12
ccgtcctttcctttctgaggctcgcgaaccccgacaatggccgcaaccgcggtgtctgtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctg

SEQ ID NO: 48510 - DNA, 439 bp, Zea mays
  unsure at all n locations
  Clone ID: LIB3067-030-Q1-K1-F4
cccacgcgtccgatgatctggtgctcgtgcaggctgatctttacaccttggatgatggctttgtcatccgcaacccatccagagcgaatccagctaacccttcaattgagcttggacctgagttcaagaaggttgccaatttccttggtcggttcaagtccatccccagcatagttgagcttgacagcttgaaggtttctggtgatgtctggtttggctctggaattacactcaagggcaaggtgacaattatcgtcaagcctggagtgaagttggagattccagatggagacgtacttgagaacaaggatgtcaatggccctgaggatctttaagcaatgtgtatcatcaccagttgtcccaaggacatgtcacatgaactgtcaagcctaatcactcctactgagctctatantttgtaatgttcatgtgcattccg

SEQ ID NO: 48511 - DNA, 257 bp, Zea mays
  Clone ID: LIB3067-043-Q1-K1-D2
gtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccaatgaaggctacatctgatctgatgcttgtgcagtctgatctttaca

SEQ ID NO: 48512 - DNA, 443 bp, Zea mays
  Clone ID: LIB3067-007-Q1-K1-G4
ctcaagggcaaggtgacaattatcgccaagcctggagtgaagttggagattccagatggagacgtacttgagaacaaggatgtcaatggccctgaggatctttaagcaatgtttatcatcaccagttttcccaaggacatgtcacaggaactgccaagcctaatcactcctactgagctctatattttgtaattttcatgtgcattccgattccgctgtgagggtcatgtgagcccgctagagaataattgtaatcttctttgctgcgtctgtacttctgtttttgtgcgccaggacgtatatttttactgaaatgatactccgtaatatattataatacttgttttatattatttttattgtttttattatattattatgttttttttatgtttttataatttattttttttttatattatttttttataatttttttattt

SEQ ID NO: 48513 - DNA, 451 bp, Zea mays
  Clone ID: LIB3067-049-Q1-K1-F5
caacctctcattctgaatgtactgctgaagaagcatataactggactcagggtcgtgtgatatttgccagtggcagtccatttgaccctgtggagtacgatgggaaggtttttgtacctggacagtcgaacaacgcctacattttccctggatttggcctcggtcttgttatctctggagccatccgtgtccacgaggacatgcttcttgccgcctcggaagcactagctgctcaggccacacaggagaacttcgacaagggatcaatcttcccgcccttcaccaacattagaaagatctctgcgcgcattgccgcagccgtggctgcaaaagcttatgaactcggtttggcgacccgtctgcctcccccaagggacctggtgaaatatgcacagagctgcatgtacactcctgtctaccgtaactaccggtagtgctgctgggatcaatt

SEQ ID NO: 48514 - DNA, 139 bp, Zea mays
  Clone ID: LIB3067-007-Q1-K1-H12
gaaagatggcattctgttcccaattcctctttaccctttgtactcagccttcatagctctgcatggtggagctcttgtcccgtattaccttaatgaaaaaactgggtggggtttggagatctctgattttaatacgcat

SEQ ID NO: 48515 - DNA, 432 bp, Zea mays
  Clone ID: LIB3067-040-Q1-K1-B11
ggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagtctgtctccaaaggatactatggagagtgtggtaaaagaggaggttacatggagattactggcttcagtgctccggtaagagagcagatctacaaggtagcttcagtgaacctgtgctccaatatcactggtcaaatccttg

SEQ ID NO: 48516 - DNA, 221 bp, Zea mays
  Clone ID: LIB3067-048-Q1-K1-F3
gagttgaggcgcttacacaaactttcattccggcctcttgttccatagtttttcttgcatgttacgtctcaccgatgaataaaatgtatgtatcagacttgtctcgtttttttgcccatccaagcagcaaattagccgctggcacagcatgcggtaataatcttgtcacagtgctgtagttgggagcgtttttcttgttagaagtgtttctggtttgtttg

SEQ ID NO: 48517 - DNA, 442 bp, Zea mays
  Clone ID: LIB3067-014-Q1-K1-B8
cggacgcgtgggatgagatgcaagcagttgctgtcaagagccaactgcaacagatcgcaagaccaatgtacagcaacccacctgttcatggtgcactggttgtttctataatcctcagtgatccagaattgaagagtttgtggttaaaagaagtcaagggtatggctgatcgtatcattggaatgcggaaggcacttaaggaaaatcttgaaaagctaggttcacctttgtcatgggatcatatcactaatcagattggaatgttctgctacagtgggatgacacctgaacaagttgaccgtttaacaaatgaataccacatttacatgacccgcaatgggtggataagcatggctggtgttacgacaggaaatgttggttacctagcaaattcttttcatgaggttaccaaactcaatttagttatggtcctaccttcttt

SEQ ID NO: 48518 - DNA, 393 bp, Zea mays
  Clone ID: LIB3067-044-Q1-K1-F10
ggcgaagtcattgagtagtctttcggattggatcatttgtgctttaggacactgcaacgtttcacggctgcgacccttgaacatggtatgcaccctccaatttcgccgaaaccagaatggcgtgctttgatggatgagatggctatcgtcgccacaaaggaataccggtcaatcgtatttgaggaaccgcgctttgttgaatatttccgccttgcaacgccagagatggagtatggcaggatgaacatcggaagcaggccatcgaaaagaaagccgagtgcgggcatcgagtcgctgcgcgcaatcccttggatcttcgcttggacgcagactcggttccaccttgccgtgtggctgggtttcggcgcggcgttcaagcatgtcttggacaag

SEQ ID NO: 48519 - DNA, 318 bp, Zea mays
  Clone ID: LIB3067-036-Q1-K1-C4
gagcccgcagccgcccctgtccaatgagtttatcgactagagtcagccggcggatctggtgcagctgaaccagcagagcgagtacgctccaggcctggaggacaccctgatcctgaccatgaagggcatcgtcgtcggcatgcagaacaccggctaggccaagaattattgtgtgcagataacctgtcttccatgagacggttgacgatatgtgtaggcctgtgagcagttagtacaccgtggccagtgtgttctggaggatttgtcatgtcagaagccttctcttgtgtgcttgctgtagatgccaaggggagctta

SEQ ID NO: 48520 - DNA, 354 bp, Zea mays
  Clone ID: LIB3067-017-Q1-K1-H10
gattggcattcctccgcgaccactgaggtgaaccatgaagagacaaaagagctactgggtcatgttgctggtcacaaggacgtccttgaaggtgatccttatctgaagcagcgtctgcggctgcgtgagtcctacatcaccactctgaacgtgtgccaggcctacaccctgaagcggatacgcgacccgagctttcaggtgagcccgcagcctgccctgtccaaggagttcaccgacgagagtcagccggcggagctggtgcaactgaaccagcagagcgagtacgcttcaggcctggaggacaccctcattctgaccatgaagggcatctactgcggcatgcagaacaccggc

SEQ ID NO: 48521 - DNA, 267 bp, Zea mays
  Clone ID: LIB3067-007-Q1-K1-C3
caaactgcggctgctgtagatacgcgcgccgtcactccaaggtccaagcctcccttgctcccgccaccgcccctcaccatgggcagcgccgccgcctctccgcagccgtctgggaatctgacgcaggacgagctcaagcgcgtggcggcgcaccgcgcggtggagttcgtggagcccggcatgacgctgggcctgggcacgggttccacggccgcgcacgcgctggaccgtctgggctacctactccgcgtgggctcgctgtccggg

SEQ ID NO: 48522 - DNA, 380 bp, Zea mays
  Clone ID: LIB3067-056-Q1-K1-A4
cggacgcgtgggcggacgcgtgggctgagaaggttatgtgcagagaagggagtgaacccctggattgaggttgatggtggtgttggtccgaaaaatgcctacaaggttattgaagctggcgcaaatgccattgtcgcaggttctgcagtttttggggctccagactacgctgaagctatcaaaggaataaagaccagccaaagacctctagctgtagccgcataaggagctggacgtgtaatcatttactctgtgcaagtttaccagtgatgcgatctgtatagatgtgtgtcttgtccagccatacgtataccggagatgaaaagagacggaagcagtgaagaaatatcctttttttttcttctcatttttcacgaaga

SEQ ID NO: 48523 - DNA, 459 bp, Zea mays
  Clone ID: LIB3067-037-Q1-K1-G5
cccacgcgtccgcggacgcgtgggccagcatctccgctccggctgcgctctgccttgcggtgctgctacctgctctagcgcgagcgagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggggttccagctctcggtgctctgcgacgccgaagtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacctcaaactgaa

SEQ ID NO: 48524 - DNA, 276 bp, Zea mays
  Clone ID: LIB3067-018-Q1-K1-E5
cccacgcgtccgtgaatgttgaaaagctcaagaagatggcaggtgctgtgcgcaccggggggaagggtagcgtgcgcaagaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtgggcagtggaactccac

SEQ ID NO: 48525 - DNA, 379 bp, Zea mays
  Clone ID: LIB3067-001-Q1-K1-D2
cccacgcgtacgccctcctccgccgaatcctctcctccggccgccgaaaccctagccggcgccgctgccgtcatggcaagcagcaacgtctcgaccgtttacatctctgtcattgatgacgtcatctccaaggtccgcgaggatttcatcacctacggagtcggtgacgccgtcctaaacgagctccaggctctagtgggagatgaaaatgctacactgctgctcgatctctgagaacatagaccgaaccaaggttgctgacgcgtacgtcggaggcaccaccggcacgacaacggccgtgcacgacctgaacgtgccgtacgaggccacatcttaggagtacgccaacccgaccgctgacatgctgtttccggcgaca

SEQ ID NO: 48526 - DNA, 411 bp, Zea mays
  Clone ID: LIB3067-048-Q1-K1-D6
ggtcaggagaggctgcgttcacttttattcttgatgatcctgcaggaaacagcgttatggagaatccgcatgctccgttattagatcctttactatctgtgagattctacgaaagaactcgtgaacaacaagcagcacttggctttcttgctgaaccaccaaaagaacaacctggagaggctgtattgcctgcttcagcagtggaatccaattctgatgggttgcaaagtgtgccccatggctcagttggagctgttgcaggtcgtcgtgctatagctcagggaaaccctgatgaagttgctgcagcattgtgtagatattcagcaccagaagaggttgatactttaccatcaacatgtggagcctgtggaacaaaatgcgtcacacgtttctttgctacaaaaatcccat

SEQ ID NO: 48527 - DNA, 447 bp, Zea mays
  Clone ID: LIB3067-033-Q1-K1-G7
gtccgcgcaaaaccctccctgctcagactcgtctgctgcagctcctgctccgccgccgtgtcaaacgcactctcctccgccgtcgcccgaggcaagatggttctccagaacgacatcgaccttctcaacccgccggcagagctcgagaagctcaagcacaagaagaagcgcctcgtccagtcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggaagggagactagagctgagtctgttattagtactggatcggttgtcaatctccagtatgtggtcttcaagttttgctctgtgccccagacgttagggtcatg

SEQ ID NO: 48528 - DNA, 448 bp, Zea mays
  Clone ID: LIB3067-053-Q1-K1-H1
cggacgcgtgggtgcaaaacgacattgacttactcaatccaccggcagagcttgagaagctgaagcacaagaagaagcggctagtccagtcccccaactccttcttcatggatgtcaagtgccagggctgtttcagcataaccactgtgttcagccactcccagactgtggttgtgtgcccaggctgccaaactgttctgtgccaacctaccggtgggaaggccagggctcaccgaggggtgctccttccgtcgcaagggcgattaggtcctgcttctcttaacgtgagaagagataaatttggtgttttgcaactttctcaggatatgtactcggtgaggattttgttaattattatggctgttagcgtggcctgacaatgcttgtgtaaacctgcactttgtttgagcgtagtgacagctaatatggtgcttgttggcttttgctg

SEQ ID NO: 48529 - DNA, 437 bp, Zea mays
  unsure at all n locations
  Clone ID: LIB3067-040-Q1-K1-E8
cccacgcgtccggaaaccttgttgcgtgtttgctcgcccacaagatgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggcttgacctcctttcacccgagaatgangagctcctgtacagccaaaccgag

SEQ ID NO: 48530 - DNA, 298 bp, Zea mays
  Clone ID: LIB3067-045-Q1-K1-E9
ctttttcctttccggtggcgaattttttgtagtctgcttttgctaggcggcgggcgttcgttgctgctctttgcttcaagagttaaatttacctaccttgtcaaggtcttgttccatcattgatccgggtgtcgcttttagtagtctgatggactgttagtagtttgcgttgcgtcggttgagagggaacggtggtggtggtggtgtgtgtgcagtcgggtgtggtgctccctttgtttcctggatgggatgttgctccttgaataataatcgtagtggccttggagcccttttcctg

SEQ ID NO: 48531 - DNA, 318 bp, Zea mays
  Clone ID: LIB3067-017-Q1-K1-C3
gggatgttgctccttgaataataatcgtagtggccttggagcccttttcctgaaataagagcagcatcctagtgcttcactttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaatcaaatcaaaaatatcaaaacttaaaaaaattaataagaaataaaaaaaatatactaatgattaaccaaaataaaaacaaatatcaatttattaaaaactcaaacaaggaaaaa

SEQ ID NO: 48532 - DNA, 439 bp, Zea mays
  Clone ID: LIB3067-040-Q1-K1-H10
actcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagccaaggccgcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggtgacgccaacgacgagaagaacgtgctgtccctgtggtttgacgggctcaa

SEQ ID NO: 48533 - DNA, 375 bp, Zea mays
  Clone ID: LIB3067-054-Q1-K1-C9
cggactcgtgggcggactcgtgggcggactcgtgggcggactcgtgggcggactcgtgggggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggactccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtc

SEQ ID NO: 48534 - DNA, 408 bp, Zea mays
  Clone ID: LIB3067-010-Q1-K1-A8
cccacgcgtccggaacaacgcgaccgccgccgtcgacgacgacgactcagctactcgcctggggatgggggtcgaactggcgcaaccgaccgccgacgcggctgcggtgaccaccgctgagcaggctcaggatctcatcgacgccgctaggtacgacgacttggaggacgtagtcgccctgttctccgctggtgtctcgctggactccacagattcgcaaggccgcacagctcttcacatggcttctgccaatggtcaccttgctgaggtggaatacttgattcaaaatggagcgaatgttaatgccaccaacatggagaagaacacaccactccactgggcatgccttaatggacgtatagaggtaatcagggctttgatctcagcgggggctagcgagagtgctct

SEQ ID NO: 48535 - DNA, 411 bp, Zea mays
  unsure at all n locations
  Clone ID: LIB3067-022-Q1-K1-H4
cccacgcgtccgaacgaggagaagctccgcgaggctctcaagttctccaacgcctgcggcgccatctgcaccaccaagaagggcgccatcccggcgctgcccacggtcgccaccgnccaggacctcatcgccaaggccaactagatggccgcacgcccgccgttccaccacgtcactgtccccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaaataaaatgttggcatgcgtggtgggatgctatcctttatttttattttattttattttttagcttggatcagttggggttttgaacattgcta

SEQ ID NO: 48536 - DNA, 347 bp, Zea mays
  Clone ID: LIB3067-039-Q1-K1-B10
tcgcccactcgttcgtccactctttcgcgtccatcgccccctccctccggtctgcgctcccagagcctctcccctgcgcccccgccgattcgcgtctccctttgttggaaggaacgatggagcagaccttcatcatgatcaagcccgacggcgtccagcggcgcctgatcggggacatcatcagtcgcttcgagaagaaagggttctacctcaaggggatgaagttcatgaacgtggaaaggtccttcgctcatcagcactacgctgacctttccgacaagcctttcttccccgggttggtggagtacatcatttccggccccgtggtggcgattgtgtgggaaggg

SEQ ID NO: 48537 - DNA, 464 bp, Zea mays
  Clone ID: LIB3067-029-Q1-K1-C3
cggacgcgtgggctcccccacccgtccatcgccccctccctccggtctgcgctcccacaggctcgcccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaagggtaagtgcgtttcattttgttctcgaattgattgctggaacacgtactctgtttaaatttcctagctatacgcatgaacttctctgctgttgaggcaagatttgatgtgcagattctggtgatatcttagaattgtttaatctatgtatacgttcggttgcgtgtgatcaccatctgaaaaaggatgttggtcgtggaagcaggaatattgcgtggagattagatttgattgaaaaccattatcttgatgtca

SEQ ID NO: 48538 - DNA, 311 bp, Zea mays
  Clone ID: LIB3067-032-Q1-K1-C5
cccacgcgtccgcggacgcgtggggcctgaaacagcactccagaatagagagaatgagcaactgaaaagtagccgcaatgagtacctcaaactgaaggcacgtgttgataatttacagcggactcaaaggaacttgcttggtgaagatcttgagtcattaggcataaaagagctggagcacctggagaagcagctcgattcgtccttgaagcacataagatctacaaggacacaacacatggttgatcaactgacagaacttcagaaaaaagaacaaatgttttgtgaagcaaataagtgtcttcgaagaa

SEQ ID NO: 48539 - DNA, 348 bp, Zea mays
  Clone ID: LIB3067-010-Q1-K1-G12
cccacgcgtccgcccacgcgtccggggagatcagcgtgctctgcgacgccgaggtcggcgtcggcgtcttctccagcgccggcaagctttacgactactgctccccgaagacatcgctatcaaaaatcctagagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgatgaggcacttgataatggactgacgaacctgaatgagaaactgatgg

SEQ ID NO: 48540 - DNA, 88 bp, Zea mays
  Clone ID: LIB3067-005-Q1-K1-F7
ggtaaacccgctagctgtgtaatcttgtttagctatcatgtatgcttgttactgcccagttacccttgaatctagcggcgcttttggt

SEQ ID NO: 48541 - DNA, 100 bp, Zea mays
  Clone ID: LIB3067-049-Q1-K1-C4
cgggtaaacccgctagctgtgtaatcttgtccatctatcatgtatgcttgttactgcccagttgcgcttgaatctagcggcgcttttggtgagagggtgc

SEQ ID NO: 48542 - DNA, 396 bp, Zea mays
  Clone ID: LIB3067-046-Q1-K1-E10
ccgaggtcgcgctcgtcgtcttctccccgctcggcaagctctatgaattcgccagcggaagtgcccagaaaacaattgaacgttatagaacgtacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagactcagctgctggaggagcaactccataagctgaaggagaaggagatgaatctgcgcaagagcaacgaagatttacgtgaaaagtgcatgaagc

SEQ ID NO: 48543 - DNA, 421 bp, Zea mays
  Clone ID: LIB3067-005-Q1-K1-A5
ggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcatgcccagatactgctgtacagaacatagagaacgagttagtccagaacagccgcaatgagtaccttaaactgaaagcaaaggtggataatttacagaggactcaaaggaatttgcttggtgaaaatctgggttcacttggggtcaaagagcttg

SEQ ID NO: 48544 - DNA, 456 bp, Zea mays
  Clone ID: LIB3067-029-Q1-K1-C1
cccacgcgtccggcctgcagctggggttagctgcaagggttgggagccatggggaggggtcgggtggagctcaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcatcaccaaaacacttgagaggtatgaaaaaaacagttatggaggaccagatactgctgtacagaacaaggagaacgagttagtccagagcagtcgtaatgagtacctcaagctgaaagcgaaggtggataatttacagaggactcagaggaatttgcttggtgaagatctggggtcacttggtgtcaaagagcttgagcagcttgagaagcaacttgattca

SEQ ID NO: 48545 - DNA, 448 bp, Zea mays
  Clone ID: LIB3067-029-Q1-K1-D1
cccacgcgtccggcctgcagctggggttagctgcaagggttgggagccatggggaggggtcgggtggagctcaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcatcaccaaaacacttgagaggtatgaaaaaaacagttatggaggaccagatactgctgtacagaacaaggagaacgagttagtccagagcagtcgtaatgagtacctcaagctgaaagcgaaggtggataatttacagaggactcagaggaatttgcttggtgaagatctggggtcacttggtgtcaaagagcttgagcagcttgagaagcaac

SEQ ID NO: 48546 - DNA, 404 bp, Zea mays
  Clone ID: LIB3067-049-Q1-K1-C2
cctgagtcctgcctgcgctcgcctcctttcttcccccccggccccttggcttttgcttgggggcgatcgggccggtcgagccggagaggccggaaaagctagctagctaccagctctccggtgtggtagtacgtctgcctgcagctggggttagctgcaagggttgggagccatggggaggggtcgggtggagctcaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggaaagctcttacaagttctgcagcggacagagcataaccaaaccactggaaaggtttgaaaaaaccagttttggagga

SEQ ID NO: 48547 - DNA, 457 bp, Zea mays
  Clone ID: LIB3067-031-Q1-K1-H5
gagccagcttatggtcgagtcaatttcagcgctccaacggaaggagaagtcactgcaggaggagaacaaggttctgcagaaggagaaagcgttactcctgcatgcagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaagtttgccctcaccgtcgcgatgtgatagcccaaaatccagcaagtcttccccggaccccggactgtccccgcttctccgtctggtgcagtatcgtcgtgatcgcgagaagcagcagcagcggt

SEQ ID NO: 48548 - DNA, 425 bp, Zea mays
  Clone ID: LIB3067-030-Q1-K1-E9
cggacgcgtgggcggacgcgtgggcggacgcgtgggacagaacttcagaaaaaagaacgaatgttttgtgaagcaaataagtgtcttcgaagaagactggaggagagcaaccaggttatatggcagcatgcgtgggagcaaagcgagcggcattctgaagtgcagccgcagcagctcaatggcaataacttcttccatcccctcgatggtgctggtgaacccacccttcagatagggtatccttcagaggcactgactagctcatgcatgaccaccttcctgcccccgtggttgccatgagatcgaactactgcgcaattccgaattaataagcatggccgcatgcagctgcctgtgctatacgttgtgcttggagtgtactttaaggttcttgcatggccagtatgtgtgtaacatttgtgatg

SEQ ID NO: 48549 - DNA, 329 bp, Zea mays
  Clone ID: LIB3067-002-Q1-K1-B10
ataaagatgcgatggcagaatcatattgtactgcaagagtgacaattgtgtgttccagtcacatatatgacctagttttgtgtgtctatatgtcgaaacccatatgtctgtgattttattatatgttatgtaagcacaaatgaaacatgccggactagttgcttttgcttgtctatgtatttgtttattccctttgcctcaaagatccatcttcagggtagccatgccggcatgaagttattcatatgctcgggagcgaacccgatctgcagggttggctctgctgcagcttccaggggatgaaagaataatccctagttctagatcgc

SEQ ID NO: 48550 - DNA, 439 bp, Zea mays
  Clone ID: LIB3067-049-Q1-K1-D7
cccacgcgtccgcttcatgccggcatggctactcctgaagatggatctttgaggcaaagggggtaaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtctatgtaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaataatataaaaaaaaaaaaaaaaataaaaaaaataaaaaaaaggggcgccctttttaaggagccaaattttacgtacccttacttgcaacgcaatagttttt

SEQ ID NO: 48551 - DNA, 426 bp, Zea mays
  Clone ID: LIB3067-059-Q1-K1-C4
cttattgcaagtctctgcaagaacctgctagagaggaacaagctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgactccgtgggaaacctgtcac

SEQ ID NO: 48552 - DNA, 426 bp, Zea mays
  Clone ID: LIB3067-058-Q1-K1-F6
cccacgcgtccgtgctttctatatctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgactccgtgggaaacctgtcactcaaggagctgaaacagc

SEQ ID NO: 48553 - DNA, 316 bp, Zea mays
  Clone ID: LIB3067-032-Q1-K1-B1
cccacgcgtccgcgcagctccaactactcacaagaagtaaaaactccactggacactgaaattaactaccaggattatctcaagttgaggacaagggtcgaattcctccaaactacacaaagaaatattcttggcgaggatctgggtccgcttagcatgaaggagctagagcagctggaggaccaaatagagatatctctgaagcatatcagctcaagaaagaatcaaatgctacttgaccagctatttgatctcaaaagcaaggaacaagaattgctggatctcaataaagacctaaggaagcagctgcaagaaa

SEQ ID NO: 48554 - DNA, 430 bp, Zea mays
  Clone ID: LIB3067-059-Q1-K1-A11
cccacgcgtccggatttctaaagtaggtcagtggtactggattcttttttttaaaaaaaagtatatgctattttctattttctttagaactaggtttgtcggtttgtttggcaaacacgatctatgtactgacctgaactttgtgtattccctttttccaagcaggatctcacgttgacttactctgtttcgttgcgctctttcttttcaaaactagattaactaccaggattatctcaagttgaggacaagggtcgaattcctccaaactacacaaagaaatattcttggcgaggatctgggtccgcttagcatgaaggagctagagcagctggaggaccaaatagagatatctctgaagcatatcagctcaagaaagaatcaaatgctacttgaccagctatttgatctcaaaagcaaggaacaagaa

SEQ ID NO: 48555 - DNA, 440 bp, Zea mays
  Clone ID: LIB3067-060-Q1-K1-A5
ggtctcttgaattgtttttacaagatttaattgaccgtacttatgaaattactcttgaaagtggagcaaagacactgaattccttccacctgaagcaatgtgtgaagaggtacagttcttttgatttcctaactgaagttgtcagcaaggtacctgatcttggtggcgctgattcctgtggagatgaaagaggattacctagaagaagaaagtcaaatggctgtgacccagagaatgatgaatcaagatctagtaaaatggccataagaaatgcatacatcagccccagaggacgtgggaggggtcgaggcataggacgaggtctgccaccaaccaagagaaaggaggttggttatgtacaatttgaagatgagagcagcatgtttgctgaacatggtgagcccttgccaggagaggatacagttcaagagatcaatggc

SEQ ID NO: 48556 - DNA, 442 bp, Zea mays
  Clone ID: LIB3067-003-Q1-K1-D11
cccacgcgtccgcggacgcgtgggggaagcaggggctagacgcggatcggcgagcatgaggggcggcggcggcggcgggatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttggttgagaattggcaggttcattcctgggtgctatacacttgctgtctcggaggagcttccagaagagtatcaagggatttgtcaagacatcaacgtgcagtatgtgccgtccaagcgtgtc

SEQ ID NO: 48557 - DNA, 416 bp, Zea mays
  Clone ID: LIB3067-039-Q1-K1-G12
ccggcttcctcctctacatggagctcggccgcaggctcaagaaaaccaggccggtcgtggcggagatcttctcgctcatgtcaagggacgaggcgcgccatgctgggttcttgaacaaggggctgtctgacttcaacttggcgctggacctggggttcctgaccaaggctaggaagtacaccttcttcaagcccaagttcatcttctacgccacctacctgtccgagaagatcgggtactggaggtacatcaccatcttcaggcacctcaaggcgaacccggagtaccaggtgtaccccatcttcaagtacttcgagaactggtgccaggacgagaacaggcacggcgacttcttctctgccctgctcaaggctcagccgcagttcctcaatgactggaaggccaagctctggtca

SEQ ID NO: 48558 - DNA, 231 bp, Zea mays
  Clone ID: LIB3067-044-Q1-K1-G8
gctgcacgcttgagctgtaatgtggccttgcttaattattctgttgccgttgctactgtatctatatgcgcctatgcctgcgtgcatgaactatgctttaggtggttgctgctccacactgtggtggtgtgcttttgcttttgtgtggtcgtattgtatgcgtaacctgacagatggatccctgattgctacatgtttgaataatttgcatgatctagctagtttctgcct

SEQ ID NO: 48559 - DNA, 436 bp, Zea mays
  Clone ID: LIB3067-036-Q1-K1-B12
cagcaatggcatggcgtcctcaccctcgcccttcttccctccaaacttcctcctccaaatgcggcagacgccctccgatcatgacccccaagaacaccaccaccttcctgctcctccccttcatcttcaccacaaccccttcctcccctcctctcaatgcccctccctgcaagacttccgaggtatggcgccaatgctgcggaagcgcccgacgatgtactgcggcgcggacgacgtcggcgtcggaggcgaggaggcgaactgcggcgcgacgaacgaggacgaggtgtcggacgacggctccctgcaagccggcgggcccggggagaagaagcggcggctgaacgtggagcaagtgcggacgctggagaagaacttcgagctcgggaacaagctggaaccggagcgcaagctgcaactggcgcgcgcgcttggc

SEQ ID NO: 48560 - DNA, 453 bp, Zea mays
  Clone ID: LIB3067-039-Q1-K1-E6
cggacgcgtgggtttttttttttaatatcagaaaatgttggatacacataatccggaaatgaagcttgggagcaacaacactaggactgactgacgcactccgcaaaagtgacacaatcttgagcgagaacacgagctgtgcttaggccagggcagggaactgagcctggtcttcgatcgctggagcagcagctggtccccgataaccgccgttgtaaccaccacggaaccccccacggcccctaccacggccacggccactagggttatagtacctttcgccttcagctggctttaagaactcgttgatgctcatggacttcttgccccgttcttctctttcagcactttctttctttttcaagtccttgtcagagcccagcttgataaacacttcatcgccatcctttttaactgacagttgttgcatggcctgtagctccttgtcaattt

SEQ ID NO: 48561 - DNA, 395 bp, Zea mays
  Clone ID: LIB3067-006-Q1-K1-B4
cccacgcgtccgcttcttttgcagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgctttagaaaaaggagaaagcacttacagatcaaaacggtgtcctgcaaaagttcatggaggcatataaggagaaaaacatggctttgatgaacgcgc

SEQ ID NO: 48562 - DNA, 345 bp, Zea mays
  Clone ID: LIB3067-018-Q1-K1-F7
cgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtggtctgcaaaa

SEQ ID NO: 48563 - DNA, 425 bp, Zea mays
  Clone ID: LIB3067-037-Q1-K1-G10
cggacgcgtgggctgacgcgtgggtccagttctacaagtccatgacggatgctggggacagggaagtgaagagcaaggttactgtcaagggtcacctgcacacctacaggttctgtgacaacgtgtggaccttcatcttgacagacgcaagcttcaagaacgaggaggccacggagcaggtgggcaaggtgaagattgtggcatgtgattccaaattgctcggacaataggcctgtgtaccctcgaggtcaaggaaggaagcttttaagtgcggcggtgcggtgtctgtctgcgcgtcagctgtacacgcctaggctacctgccgaggcggtgtctgtctgcttcagctgtacacgcctaggctaccggccgaaacggatttcatttgccttcttcgtactggatgtgtatcttcatttattttt

SEQ ID NO: 48564 - DNA, 317 bp, Zea mays
  Clone ID: LIB3067-057-Q1-K1-A8
cccacgcgtccgcccacgcgtccgctcagcccggagctcgctatccaggtcctcgtccagggggacaagtccatgacggatgctctggagaaccaagtgaagagcaaggttactgtcaagggtcacctgcacacctacaggttctgtgacaacgtgtggaccttcatcttgacagacgcaagcttcaagaacgaggaggccacggagcaagtgggcaaggtgaagattgtggcatgtgattccaaattgctcggacaataagcctgtgtaccctcgaggtcaaaggaaggagcttttaagtgccgccgggccgggtc

SEQ ID NO: 48565 - DNA, 427 bp, Zea mays
  Clone ID: LIB3067-058-Q1-K1-H9
cccacgcgtccgcccacgcgtccgcccacgcgtccgcccacgcgtccgtgggaaaatgtggccagatgcttctgatactgatgcttcctctcactataagcttccgttctcaagaactgtctacattgagaaaactgattttcgccttaaggactcaaaagactactatgggctggcccctggtaaatctgtcatgctaaggtatgcgttccccataaaatgcacagacgttatctatggtgatactcctgatgatattgttgaaattcgagcagaatatgatcctttgaagacttctaaacttaagggtgttctgcactgggttgctgagccagcacctggtgtcgaaccattgaaggtggaagtaagactattcgagaaattgttcatgtcagagaatcctgctgaattggaggattggcttggt

SEQ ID NO: 48566 - DNA, 434 bp, Zea mays
  Clone ID: LIB3067-040-Q1-K1-B9
ccagaacgacatcgaccttctcaacccgccggcagagctcgagaagctcaagcacaagaagaagcgcctcgtccagtcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggaagggagactagagctgagtctgttattagtactggatcggttgtcaatctccagtatgtggtcttcaagttttgctctgtgccccagacgttagggtcatgaacttccttagctaaggctttccgcatgttgttctgtgctgctatgtatcgcacgttggttcttgctgaacttatagcttgtttggttcgg

SEQ ID NO: 48567 - DNA, 239 bp, Zea mays
  Clone ID: LIB3067-034-Q1-K1-E3
catgtacaccgtcttaagagagttaaatgttagtgcttgcctcctgttagattgaatgggcggtttaaccgagacattcagacaagaagaatgagaacaaggaggttgctgcgaatgactttctaccagcgagcgccgcttatgaagccatacagcactctatggacctgtatgctacatacatcgcttgagggcctgaagaggtaggattctgatggctaggaaaggtcgcgaggatg

SEQ ID NO: 48568 - DNA, 410 bp, Zea mays
  Clone ID: LIB3067-022-Q1-K1-D11
gacccaatggatgtgttggtcctgatgcaggagcctgttgttcctggttcgttcctgagagctagagcaattggccttatgcccatgattgaccagggtgaaaaggatgacaagataatagcagtatgtgctgacgatcctgaataccgtcactacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatcggggcgtgattttaataagccgaatcgctt

SEQ ID NO: 48569 - DNA, 373 bp, Zea mays
  Clone ID: LIB3067-016-Q1-K1-G4
gctcctctccactttccacattccagttccactccgactgcgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttggtgttgagatcacacagggatgcaaagcttaatatgaacttgacaagaaaaccggactgattaagggtgatcgagtcctggacttatcagttgtatacccttac

SEQ ID NO: 48570 - DNA, 428 bp, Zea mays
  Clone ID: LIB3067-029-Q1-K1-C6
cccactctccgaaggactctttgtgaatacaatgacccaatggatgtgttggtcctgatgcatgagcctgttgttcctggttcgttcctgagagctagagcaattggccttatgcccatgattgaccagggtgaaaaggatgacaagataatagcagtatgtgctgactatcctgaataccgtcactacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaagcagtagattgcaagcaacaatttatctatcatgcgtcttggatcggggcgtgattttaa

SEQ ID NO: 48571 - DNA, 442 bp, Zea mays
  Clone ID: LIB3067-047-Q1-K1-H2
ggtggagcttctttgaagcctgagttcatcgacatcatcaacgcggccaccgtgaagggcgctgaagatgttacgctgaagacgaacatactttttttttgctcaactgtgctatgtaagctagtagcttttgcgcaggagcagagactgttttgcctgcccccaacttttagcttgagcttgctaataatgtttacctctggacgtatcaataatggtgcttatgtaccccttttttgtgccgaattacggtggatccgtcatctgaaccatgggtttggtgtatgtaattgcgtcacccgatgcctaaggtgagactgaagtttttggacatttgggacaaggtagccttgtgccccacattggtcgaatgctgccaaaactgtaccggtcatctgtgctccgtacggattagcctgatctgcgaatgcaacttgtcagc

SEQ ID NO: 48572 - DNA, 433 bp, Zea mays
  Clone ID: LIB3067-055-Q1-K1-G8
cccacgcgtccgggatcatttacggaggctctgtaactgccgcgaactgcaaagagctggcagcacagcctgatgtcgatgggtttcttgtcggtggagcttctttgaagcctgagttcatcgacatcatcaacgcggccaccgtgaagtccgcttaagatgttacgctgaagacgaacatactttttttttgctcaactgtgctatgtaagctagtagcttttgcgcaggagcagagactgttttgcctgcccccaacttttagcttgagcttgctaataatgtttacctctggacgtatcaataatggtgcttatgtaccccttttttgtgccgaattacggtggatccgtcatctgaaccatgggtttggtgtatgtaattgcgtcacccgatgcctatggtgagactgaagtttttggacatttgggac

SEQ ID NO: 48573 - DNA, 427 bp, Zea mays
  Clone ID: LIB3067-059-Q1-K1-D10
cgcaccccaatctaatcgacacctcgccgtgatgggccgcaagttcttcgtcggtggcagctggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacactt

SEQ ID NO: 48574 - DNA, 457 bp, Zea mays
  Clone ID: LIB3067-027-Q1-K1-B10
aaggttgcgtatgccctgtctcagggactaaaggtcattgcatgtgttggtgagacagttgggcagagggaggctgggtctaccatggaggttgttgctgcacaaacaaaagcaattgctgagaagatcaaggactggagcaacgtagttgttgcctatgaaccagtttgggctattggaactggtaaagttgccaccccagctcaggctcaggaagtgcacgccttcctgagggattggctaaagaccaacgtcagccctgaggttgctgaatctactaggatcatttacggaggctctgtaactgccgcgaactgcaaagagctagcagcacagcctgatgtcgatgggtttcttgtcggtggagcttctttgaagcctgagttcatcgacattatcaacgcggtcaccgtgaagtccgcttaagatgttacgctgaagacgaacatactttttt

SEQ ID NO: 48575 - DNA, 404 bp, Zea mays
  unsure at all n locations
  Clone ID: LIB3067-034-Q1-K1-B7
acttgagcagagggaggctgggtctaccatggaggttgttgctgcacaaacaaaagcagttgctgagaagatcaaggactggagcaacgtagttgttgcctatgaaccagtttgggctattggaactggtaaagttgccaccccagctcaggctcaggaagtgcacgcctccctgagggattggctaaagaccaacgtcagccctgaggttgctgaatctactaggatcatttacggaggctctgtaactgccgcgaactgcaaagagctagcagcacagcctgatgtcgatgggtttcttgtcggtggagcttctttgaagcctgagttcatcgacatcatcaacgcggccaccgtgaagtccgcttaagatgttacgctgaagacgaacatactnttttttt

SEQ ID NO: 48576 - DNA, 314 bp, Zea mays
  Clone ID: LIB3067-032-Q1-K1-E5
caggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaa

SEQ ID NO: 48577 - DNA, 402 bp, Zea mays
  Clone ID: LIB3067-045-Q1-K1-E5
cccacgcgtccgccctcgcgtctttgcgtacgaggacggcttctagtccctcgcctaccccgcccccgaacctggcgtctgccctaccaaccgcagcagcgacactagaatggccgcggcgccgtcatccctcgcgtcctcccacctctccccaatcgcggcggtgtccactcccgccgtcccacatcagcttcgcatcggctgctcccgccgacgcgccgggcgcatcgttgccatggctggatccggcaagttcttcgtcggaggcaactggaagtgcaatggaacaaaggactccattagcaaacttgtctctgaattgaatgctgctacccttgaaactgatgtagatgttgtggtggcaccctcatttatctatattgatcaggttaaagaattcac

SEQ ID NO: 48578 - DNA, 402 bp, Zea mays
  unsure at all n locations
  Clone ID: LIB3067-044-Q1-K1-C8
gacccactcgttcggttctatcttactattgaagcgtttgattgcaataccaagaagctnnatgaagctaaggtctggtagaagccatgggagaacttcaagcagctgcaggaattcaagcctgttgaagagggtgctagcgcctaaggatctgtcgtctccctgtgcaatttgctgcctgaagcgcaaaactaagttacagaataaggagctgcttcgtaacatgccagagcatgcaccctcgcgtaatttcataaaatcacagggctcttaatgtaatatcttgaattgccgtgccatgtgtaataagtaatatcatgaataacagttgctattatgggttctaaaggtttattaacagccatccatgggccatggcagaattctcatattaacttgttg

SEQ ID NO: 48579 - DNA, 351 bp, Zea mays
  Clone ID: LIB3067-044-Q1-K1-C9
acccacgcgtacgcggacgcgtagggcggtcgcgtgggcggatgcgttggccaaccagagcaaaagccaaacggaagcggcacgcgtaacaggaccaacaaagggaggagccaccagagcgagaacagcatcaccgactgcaagagcgagggcaataccggcgggtactgcaagctcggggctagcatgtgcaccaaagagtgtgaccgaagtactgacgctgctggtgctaataaagccccacagcagcatttgagttgatgagtagtaaagaagaacgcttttgttatgccagcgcaagctctagaattcgaggccgagatgaccaaaaataaatgattttgttactct

SEQ ID NO: 48580 - DNA, 116 bp, Zea mays
  unsure at all n locations
  Clone ID: LIB3067-044-Q1-K1-D1
accacgcgtccgcgaggaaaatggactactacatgnaccataggattacacgcccaaggctcaggcagccggggcgggtgaatcaaacatggccacggacatgctcaagaagaacc

SEQ ID NO: 48581 - DNA, 412 bp, Zea mays
  Clone ID: LIB3067-044-Q1-K1-D10
ggttcacttctccagttaaagtgttcgtattcattgcgccgccgcagccaaagtcgggcctcttcgttggcatcaacaagggtcatgtcgtcaccaagcgcgagctgcctcctcgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggccggcgtcctcaggaagatgaggtcggctggtacgcacactgacaagaagaaatagagagcatttcaaggtcatggaacctgccaaagattatgttccag

SEQ ID NO: 48582 - DNA, 300 bp, Zea mays
  Clone ID: LIB3067-044-Q1-K1-D11
gctgcagatgcctgtttagctgctcatttgggttcagctctcgcatgttgagtatgcggtaatgactactatcagtactgcgaaggataatcccataagcgatgcggctattcgcatcctatgaaggtgttactggaaatgcttacgatgcataaatgcatggtccgcacatgatggaggcataatacctatggtatgacttgactggagtggtcgtctccagaagcagacctggtctggcaaggacgatccctgagctggacaaaaacatgtatggagacatcgtcgatgtgtgtgact

SEQ ID NO: 48583 - DNA, 186 bp, Zea mays
  Clone ID: LIB3067-044-Q1-K1-D12
ccactcgtccgcgttcgcgtgggcggtcgcgtgggtgattatgtttgtaccgcgttagacccggaaggccggaagattgtacacgcggcctgatctggaaatggtactctccatcgggtagggtggcgggcataacagactcatataaccagcttgctcaacttaatctgtctgtcctgtatcaga

SEQ ID NO: 48584 - DNA, 266 bp, Zea mays
  Clone ID: LIB3067-044-Q1-K1-D2
cggtacacatttgctgtatcgtgtagatctgattgcaggccaagcaacaaagtgacgtcaggacacgccatctggggaaacataaactgatgcgacgcgatggcctgtaatgtgttgttgggatctagactagatgagatttatttaatgtaggtgcttcgttgatcatgtattatgttatgtaatagacgctttgctgtatcgagatgcaggcttgcagcttggcaacctggccgaatttgggcagtttctttcatgcttctttt

SEQ ID NO: 48585 - DNA, 317 bp, Zea mays
  Clone ID: LIB3067-044-Q1-K1-D3
cgaccacgcgtccgctttactctacagcatctactgtaaaagcttgcattacacagcagcagctgctgccatggaggcgtgtagatctctcctcgcgagcgtcgtgctcgccgtgctggccgcgcaggccttggtggccgtggtcgagtccaggaccggccccgtggagcacgcgagccaaggtgacgacgtgaagaagccggactgcgtgccggggatagacccgcgctcgttcccgggcaccggcggcggccacggcatcacgcccgtgacgccatcgcacggaggctccagcttctcgacgccgtcccacggcg

SEQ ID NO: 48586 - DNA, 389 bp, Zea mays
  unsure at all n locations
  Clone ID: LIB3067-044-Q1-K1-D4
cctacgcgtccggactggactagacttttacatgctgacacggccgagaagcagcttgcattgcatgcgtagtacgtacccagcagcagctagcactagcagtccatcggagcgacgatggtgagaaggacggtgctggcggcgctgctggtggccgccgccctcgccggcggcgcgcgggcgcagctcaaggaggggttctacgactactgctgcccacaggcggagaagatcgtcaaggactacgtgaaggcgcacatactccacgcgcccgacgtcgcctncaccctgctccgcacccacttccacgactgcttcgtcaggggctgcgacgcgtcagtgctgctcaacgcgactggcggcagcgaggctgaaaaagacgcggcgcc

SEQ ID NO: 48587 - DNA, 330 bp, Zea mays
  Clone ID: LIB3067-044-Q1-K1-D5
cttaaccctcgttcctctagccttctcgtgcagccacagcctccatttctcctccgacggcggtgctgctagctcaaccatggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaagaccctaacaccatcttcgtcgtcaagtttcgcacacacttctgtggaggcaagtccactggctccggcctaatctacgataa

SEQ ID NO: 48588 - DNA, 392 bp, Zea mays
  Clone ID: LIB3067-044-Q1-K1-D6
cttacgcgtccgctgttgacttttggtttacctgccgaccgccaggaccacgctctactgatacttggcatccatcacctggcacacaccatcagacgaaatcacataagtcgcgtgcttgcattcccagcccatccgaagcgaagcacgccaccggcctcgaagggatcagcttctctagcactcatcatcgtggcctcgctcctcctcttctataacggactgcgtctgagtggagatacgcgccgacatagaccgactatagcgctcgctgcctacgattgatggcctcaccttcaccaaccgagttcactagggaagcagctcgtcagcctctcatcgcaatctaccagaccattccggagacaccttgatccgagactgataaggca

SEQ ID NO: 48589 - DNA, 240 bp, Zea mays
  Clone ID: LIB3067-044-Q1-K1-D7
cctacgcgttcgacctcgcgtttggccatacatacggacgcgcagtcgcacattcggcatctagtcctcccgtcgtgacccgtacgcacgatctgcgattggccgacgcccggctcgccctcgtcaacaaaagcacaccgcaagcgagcgaaaccgagcaatagtgacactagaacgcacgggctagctgagcctggatggacgacctgaataatgaagcaactgcgtgatatgcatgtt

SEQ ID NO: 48590 - DNA, 402 bp, Zea mays
  Clone ID: LIB3067-044-Q1-K1-D8
ctagttctagagcgcttcgggatcgctttcggccatgattgatcgcgaacgagcagaggaaatgcaagttaataatgaggcaccactagggtgcctcaagccaaatatttctcagtataactctccagagcagataggtggtgttgaagggtttcctgagaataatgaaaaaaggaatgatattgttgctgcggaaaaaatctgggaggcgactccaaaccaaggccttagcaggcccatctaccgacaagaattttatgcctggccatatatttattcagattatcaaatcgtgcgtcagccactaccttatggttttgacaaccaattttatcagataaatagggaccacggtttccctattgagaacagggttcaatatcttccattcaagatgctccc

SEQ ID NO: 48591 - DNA, 387 bp, Zea mays
  Clone ID: LIB3067-044-Q1-K1-D9
gatggacatcatagatcttgaggatgagtcaattgatgcagagatattgaactcgatggctgttacaaatgaccatttcaagactgcgcttggaacaagcaacccatctgctctccgtgaaactgttgttgaagtcccaaatgtctcttgggaggatattggtgggctggagaatgtcaagagggagctccaggagactgttcaatatcctgtggaacatccagagaagttcgagaagtttggcatgtctccatccaaaggagttctgttttatggtcctcctggttgtggtaaaaccttgttggcgaatgcaattgccaacgagtgccaggctaacttcatcagtgtcaaaggtcctgaattgcttaccatgttgtttggtgagag

SEQ ID NO: 48592 - DNA, 166 bp, Zea mays
  Clone ID: LIB3067-044-Q1-K1-E1
cctacgcgtccgtgatgacggacccagatccaatgacaggagaggaggcagggccgcgggcgcgttcagaattccgagcggcagcggcgctcctaatgcacgcggcacagatgtcccggaggccaatggcaagctcacggccaggcccttggagcatgctagccaa

SEQ ID NO: 48593 - DNA, 368 bp, Zea mays
  Clone ID: LIB3067-044-Q1-K1-E10
cccacgcgtccgccctcgcgtccgaaagtggctatcgaattagaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgacgccgtcgaccccgacgacgccggtgacgccgtcgtcgtcgacgacgccgcgcggcgccggcaacgtgtggcgcagcgtcttccacccggggagcaacctggccaccaagggcatgggcgccaacctcttcgaccggccgcagcccaacttccccaccgtctacgactggctctacagcg

SEQ ID NO: 48594 - DNA, 257 bp, Zea mays
  unsure at all n locations
  Clone ID: LIB3067-044-Q1-K1-E11
ggtatagcatggggtttccatacaaaattagatgccaatcagaagangctggacaagggagaggactaacgaggaggccgggcctcacaaaggagacaacacccgagaagcaaaaaaaaggaaaagaccgcccgcccaaacggcacaaacaaagacacggacggcggcagcaacaagccgacgcacaagacgccctcaacgccaacgacgcgggcgacgccgaacaacgcgacgaccgcaaacaccaccgcggacgc

SEQ ID NO: 48595 - DNA, 275 bp, Zea mays
  Clone ID: LIB3067-044-Q1-K1-E12
cccacgcgtccgccctcgcgtccggctttgtcttcttgaagattgttatcaacactggggtgatgctgagttacgtgtcgaatctcgccttctcgaggccaaggccgtgctcgacaagacgtcggacacgcccgctgaggccgagcagcggctgctcgagatcgaggacgtcgtgatggacagcagcggcgacagcggcgcgtggaaggaggtggcgacgaaggctggcgtacagcgcgtgttggcaacccgggtgacgctgcaagtcttccagc

SEQ ID NO: 48596 - DNA, 409 bp, Zea mays
  Clone ID: LIB3067-044-Q1-K1-C6
gacccacgcgttcggatcgacacttgcattcacgcttttgatacactgctcaagaatagcaagcgagcgcgagtgagctcaaaggtagcctgagcaaatcacttaaacaggtgtcagatcccactctgcctctgagctggaaagggcagaaagcattcaaatctgagtctgacgtcaagaatgaattcaagtcaatggctctgagctttgccagtgccaagaatgccgccatggagatcccacctgaaaactacctcattgtcacaaaaaatggaaatgtgtgcctgggcatccttgatggaacggctgccaagctgagtttcaacgtaattggagacatcacgatgcacgatcagaaggtgatctatgacaacgagaaatcccagctgggaatgggcccgaggggcat

SEQ ID NO: 48597 - DNA, 388 bp, Zea mays
  Clone ID: LIB3067-044-Q1-K1-E4
ctcttccccacgagctcttgcggcggctcggttgcggaattaggaggcaatggggcactccaacgtctggaactcgcaccccaagaactacgggcccggatcccgcgtctgccgtgtctgtgcgaaccctcatggactgatcaggaagtacgggctgatgtgctgcaggcagtgcttccgcagcaatgccaaggacattggcttcatcaagtaccgctgaaatcaggtgggaatggaccatgtggtagaggcgaggttgtagttttatttccagtaatttagatgttttgttcaaaagtctgctagtaaagactgctacgtttatgatggagaacttagccatgttggtcatgttggtcatattgatcatgagttacctatgttgagc

SEQ ID NO: 48598 - DNA, 402 bp, Zea mays
  Clone ID: LIB3067-044-Q1-K1-A9
ctctgtgttggtgtttagatctatagattaggtatttctatgggcagtgcatcaggactcgaatgtagcatagcatcatcggtttttgtgtttcattaattctcatttcaagatggcatctgctggcctaaagccaggggtgcctgttattctacgggagctggagccatcctcagagatgttcaagcaaggagcgtcccttcgagtcacaggaagtctccagtcattcgatgtggagtccgcgactgccaccattcaagactgcagcgtaagtctgaaggttgacacccagcatctgagggatgtcagtttccgcacgaactcggtgtaccaattcattggtgaacttcagatccgcgaagttgatgatgccattctactctcgcgcatctgaaggaacgt

SEQ ID NO: 48599 - DNA, 223 bp, Zea mays
  Clone ID: LIB3067-044-Q1-K1-B10
ccacgcgtccgcgtcgaagaaaaatctttcgttaggtgatgagatgtctggaggaagaaagcaatggagagcaggctcattttgttccatgtgcctgcctgcgcatactgcctctctgtgcaaattggccgtactccatgaatcacactgcaattctaaaaacgcttagcgaaacgagaatgcaacacgtaataaacgaaaaacaccggttggctttacaatg

SEQ ID NO: 48600 - DNA, 207 bp, Zea mays
  Clone ID: LIB3067-044-Q1-K1-B11
cctagcttgaaatgactgaccgtctctatacagccacctaaacttgaataaactggccggggacttaaaacgaatggactggaaaaactgtggctttacccagctgactcaccttgcaaaagatccgcatctagcgagcttgcgaacaagcgaacaggccggaacgcatagggatgcgaacagtagcgcagcatgaagggcgaatgg

SEQ ID NO: 48601 - DNA, 324 bp, Zea mays
  Clone ID: LIB3067-044-Q1-K1-B12
cctacgcgtccgccctcgcgttcgcggatgcgttggcgctggccatgggggagacactggcaatgtcacctgatatcatcaaagggaaccagatggcgtcctcggtgttcgagatcctggaccgtaagaccgacgtccggatcgacacaggtgaggacatcaagagggtcgaggggctgatcgagctgcgcggcatcgagttccggtacccgtcgaggcccgacgtgaccgtgttcaagggacttgacctgctgatgaaggctggcaagagcatggcgcttgtcggcatgagcggctccggcaagagtaccgtgctgtcgctca

SEQ ID NO: 48602 - DNA, 416 bp, Zea mays
  Clone ID: LIB3067-044-Q1-K1-B3
cctacgcgtccgcggtcgcgttggccgttagcgtactctttctctatcgactggcgacgactccgtcaccgtcgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccagagaggccgcgagggagggccccagggaagacagatgaggattgcggagtgcttggttggtgatgaaaccggcatcattgtcttcactgcatgaaacgatcaagtggatggaattaggcctggaacaactgttgaactgaggaacg

SEQ ID NO: 48603 - DNA, 398 bp, Zea mays
  unsure at all n locations
  Clone ID: LIB3067-044-Q1-K1-B5
cctacgcgtccgccttcgcgttttggcattttactttaatcaagtcatggctgctattgggggaaacactgctggtccaggtgatgctgttctcaatgtatacataaatcatgacaagaaatttgcttttgtggagatgagatctgttgaggaagcaagcaatgcaatggccctggatggcattatgttcgaaggggcaccggtgaaggttagaaggccaacagactacaacccttcccttgcagccgccctgggcccaagccagccaagccccaatctgaatcttgctgcagttggcctaacagcaggatctaatggaggactagaaggtccagaccgtatttttgtgggtggcctnccgtattacttcactgaagcgcaagttcgggagttgcttg

SEQ ID NO: 48604 - DNA, 376 bp, Zea mays
  Clone ID: LIB3067-044-Q1-K1-B6
attcatgttgcacaatgcaaaattgactcaagtgcatggggtattacagtgccttgtgtgaacctgcttatctcgtgcggtacagattaaataatggcacgaacacagaggttactttactgtacggccacacatgtctcaatcattctgtagcaatatatggaacggaacgagtgccgtgctaacacacgtcatataatcgactctgtacaacactaggcccgccattgggtgaccgcttcttggttctccaaggtgcagctgtcacttgagagcctactgatcatgattgtcgatacctgcgaatagtttgccggaacatggatcaaggttgtctgcatcagtttgggctgaatggaaaggataattaaaagga

SEQ ID NO: 48605 - DNA, 361 bp, Zea mays
  Clone ID: LIB3067-044-Q1-K1-B7
cctacgcgtccggagttggcgtgtataagtccaatggcgcgccactctttactgttgtgcagtcaatcgagccatcaaaacaaatgtataaacaggatgatggactgggttgttctggcagtagcatggccaatgacgacgaccttgatggctctggtgaagcagaagagtggcagatcctttagacgaggctaagacatgttgggctgaagaaaaaaaaaacttgcattgaaaatgttgtctgaatgccctcgtctgcgtgtgaatagaggggattatttgtgtgatctcggggtggaaatgttcagaacatacactcgtagtcgtggatgataataattaaatgtatttattattccat

SEQ ID NO: 48606 - DNA, 232 bp, Zea mays
  Clone ID: LIB3067-044-Q1-K1-B9
aaaaaaaaaaaaagataaaaataaaaatttaggataccaaaccaaaaaaaaaacaaaaagggacgggccaacaagcaacaaaagacggccgaaacaaaaaacagagcgcacgagacgaacaaggacaaaagaagcaaacccacagccaggaaaaaggccgacgcgacagacaaaagaggaccagaagaccacaaaccgagacagaccagggcacccgcgcgaacaccaacca

SEQ ID NO: 48607 - DNA, 355 bp, Zea mays
  Clone ID: LIB3067-044-Q1-K1-C1
acccactcgtccgagaaaagataaagggtctgtttggaacgttcatttttgataacaaaggaagcaaatcaaaagaaagtgatgcaattggcagcgaacaatgtattgcaacgacttctgaagagctggcttcaatattttcatcaactaactttgctccgccatctgagggaaggaacagttcactacgagatgatgaaaatgctgagctggacatagatgatatcgacattgatgacaacccacagaagccaaaaggtccacatttccctggtctaagtaaagataaaatcagcaagggactccaaacccttaaaggaaagttgaagcccaagactgaagaaatgataagctc

SEQ ID NO: 48608 - DNA, 302 bp, Zea mays
  Clone ID: LIB3067-044-Q1-K1-C10
cccactcgtccgggtaaggatgctacatatgattttgacgttgcttggcacagcaagagtgccaaggagctaatgcatgactacttcattggggagttgaactcgtacccaactcctgagattcctgagatggaggttttcagataggaacacgacacacgatttgccaggaagcttatggacgttgtggtgcaatattggtcgatcccagccgctgtaattgggatatcagctgttgttgccatatagtgtgcgctaacgaagttaaagctgttgtgcatgttcctagctcgttcagatta

SEQ ID NO: 48609 - DNA, 280 bp, Zea mays
  Clone ID: LIB3067-044-Q1-K1-C11
cccacgcgtccgcctacgcgtccgaaataaaataaaaagataccatttccaacaaaaaaaaaaaacaacaagagcagctttaaaagaccaaaaggagccacagcactaggaacaagcaacccaaccacactccgagaaactgatcaagaagtcccaaatgcctcttgtgacgaaaaaggcggactaaaaaaagtcaacagggaactacacgaataaagtgcaaaaaaccgcggaacaaccagagaactcagcgaaccatgacacgactactcacaaagga

SEQ ID NO: 48610 - DNA, 296 bp, Zea mays
  Clone ID: LIB3067-044-Q1-K1-C12
acccacgcgtaccgcccacgcgtccgcccacgcgtccgcgcatgacataccaccctccgccccccgccgggcgtgcagggtggacgacaccacggccggccgaacgaacaccgccactgcacgactccacgcaagaccgcaatcgcaagagacgagcgttgcgccgcgcaaaaaccgggacgtgacgaaagccgccattgacagcatggccaaaggcacctcaatggatgatgatgatatcgagaagaccgatgcatctgccaagaaaagcaagaaaaagaagaccaaaaccaaag

SEQ ID NO: 48611 - DNA, 323 bp, Zea mays
  Clone ID: LIB3067-044-Q1-K1-C3
gttatgggtgctacataccggccaaacatcatttatcctgctcttagaagatttggaaggtttgaccgggaaattgacattggagttcctgatgaagttggccggcttgaggttctccgtattcacactaagaacatgaagctagctgaagatgttaatttggaactcatttcaaaggatacccatggatacgttggtgctgatcttgctgctctttgtactgaggctgctcttcagtgcattcgtgagaagatggacatcatagatcttgaggatgagacaatagatgcagagatattgaactcgatggctgttacaaatga

SEQ ID NO: 48612 - DNA, 372 bp, Zea mays
  Clone ID: LIB3067-044-Q1-K1-C4
aactacgacaccccctcccttcctccgtccatcgcctccccaaaatccgacgcgtaatcccgtcaggccgccgccggcaagctcctcctcctggtcgccgccgtcctggcggcttccctcgtcgccgacgcgcgcccgtgcggccacgcgcagacgctcctcgtctccttctcctccgtcctcaggccgaacccggaccccaccaacccgacgccgctcaccaccacagtcgtcaccgtcctccgcgtccgccgcctcggcccgcaccagatccgccgccccgtggcgctccccgccgtcgagtcggaggtcgccgcctcgtccgcccaggaccgcgccaaggacatcctcgtcgtcgtcttcggcctcctc

SEQ ID NO: 48613 - DNA, 406 bp, Zea mays
  Clone ID: LIB3067-044-Q1-K1-A8
cctacgcgtccggcctctaggattcgattggcctgtatgatggtcacttcacaacatcggctctctctgggtttgtccgtgctcagggcgatgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatctttgttgggttccttctgagtttgatgtgtggtgttcgtttaattcccttgtacaaccccatttagtatcattgtgatgattttggattcaatcttgctcgagtcagggtacgattccaataaaaatataaagaggaagaaa

SEQ ID NO: 48614 - DNA, 405 bp, Zea mays
  unsure at all n locations
  Clone ID: LIB3067-044-Q1-K1-C5
atttgacagtggtagtacctattctgattttactgctcaaccataccaagctgttgtttctgcgctcaaaggtggtctcagcaaatcacttaaacaggtgtcagatcccactctgcctctgtgctggaaagggcagaaagcattcaaatctgtgtttgacgtcaagaatgaattcaagtcaatgtttctgagctttgccagtgccaagaatgccgccatggagatcccacctgaaaactacctcattgtcacaaaaaatggaaatgtgtgcctgggcattcttgatggaacggctgccaagctgagtttcaacgtaattggagacatcacgatgcangatcagatggtgatctatgacaacgaggaatcgcaactgggatgggcgcgtggggcatgcactaggag

SEQ ID NO: 48615 - DNA, 321 bp, Zea mays
  unsure at all n locations
  Clone ID: LIB3067-043-Q1-K1-H1
gtcagggagaggcttataattcttgttgttttnttttaacaagggactggccttgttacaactctgctactaggctggagcctggagggagggacgatgatccatcagatgggctatgttactctgtagatcatcgagatgttaattaggtctcttgtgcagtgcagctcagccaattagcatcttctttcactttttgcctttttgcgctgttacttagatcattatcgttcgttaatagcggtgctaatgagatggcaaaaaattnaaataaagttttctaagaaattaagtaaaaaaaatataaaaaaaatgggcggc

SEQ ID NO: 48616 - DNA, 421 bp, Zea mays
  unsure at all n locations
  Clone ID: LIB3067-043-Q1-K1-H10
atctcctcgcatttcttcccatccctttttgcaacccaaaccccaactcgccccgcatcgatggcgcccaaggccgagaagaagcccgcggcgaagaagccggcggaggaggagcccgcggccgagaaggcgcccgccgggaagaagccgaaggcggagaagcgggtccccgctggcaagtccgctgccaaggagggcggcgagggcaagaggggcaagaagaagggcaagaagagcgtggagacctacaagatctacatcttcaaggtgctgaagcaggtgcacccggacattggcatcttctccaaggccatgtcgatcttgaactccttcattaacgatatcttcgagaagctcgctgctgaagccgncaagctcgcgcgctataacaagaagcctaccatcaccttccgtgagatcc

SEQ ID NO: 48617 - DNA, 306 bp, Zea mays
  Clone ID: LIB3067-043-Q1-K1-H12
gacccactcgtccgtaaaattggaacgatatagagaagattagtatggcccctgcgcaaggatgacacgcacaaaaagagaaatggacccaacattttctatagtcgattttggtaaaaaaaaaaaaaaaaaaaaaaaaaaaaaaaaaaaaaaaaaaaaaaaaaaaaaaaaaaaaaaaaaaatgaaaaaaaataaaaaagaaccaaaaatttgtactactttaatacaacttaaaacaatataaatggtaataataaaattaaatttattggctttgatttttataatttaataaattgataaaac

SEQ ID NO: 48618 - DNA, 290 bp, Zea mays
  Clone ID: LIB3067-043-Q1-K1-H3
cggacgcgtgggcggtcgcgtgggcggtctcgtgttcggacgcgtgggtgggattccacatcttaagtggttcggggtggaggggcagtacaatgtcatggtgattgatctgcttggtccaagtctggaggacttatttaactactgcagcagaaagttctcccttaaaacagtactaatgcttgctgatcagatgatcagtagagtagaatacatgcacacaaggtgtgttctacatcgcgacatcaagcctgataattttctcatgggtttaggacgtaaagcaaacc

SEQ ID NO: 48619 - DNA, 205 bp, Zea mays
  Clone ID: LIB3067-043-Q1-K1-H4
gcctttgcttaaggtttttctaccttgttagaacatatttgtggttagaactttgtcagaactatgtgcaatatgtttgaatgcttcaaacctttgtggtgaaacctttgtatgttgaacctctgttgtggaagaactagtgtgctggaattgtgtaaaaaaaaaaaaaaaaaaattaataattaattataaaataataaataga

SEQ ID NO: 48620 - DNA, 350 bp, Zea mays
  Clone ID: LIB3067-043-Q1-K1-H5
caacactctccccagctcgagttaccatttcgagaaccaatcaccaagcaaaagcccgagaaggatagaacaaacaggagacagatggcggctgcagcgaaggcgtcgtggatggtggcgatgagcgtcggggccgtggaggcgctcaaggaccaggcgggcctctgccgctggaactacgcgctgcgctccgtccaccgcgccgtcaaggccaacgctcccagcttcgtgcaggccaggaaaaagctggcgctcgccgtcgcggacaaagccgtcgctgaggatgtgatgaagaccgtcatgtaccttaactgcttgggccccaactagctagggcctctgctagtttc

SEQ ID NO: 48621 - DNA, 162 bp, Zea mays
  Clone ID: LIB3067-043-Q1-K1-H7
cgacccactcgtccggtctagctttgtgtattgtaattttaattggtatacgtagccctatatgtgattaacggcttgactggacctatgagaatggtaagtttatttacgtggggtatggaaacatgaacattaatgaatgtgcaaatgggttgaggtcct

SEQ ID NO: 48622 - DNA, 444 bp, Zea mays
  Clone ID: LIB3067-043-Q1-K1-H9
gccctgtatgttgttgtagtgttctggacttctggtcaacttggtatgatttaaaactaagttcgggcataatcaggaaagtgaagcagccagctcaaatgaagaatggtgtatcttggcgctgaaacgattgaaagaggcctctccgttagctttgaaggtctcactgcgatcgatacgcgagggtagatatcagacacttgatgagtgccttgtccgtgagtaccgcatgtccatgaatggaatctcaaagcaattttctcatgaattctgcgagggagtcagagcacgactagtcgacaaggacttcactcctaagtgggatcctcctgcccttgagtatgttacgaatgacatggttgacgcatacttcgcacctcttggcgattcggagcctgagttgaagctgcctatagaatcgcgagaggcatttgtatgatcaca

SEQ ID NO: 48623 - DNA, 220 bp, Zea mays
  Clone ID: LIB3067-044-Q1-K1-A1
acccactcgtccgcctagctcgatcgagttcactctcagcatgacgctcactcttgcagctccacccttcagtcagttttaggctcttagctgtaggctctatctagccgcgccactccttcgtgtagccatcagccttctcatcgccaccaatggccactgccgaggtccagaccccgaccgtcgtggcggccgaggaagcgcccgtggtggagacccc

SEQ ID NO: 48624 - DNA, 329 bp, Zea mays
  unsure at all n locations
  Clone ID: LIB3067-044-Q1-K1-A10
cccacgcgtccgcccttgcgtccgaccatgcgtancggctaacaacgaataccggcttgctctgaatgttgcttgtcatcatagctgtttttgcggtggttgtggtgatgctagcgatcgcctgcttgtcaaactttaccaagtccagtaagaaatgcaagagcgaatagctgtgagctgcataggagaaacgaagattcggtccagctataagctggatttcacactgaccagtgatcacctatgtcaaaccatgcctctgagcaggcaagagccagattgcaccacagcattaagcaatacactgcgtagtgcaatttgcaaagcgc

SEQ ID NO: 48625 - DNA, 265 bp, Zea mays
  Clone ID: LIB3067-044-Q1-K1-A11
cagacagacactaagaagatatctgcagctgctttatatattgagacaatgtgttacagatgggatgaaagcaccggattgattgatgactatcagctggagaaaagcgctgttctttttgggccaaagttgatcagcgctggtgcaagtgcatatgctcggctatatgattatgaccgtatgcggatggtatgcctcaagcagatggcactacttctagcagacttggcacatactgtgtgggctagctgcagctggcgtagac

SEQ ID NO: 48626 - DNA, 301 bp, Zea mays
  Clone ID: LIB3067-044-Q1-K1-A12
gctcaaccaatatggtttgctcactgaatcagatcttgtgacagagcatatatggtcgcttcccaagtacagcagcagaaggcagggggacataaaggagaggttgaagaatgcatactatgctcttcacaaggagtttaggagcattttcgaaagcattgtgacagatcaaacagagatctctgatgatgagaaaagtcggttttacgagatgaaggcctccgcttggtaccaggtaacctaccatcctgaatgggtccagaagtcaagggaaatgttcaagtctgactgtgaggacatg

SEQ ID NO: 48627 - DNA, 364 bp, Zea mays
  Clone ID: LIB3067-044-Q1-K1-A2
ctgattccagggaagttagactgaaaggtggcctagatgatctccaaaagcggcatcaagcccggtatcttggctataatgaactggttacacaagtgcctgcgtctaccagaccgtttataagacagatcgaagccctgcatgagacaactgctcaaacggcagaggctagggctgatgcggagagaaccttagactgtagcctacacgaagcacaagctgaagctgctgcttcagaagaaggagcagactgtagatcagagagtgtcacagagattattacggataacagtcctggagaccgagattgcaactcttagaacagagcatacacagctgaaccgatctctggaaaaggagaggc

SEQ ID NO: 48628 - DNA, 417 bp, Zea mays
  Clone ID: LIB3067-044-Q1-K1-A4
cccacgcgtccggatggactgcagtatgtggagttgaagctctaccttgtattgcactatctacacttagtgcctcagtgatgcataaactacgaccgcagcctgcatgggatcgtacctgcactgcagcagctgcagctggcctcctctgggagttgagctcgcggcctgagctcattgcatttgggttggaaaagcaagccgaggcggtggagtgctcgttagacaacttgctggatgctctcactgccagacggcttcgtctgggccgatcgataactcggaaacagagacatagtaggaactgcatatagggaaagaagaaactcacagtaacagaggagcatggtgtgccatcaagtggaaggctgatttcattcttttttgtagaactcaggagctgatcattgtcaacaa

SEQ ID NO: 48629 - DNA, 199 bp, Zea mays
  unsure at all n locations
  Clone ID: LIB3067-044-Q1-K1-A5
cacgatcggttccaatcgactttttngttgaatcgcgactaatccaggccgtgtgcgtgtggggctttggactctgctatgcgtgtccctgaattggactctgcgtgttcggcaggctgcaagccgacactgttgcagctgttcggactgctgcagctgcaatccataggagagaaaaatactggagaagcctcagccg

SEQ ID NO: 48630 - DNA, 406 bp, Zea mays
  Clone ID: LIB3067-044-Q1-K1-A6
ctcaacttcctttggtttcaggtttgcttatagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctcttctgat

SEQ ID NO: 48631 - DNA, 326 bp, Zea mays
  Clone ID: LIB3067-044-Q1-K1-A7
cccacgcgtccgggctgaacttacctttggccatactggcaagacagttttgttcgtcctcctaggagtgggggccgtcgttctgttgtcatttttcattttcaagtattggcagaagaagaaaagggaggaacaacatgcacgtctactaaagctatttgaagaggatgatgacattgaggttgagcttggtcttagagactgataatcttcaatgtacagcaagagtatctcggctgaccaggttttgctggcttgccttcagagcattttcacgttaatgtaaagaatttgttgtatttaaacttggtagacccccacaagaa

SEQ ID NO: 48632 - DNA, 324 bp, Zea mays
  Clone ID: LIB3067-043-Q1-K1-G9
aactgtcgtgacatcgtttggacattttctaagaagcaaaagatgacccatagaactgaggcattttgatgccatgtttgatccttatgttaaatgtcggtctccaccaaagatacttgtcatcttgaatcctcgatctggacatggtagatctagcaaagtttttcatggaaaagtggaacccatatttaaggtatgtctagctgagtagaagcatgcatcttatctcaagattggatctgtgttgtcgctactactacgaactttggtatgatctattcatgctttccaatatcatatttattccggttgtttcatacaacc

SEQ ID NO: 48633 - DNA, 369 bp, Zea mays
  Clone ID: LIB3067-046-Q1-K1-C7
cgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaagctatagcccgaaataattgcttccgctggggttttaaaatgtaccaagaaattcctggcttgtcctgccggccattgccagcctgaatttaatggaccccttggcgaaaagattggtggattgacctatggaccttagggggaa

SEQ ID NO: 48634 - DNA, 188 bp, Zea mays
  Clone ID: LIB3067-046-Q1-K1-C8
cggactcgtgggttgatatcatccaagtgaccttttgaactagtttgcgttctgcacttgattacacttggaaaaaaaaaaaaaaaaaaaaaaaaaaaaaaaaaaaaaaaaaaaaaaaaaaaaaaaaaaaaaaaaaaaaaaaaaaaaaaaaaaaaaaagtaaaaagaatactaaacgcaaacatacaa

SEQ ID NO: 48635 - DNA, 428 bp, Zea mays
  Clone ID: LIB3067-046-Q1-K1-C9
cccacgcgtccgagcgttacaagaaccgtgagttgcagaccatgcgccttcttgaccaccgctaatgttgttgctttgaagcattgcttcttttcaactactgagaaggatgagctttatctgaacttggtccttgagtatgtgccggagacagttcatcgagttgtgaagcatcacaacaagatgaaccaacgcatgccacttatttatgtgaagctgtatatgtaccagatatgtagggcattggcttacattcatggcactattggtgtctgccacagagatattaagccacaaaaccttctggtgaacccacacacccaccagcttaaactatgtgactttggcagtgcaaaagttctggtcaagggggaaccaaacatatcgtacatctgctcccgatactatagggctccagagctcatatt

SEQ ID NO: 48636 - DNA, 381 bp, Zea mays
  Clone ID: LIB3067-046-Q1-K1-D1
catcctctgatcacttgtgcagtgcccaaaggatgggatcagggtctcctgggaatgtgcgtcggggaaaagcggaagctgaagatcccatcaaagcttggctatgggcctcaaggctcgccacctactattgctggtggagcaaccctcatatttgacacggagcttgtcgctgtcaatggagaaccaaccaaccaatctgacgagctctagattcatcatacaaatgaatccattcaccttgttactcggaactcagcagatgtcatactatgcaagagatgagccttcattccctgccacttgtatagtgtcgaaaaagagccagcgttggaaatcaaaaaatccgctgtgtataaaaaaaaaaaaaaaaaaggcaaa

SEQ ID NO: 48637 - DNA, 406 bp, Zea mays
  Clone ID: LIB3067-046-Q1-K1-D10
gggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccattcccgctgcggccgtggaggcggctgcggcggctactgtggtggccgtggaggcggcggctacggcgg

SEQ ID NO: 48638 - DNA, 408 bp, Zea mays
  Clone ID: LIB3067-046-Q1-K1-D11
gtcatccacactaacgaacgaactcttgctccgatcacgagctagctgaggtcgacgatggcggctgtgctgaacagcaggaagacgccgcaggtggtggccgtgctggtggtggtggcgctgctggcttcgtccgcgtcggcggcgatcacctgcgggcaggtggggtcgtcgctggcgccgtgcatcccttacgcgacggggagggccagcgcgctcccctcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgtcaccatccccggcaagtgcggcgtctacgtcggattccccatcagcatgtccaccgac

SEQ ID NO: 48639 - DNA, 357 bp, Zea mays
  Clone ID: LIB3067-046-Q1-K1-D12
gctcgctctaacgccgacgcctggtgccgtctgccgaggccttcgctggttactagcacggccccagctccttctaccttttccggcggaggtgaacaccgcctcctctagcgcgccacgatgaggccgatcctgatgagggccacgagcgcccgctgactttcctgcgctacaaccgcgacggggacctcctgttctactgcgccaaggaccacacccccacggtctggtacgccgacaacggctatcgccttggcacctaccgctgccacaacggctccatctgaacctgcgacgtctgccacgactcggcgcgcctcattaccggatccgtcgaccagaccgtcaagctatggg

SEQ ID NO: 48640 - DNA, 433 bp, Zea mays
  Clone ID: LIB3067-046-Q1-K1-D4
tcgtctcgcacatgttttaacaaagggtgactaattccacttatagaatttcgtaaaattaggagaaacataaaaccgaaaagagtgaaacatgaactagtaacgctggtaggatgacaacgcgccgttgtgtttcggctttgggcgacagagagtttgtagccaatggtgctgatgtggttcgtgggctttgtgtatgtgcacagttttacgtatatgttctggtcgtgtaatctatatgtgtatataaacctgtatgggtgttgatgaccatctaaaggtgtcgaaatattcagtagtatatgtagcttaaggcttaaacgggtgtggttataaaggcatttggcgtgtcgatgggaagtattatcatgttattttcaggactcaagagtataaaatgaaataaaatgtgaattcatctgaaaaaaaataa

SEQ ID NO: 48641 - DNA, 323 bp, Zea mays
  Clone ID: LIB3067-046-Q1-K1-D5
gggaaggtgaccatattcagttcattcttcattcatccctcatcacgaaaccaaacaagagacggtgcagcttcaacccacttcaaccctgtaatcaaacaagaaattaggttcaacccatcacttaaaccaaacaaggaacatgtccgacccagcccacaaaaatgggttggtttcgacccaacccacttcattccgaaaccaaacgcactataagataactgagaggatcacagctacttgcacaaattgtttgcaggagttcagaatgtttacttgatctgcggctatttctgtaacctggtcctgaagtctgaattttg

SEQ ID NO: 48642 - DNA, 401 bp, Zea mays
  Clone ID: LIB3067-046-Q1-K1-D8
cggacgcgtgggcggacgcgtgggctggtacatccagagcacttgtgccacaactggcgagggtctgtatgagggcctggactggctgtccagcaacattgcgagcaaggcttgaggcctaccttgaatatcaactgcgaactgactaggagctccgggtgtatcatggaaactcaggacagaatcgcagttgcaacctgttagatgtcttctaccggcactatatatgtttattgcttgatgtgtactgatgttactgttcaacgcttattaccctactatactgttggatgttctttggacctgtttcattcgcacaaagaatggactttcaatgtcatgcttaaaaaaatataatgatttatcttgaaattatcttttacaaatacagttgattatta

SEQ ID NO: 48643 - DNA, 414 bp, Zea mays
  Clone ID: LIB3067-046-Q1-K1-D9
cggacgcgtgggcggacgcgtgggcggactcgtgggcggacgcgtgggcggacgcgtgggcggacgcgtgggggcccgggcctgggcctgggcttcctcgcggtcagcggcgtggtggcgtccctcgcactcctcgtgatctggagcaaggtggttgcggccgttaccgtggcctccttctcactctacctggtcgagtccgtgaggtcgtcctcgctccccaggcggcggccccgggcggtggtgaccgagaggcggcttcccctggacggccgcgggcgcgtctcgccgatccgggaggttgacgcggcgaccgagccgtcgcggccgagctgctgctcggattccgacaggggaagcgacggccgcatgctgctcgtcgaagaaagcagcggcgtcctggacgaatcaagc

SEQ ID NO: 48644 - DNA, 245 bp, Zea mays
  Clone ID: LIB3067-046-Q1-K1-E11
cccacgcgtccgtccactcgtcctcccacgcgtccggcataatttacagctccaatgctatgcgacatgcaaaaggtattaattatgaacacaacatccctgattaatacctcttgcataatttacagctccaatgctatgcgacatgcaaaaatagagagattaatcagggatgttgcgttcataattttgctaacctggtttagcagtatgttggtggacaaaaataatgaaccatggaacaa

SEQ ID NO: 48645 - DNA, 430 bp, Zea mays
  Clone ID: LIB3067-046-Q1-K1-E12
cccacgcgtccgcccacgcgtccgcccactcgtccgcccacgcgtccgatgataatgaggtgctgagtaaggcgatagaggttgctgaggctattgtgaggaacaaccgcaacttagttgtattgtacaaatcggttataaatgatggatttaagctggatttggagcatgctcaagcacttgagaaggaaagaggtcacaactattacaatggaatgacaaaggaacagttcacggatatgcagaaattcatccagggccggagttctaagaaaacaccatcaaagctgtaggttgctggtgacattttctgtggtccgtgtacgatgtacagctactgaaagcgtgttcagtagtctgaaaaataaagatgtcggtgtggcaatatatacagttaccgtcttctcatacttttacgtaagtttatatt

SEQ ID NO: 48646 - DNA, 442 bp, Zea mays
  Clone ID: LIB3067-046-Q1-K1-E2
cccacgcgtccgtggtgaagcttattgaggtctatgaaaatgatcctgagaacatgactaagatttttgacatcatgcaaaacatgcaagaatgtggtcagccccccagtgatcttgtccaagatactgtacctgatctggatctgagcaagttgggacagctgtctcctgagatgcttgaatcagcaccaaattgttgcgtaatgtgaagacaaaaaacattccacttgggattcaattccatgaagtttcttagcctgtacgaaccgccttccccctttctggcttgagtagattcaagataatttccatctggataatctgtaaagccttgcaaatatataatgggctcaatgttctttctggttctttctgttatttttctgtaacacttccgtcgttcctatatacataccttacgtgtcgaaaccccttacgtttt

SEQ ID NO: 48647 - DNA, 217 bp, Zea mays
  Clone ID: LIB3067-046-Q1-K1-E3
gttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactcccttcacaacgccttcagcacctacggcgaggtcctcgagtccaagattatcctcgatcgggagacgc

SEQ ID NO: 48648 - DNA, 497 bp, Zea mays
  unsure at all n locations
  Clone ID: LIB3067-046-Q1-K1-E4
tcgtctcggaaatctcacaagtcagtcccatgggtnctagaatttgtacgtgtcttcataccagtagaccaaagtattatgcgatgtactcatgttggtgaattattatactcagaaggggtgttnnccttacatattaacagctcaactctggctgtannaatggagtagaaatctcgacttcgtccttactgggttggttgggnngtggtcctggagggcttacgtttattcagaaggggcctacctcgtaattcttctgcgcaaanggagaagttggactcaactaattgagaagatcaaagcanttcccttctctcacttacattgctgtgaacaaggatggagaaacattctccaatatttcaccgaacgccgtgaatgcttgtacgtggggtggtttccctggcaaggagattatccagcctacggttgtggatcatgcaagttttatggtttggaaagacgaaacatttgaaatctggactcggggtggg

SEQ ID NO: 48649 - DNA, 439 bp, Zea mays
  Clone ID: LIB3067-046-Q1-K1-C6
cgctcccaggacgccgccgctggggacggcaccacgactgttgtcgtcctcgctggatcgctcctccgccgcgcccagtcgctcctctccgccggggcccacccaaccgccgccgccgacgctctccaccgcctcgcgacacgcgctgttgagatcctccacggcatggccatccccattgagctatctgaccgggaatccctcgtgaagtccgcgtccactgctctcaactctaaggtcgtctcccagtactccacccttctctcgcccctcgccgtcgacgccgccctctccgtggtggatcccgctcaattataagctgctgaaggccgctggtctgtttgcgggatccatcttcctgatgcggaacttcggtgatctgatggccatttagtaagcttatcagcgttgtttacttggatcctatggaatgtgtttg

SEQ ID NO: 48650 - DNA, 422 bp, Zea mays
  Clone ID: LIB3067-046-Q1-K1-A5
ggtggcggagcggaaggcgaaggagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctatggagtgcctgccactgatcctcatcatcaggaacaggctcaagtatgctcttacataccgcgaggtcatttccatcctgatgcaacgccatgtacttgttgatggcaaggtcaggacagacaagacttaccctgctggcgttatggatggcattttcatccccaagaccaatgagaactacaggctgctgtacgataccaagggccgcttacggctttacccaatcagg

SEQ ID NO: 48651 - DNA, 193 bp, Zea mays
  Clone ID: LIB3067-046-Q1-K1-A6
cggacgcgtgggcggacgcgtgggtttggatctgcttgttctcgtgtctctgcttcatctgctttcgcttcatggtactgagtactgacgctgtgaagtggaacaagtactctctcccccaaaaaggccggtagacccaaacatcttttcttgcgggctggtaaagccaaaaatttttaaatgtactcgaacg

SEQ ID NO: 48652 - DNA, 431 bp, Zea mays
  Clone ID: LIB3067-046-Q1-K1-A8
ggctatgtgtgggcttgcaagaactacgatggagatgtgcagagtgatttcttagctcagggttttggatctttgggtttgatgacatcagtgttggtgtgccctgatggaaaaaccatcgaagctgaagctgcccatggcacggttacccgtcatttccgtgtccaccagaaaggaggcgaaaccagcacgaacagcattgcttcgatctttgcatggacaagaggacttgcccacagggcaaagctcgacgacaacgctagactactcgacttcgctctcaaactcgaggctgcttgcgttgagaccgtggagtccgggaagatgactaaagatctggcgattcttgtccatggatcttccagcgtcacgagaagccattacctgaacaccgaggagttcatcgacccattcgttactgagctccgatc

SEQ ID NO: 48653 - DNA, 324 bp, Zea mays
  Clone ID: LIB3067-046-Q1-K1-B1
accacgcgtacggtttgttgcgatgttgccctttcttttacggacagacggtaacagaagttaagtgtcattgtacatattgaagatcgtgtcctattgaatacaatattgttctacggaaaacaaaaatgcactactacccaaatacaacaacgtcagggccttcacggacatcgtcgtcaagactgcgcagaagatcaaagctaataaatagacggcaactaggcccaatatgcctaatgtcgagaacgaaccactcttcacggtggagaagcccaacctgaacacgaaggaccagggcgacacgactgttagagacatgtt

SEQ ID NO: 48654 - DNA, 370 bp, Zea mays
  Clone ID: LIB3067-046-Q1-K1-B10
attgagctctgagcatgcctctgctgtctgcccatctttgtattcacacatgaaaaccttggttggaagcttgttcagctgcatcataagaatccctttttaaaaaataaaaaaaatacaaaaaagaaaaaacataaaaccaaatatgaaaataataatacaatatataacgcactacataacacaaaaacacactactaactaactacaacagatataggatgacaaagcaatgggcaggacgatatgctctacccaagtatccaaccaattatttctatctctaaacacctctatatctgaacccaaatcctcaatgacaagataacttattcaaaacgtactcgtctaaaaacctatattttacaca

SEQ ID NO: 48655 - DNA, 182 bp, Zea mays
  Clone ID: LIB3067-046-Q1-K1-B12
cccacgcgtccgcccacgcgttcgaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaacaaaaaaataaaaaatagaaaaagatgagaatgaacatcaccaccaataatctaattataatt

SEQ ID NO: 48656 - DNA, 375 bp, Zea mays
  Clone ID: LIB3067-046-Q1-K1-B2
cccacgcgtccgcacgccgcaacctccctcgagcccgagcaaacaagggcggacgcggagccggcggcggagcggagatggcggagaagaagcgaggcgccggcactcgcaaggatgaggtggtgacacgcgagtacactatcaacctccacaaacgccttcacggatgcacctttaagaagaaggcaccaaatgccatcaaggagatcaggaagttcgctcagaaagccatgggtactactgatgtccggattgacgtgaagctcaacatgcacatctggagcatgggtatccgcagtgtgcccaagcgtgttcctggtaaaaatggccggaacccggaccaataaggaggaccccaaggaggacctttacttt

SEQ ID NO: 48657 - DNA, 408 bp, Zea mays
  Clone ID: LIB3067-046-Q1-K1-B3
gaagatctgggaatgcaacttactgatgcccttttggacatggaatctgaaagatcaatttggacagcaaaggagaaagaatatgtagaagctaatcatagattgaacatctgccttgatgagaaccgcaaactttcagaagatttgatgaaggtgatgcaagagctagggtgttgtagagaacagtgcaaaacaatggaggataaactggtgctttccatgaagagtgacatgaatgagaaagtaatggaatgcagcgaggcttgtaaagcatccaaccaaattgtggagaaaggaggaaccattcctggtgctgtgcgtgaaaatgagctcgacaaacaactatcgttgattactgaagagcgcaattgtttactctttgagacacaacagatgagatccatggtc

SEQ ID NO: 48658 - DNA, 305 bp, Zea mays
  Clone ID: LIB3067-046-Q1-K1-B4
gttccacgcagcagatcagagagtctgcaggtacgctagcgatctagctgccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggcggtggaggatctggtggtggtggtggtggaagcgggtgggggtgggagtggagggggtggatcgggtggtgggagtggagggcggggatctggtggaggcggaagcagc

SEQ ID NO: 48659 - DNA, 127 bp, Zea mays
  Clone ID: LIB3067-046-Q1-K1-B6
tcttcctaaaaaaaaaaaaaaaaaaaaaaaattaaaattaaaaaataaaaataaaaaaaaaaggaaaagaccaaataaaaacaataaaaaaaaattaacaaactatataactatatcttaattatat

SEQ ID NO: 48660 - DNA, 235 bp, Zea mays
  Clone ID: LIB3067-046-Q1-K1-B7
gcgcttctctgagcagggaggccagcagtttacatttgcgccacggggtccaaatagtggttagcaatttgaacttagcaacgttagatcgttgatggtgatggatggatgtgaagccttctatgtttgctgttttgtaaggtgaataccgatgctgttccattactaggatctatacttggccaaaacaaatgtctaatctgaggtttcgtaaaaaaaaaaaataatagaatat

SEQ ID NO: 48661 - DNA, 369 bp, Zea mays
  Clone ID: LIB3067-046-Q1-K1-B8
tgtaactgcttccaatgggaagacaattgaggtaaataacactgactcagaaggaaggcttgattttgctgatacttttatctatgcttgcatccaatgtgttgataagattattgatttggcgactctgaccgtcgcttgcgttgtctcactctggcctagcatttccggtattttcacgccgagcgactatcttgccaatgaggttgccgctgcttccgaggtatccggctagaagttctggagactgccgctggatgatagctactggtagtctatgaagtctggcatgtctgatatgttcaacactgccgtcaggcttttatgttctatttacctccgtctgttcctgaaccttttcttctacta

SEQ ID NO: 48662 - DNA, 429 bp, Zea mays
  Clone ID: LIB3067-046-Q1-K1-B9
attgagaacccacttactctgttgaatgatccgtcctctgttgagccactgggcaactgtgggaagaaggtcctactgtggtggcttcgtgttgaagcacgggctgatagcaagtttcctgaagggtgggtaattgagccacctttggaagtcgtcgtccctgcaaagcgcactccatggcctgaaacaaccaccgagctgccagccgagttattggatgacaagcaagagcaggaggataggcgcttgtcaagagccaacaaatcatctcggccccgaggcaccacgaagcggaagggcgaccctcaaggacaagataactgatgcagaacgtactggccttgtgatgtatatcttacaccctgcaaaaacacagtagcaagcatatcctgttaatctggcggtgtctgtttaatttttcttttcttt

SEQ ID NO: 48663 - DNA, 435 bp, Zea mays
  Clone ID: LIB3067-046-Q1-K1-C11
gtagacaatgccataacgttcggtgaagccggcgaaccattcaaagttgtccagcagagaccaagcgaagtagccttgcacatttgatcccaagtctattgattccttaagagtagcgatgtggcgctggatgtaatctagccttttgtagtcatttaaggcatcctccatgggtagaggtgtctccttggtatcaacatccccgattccgttctccgtgatgtagataggtgggtttccgtatttgttcttcatgatcataaggagatccttcaagccctcagggtacatgtagatccatggatttcccataggaggaccaatgggcttcccgtcaggcccgttaacttcttgactggcgtaggcgtcgtcagtgttgagcacaggtgagtagtttggtgagatatcgatgtttttggagaaccgtgaggtgta

SEQ ID NO: 48664 - DNA, 427 bp, Zea mays
  Clone ID: LIB3067-046-Q1-K1-C12
ctgagcagtttgaaacagagaggcgagagcaacatttccacacgtactaacaagcgacacttaccagtgttctataaaaaaggataacagtgctggcaagtttgcagggcccggagcctcatctggtgctatttgcagcagttcctggctggctggccggactttgtaaagaaccgcctgagaactatggcggccagttccctgcacagttgccatgcattcttctcactcatgctttctgcgtgcttcaaattagggtcacgcactcacggacctgcggcggccactccttttcatccccttcttcccatggatggttggttggtttcagtgcgtggctacctgcgacttgccaacaatgaagagaaagtcagaagacttcacacacaagagtctctccgggaaagagagaaagggatggcgtttg

SEQ ID NO: 48665 - DNA, 285 bp, Zea mays
  Clone ID: LIB3067-046-Q1-K1-C2
gctactccttgctccacccgtgccctcaaattcgtttctagatcggatgtccatttccaggtatggctacctttataacctaaagcaatatatatatatatacactacctatcaagtactacccaaaattctactgcgtcatccacacccacaaggaaagctacctgcactatggctatgcctattcaattaggcgagcgaccaaaaatgctctagagcggtgtcacttctatcaaagctacatctgtgctccctacctccatgcgctaaactgtctctcatcaa

SEQ ID NO: 48666 - DNA, 360 bp, Zea mays
  Clone ID: LIB3067-046-Q1-K1-C3
tcgggcaagggtctgggcaagggcggcgccaatcgccaccgcaaggtcctgcgcgacaacatgcagggcatcaccaagccggcgatccggaggttggctaggaggggcggcgtcaagcgcatcttcgggctcatctacgaggagacccgcggtgtgctcaagatctttctggagaacgtcattcgtgacgccgtcacctacaccgagcacgcccgccgcaagaccgtcaccgccatggatgtcgtctacgcgctcaaacgacagggccgcaccctctacggcttcggcggctaggtcgcttactcatctggtggcgaactgcatgtgttgtcgccggtggttgtgttgtgtgcctaatta

SEQ ID NO: 48667 - DNA, 449 bp, Zea mays
  Clone ID: LIB3067-046-Q1-K1-A4
cccacgcgtccgatctctacagaaatgggagggattccgaaagaggtggacacagatacaggagtggtgatatgacaaacgaccgggggagaatgaggagcagatcacgttctccaacaaggcatggctatggaagatctggaagtccaaatcattagctgaatatttagatagttttattcacagttgggactcatgagctctgttggaaccctacagtcttgctttttacatgagaaaaaaaaaattctcagttaaactcgtaaggccggtactgaacttaatgtatggataataatgttaccagattaccagtctatagcaggaaaaccttgaccttcaaggtttggggtacacaatttttttaattgccttgagaacctttgttaaaaacttaattctggtctttggcctaaaattttttcaattcttaaggcaagtattttttt

SEQ ID NO: 48668 - DNA, 444 bp, Zea mays
  Clone ID: LIB3067-045-Q1-K1-H11
cttatctgtcgtgcttaccaggttttcttggatgggtatgaattttttgctgacagacagcttgtcaccatattctcggcccccaattattgtggtgaatttgataatgctggtgcaatgatgagtgtcgatgaaactttgatgtgctcattccaaattctgaaacctgctgagagaaaaaacaaatttatggggtccaacaaaatgtgatagtgaaagccattttgcttccagcagctctagcctcttaaggttctcctgtggatgcatcgagacaacagcatgctggcgccaagtttgagggcagcattgggctactatcagagaaaccaaataatcccatacctaactgttcatctggaagttactcatcatgacaagtgcctgaaatttttcctctttcctgttaccttgtgtcagaacattatgtagctgtagatatat

SEQ ID NO: 48669 - DNA, 401 bp, Zea mays
  Clone ID: LIB3067-045-Q1-K1-H12
gaaaatttgcgggcttcactcattaatatgggcgttggtgggcatgcattggaagagataatagataaagtgaagaacaggcattaccagctagcttgcacattaacatttgagaccacacacggtgtctcctgtgattctggaatcaaccatccaaacctatatttcagtgaaagccagaaagttctgcgggccaaaaaccagaaaatggagagccaatcagcaacctaaattgtattgcagctggagaaactatgcatcttcaaaaatcttaccagcaggtaagcactgaagcaatattcatccttgaagccaattatgttatcattactgattgttgaccattggcgtctacctggaatattgttgcttcctgctgttaccaaattccagctgctggc

SEQ ID NO: 48670 - DNA, 374 bp, Zea mays
  unsure at all n locations
  Clone ID: LIB3067-045-Q1-K1-H2
accacgcactctgctcatgacaatgaatcactttttgatattattagtgtaaaggtatggaacttatcaggatatctaggaaatttactgcaatttatgtattttggtatcaattatcaatctgccaatcaatcattttcttttgctttcttcaataaacatttattggcaagacagattagcatgaatgttttgttacacttttttttactgcttgcagtattttctaccttttgaaattatgctntatagttataaactaaacatgtatttatgtaacaatttagttttccagaaacagttttccaatctatttcagaacatgatcttgtaccttgtgaagttttttgttgttgcttgtgcagactctgatg

SEQ ID NO: 48671 - DNA, 442 bp, Zea mays
  Clone ID: LIB3067-045-Q1-K1-H3
catggcttgtatttaggatttgcatttgagcagaatgcaatgtctgctgatgtactgaagaaggcatatgaagctacagaagatggattcttctccattgttaccaaacaatggcctgtaaagcctcagatagcagctgtcggctcatgctgcctggtcggtgtaatttgtggtggcatgctttatgttgccaatgttggggattcccgtgtcgttttaggaaaacatgttaaggccactggagaagttttggctgtccaactgtcagcagaacataatgttagtattgcgtccgtgagaaaagaactgcagtcaatgcacccagaagataggcacattgttgttctcaagcacaatgtttggcgtgttaaaggactaattcaggtttgtagatcaattggtgatgcatatctcaaaaagcaagagttcaacaaggaacccc

SEQ ID NO: 48672 - DNA, 372 bp, Zea mays
  unsure at all n locations
  Clone ID: LIB3067-045-Q1-K1-H4
cgacccacgcgtacgcccacgcgtccgcggtcgcgtgggcatttcacttaccgatgtgagtcttggccggctggttggtgggatccggcggacagcgtcgccaggctgtgttccccccaccctccagccagcctgactcggggtctcgggcaggttccgccgcatcgtgtcgtttcttccctttcccgtttcccccgttcagttcagcttcggttggctcgccgtactcgggtttgttcctcgcctcgcttcgcttncttcctccgcagtcctcgtctcgaattcgctcgcggtgggagaaatcggngcgcgaggatgaccgtgatcgacatnctnacccgggtggacgcgatctgccagaagtacgacagg

SEQ ID NO: 48673 - DNA, 447 bp, Zea mays
  Clone ID: LIB3067-045-Q1-K1-H5
gccggaaaagagaaatcaggagctctcaattcggcgcatagccaagccaaggaaatggcgcactaccaccccgtgtccgcggacacttaccaagacctcgaggctggcttctccggccactcctcctcccctctgaagcccgcggcctcgccgaggcggcccggccgcatgttctgcgacccctgcgacgacggcgacgagctccacggccgccaccactacctcgacatctgcttccggtgccgtaaactcctgtccggcaacagagacatcttcatgtacagaggtgacctgccgttctgcagcgaggagtgccggcaggagcagatcgagatcgacgaggcgagggagcagcggctgaagcagacggggcgggccgagcagcagcggcagcggcagcagaagcagagcccccagaggatccccatctgggcgtggtaggatgag

SEQ ID NO: 48674 - DNA, 403 bp, Zea mays
  unsure at all n locations
  Clone ID: LIB3067-045-Q1-K1-H6
acccacgcgtccgcccacgcgttcgcctacgcgtttgacctgcgtccgcccacgcgtccgcccaccgcctgcgccgccgacaacagcgtagtgtagtgtagttccggagagggttggggagagtagtagtgatccgcaatgtcgacggaggaggctgttgtggctgacgtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcggcgcaccctccctacgctgagatgattgtagaggcgatcgctgccctcaaggagaggaaggngtcgagctcggtggccatcagcaagtacgtcgaggggaagcacg

SEQ ID NO: 48675 - DNA, 427 bp, Zea mays
  Clone ID: LIB3067-045-Q1-K1-H8
cccacgcgtacgaaggaccagatacggcttcatctttgcgttggagctccgccacgtgatgaccaacctcggcgagaagctgaccgacgaggaggtcgatgagatgatccgcgaggccgacgtccatggcgatggccatatcaactacgaggagttcgtcaaggtcatgatggccaagtgagtaaagcctgcggtaacggtatagtacccctcgggaatcgaaggaggaaaccaaaccgtgcatcgcatattagaaaggcaatgcaggtcttgtttccttcgttttccccatgaagaaaccgtactagctgtagctgctgaacgtttgagtccccctgctgccacccttatctccatttgtgtcatcgaaactccgtgcttcccctgctgtgtgaatctgtacggctttgcgtgttctggacactga

SEQ ID NO: 48676 - DNA, 442 bp, Zea mays
  unsure at all n locations
  Clone ID: LIB3067-045-Q1-K1-H9
cccacgcgtccgccctcgcgtccttatnttcacaaaacagccagaacaagtgcggacaatctctccttctgagagtggggcaaatattgacttggacgacgttttatctgctgcgcagacagctgctgaatcagctgagcgagctgcatcagcagcccgtgctgctgcaaaccttgcacaactgcgcatttcagacctgaagaagaattccaaggtttatagcaattacggtgatagcgtccaaaaggaaagccatcatcagactgaggcgacacagaaaccggtatttgatcaccaggactccttcaccaatgatacacatgactatgtgtcatcccatgtgccgcagaggtcgtcatctttggaggacgatccatatttctcgtatcccaacttgttctcagcgccaaagccctgatagcgggaactagtgggctgcaag

SEQ ID NO: 48677 - DNA, 305 bp, Zea mays
  Clone ID: LIB3067-046-Q1-K1-A1
cccacgcgtacggttgcgagtggctacaacaatccgccggaacccacccagcgcggcgcgaccggcgacccgtaccccctagcccggagagcgagagcgacggagctgaccgaggcgcagctgagcacgtactactgcagctacccgtccaagcgcatctacgtatccgctcggggcaggtgctactacatcagctccggccgcagctactacggacgcggcagcgcctacatcgtcttcacaggccgctgagccaagcacgccactcggaacatgtccaatgacgaggcccacgtctaccggga

SEQ ID NO: 48678 - DNA, 405 bp, Zea mays
  Clone ID: LIB3067-046-Q1-K1-A10
accgagcccaaacctctccccttttctccgtcctctcctagtccacacggcagacgccgccgccgggggagaggagaggaggggaggggatcggctccaagggaacaggtgagatggcaatcctgtacgcgctggtggcgcgcggcacggtggtgctggcggagcacagcgcggcagccaccaacgcgggcgctatcgcgcgccatgtcctcgagcgccttcccgacggcggcgccgacagccacgtcttctacacgcatgaccgctacgtgttccacgccaagcgcaccgacggcatcaccgggctctgcatggccgacgacgccgccggaagacggattcccttcgcatttttggaggatattcatggaaggtttgtcaagacatatgggcgggctgcgctaa

SEQ ID NO: 48679 - DNA, 423 bp, Zea mays
  Clone ID: LIB3067-046-Q1-K1-A11
cccacgcgtccgggagcctggcacggcgaacgaatccctgttcagaagctggcgggtgacgttcgagctggtgaacgtggtgaaccaggtgatcaccaacgtgtcgaacaggaacttccccccgcagctgacgcctttctactacatcgcagtcggggccactgatgcctctgctctgcaaccccttcacgcctgatctgagagaccgcatctgcatcagaggagaggttaccttggacaacgcatcccaggtgtggaagaagtacgagtgccagagcaccagcgtctcaggaggagccgagatctgctcgactgtggggcgcgtcacccccagcatctactggcagatgaccgcggtcgtgacggtgagccaggggctgtaccagtacgggcctttcctcatccagctgcatgactgcacct

SEQ ID NO: 48680 - DNA, 429 bp, Zea mays
  Clone ID: LIB3067-046-Q1-K1-A12
cccacgcgtccgcccacgcgttcggcctagcaggaaataaaaaatctgtaagagagaaccaaaaaaaaaaaggagtcaatcgccggcgacgggtacgggtgtacgcttgaggcgatcggcagagaagaccgagaccgacggctccagtgccgctgtcactgccagtctgccacagctagccgcctagcttgatccgccttttgtgctgtgcggatatgagggccgcgcaggtcgatccgttccccgcggcgccgcccaagtcgcggctgaagcgcctcttcgagcgccagctgctgcgggtctcgccggccgagcgcctcccgtcggcgcctcccggtggcggggagaaggatgagctgccggagcctagctcgctgtgcctggacggcatggtgcggagcttcctggaggacggcggcggcggcggag

SEQ ID NO: 48681 - DNA, 59 bp, Zea mays
  Clone ID: LIB3067-046-Q1-K1-A2
cccacgcgtccgaacgaaaggacttatactttgtttctaaaagcttcatgtggatcctc

SEQ ID NO: 48682 - DNA, 58 bp, Zea mays
  Clone ID: LIB3067-046-Q1-K1-A3
tcgatcacgctttcgtgttagtatgccaacgtttatctgccggagaccagacagagag

SEQ ID NO: 48683 - DNA, 282 bp, Zea mays
  Clone ID: LIB3067-045-Q1-K1-H1
cccacgcgtccgcccacgcgtccgcccatgcgttcgcccacgcgtccgcccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagaatcaattttaaaggatcaaaaaattaaaaaaacaataaaaagaaggtaaaaaaaaataaatcgggtaaaacaaattaaataacctggccagtgttaaaaaaacttcatgactggaaaa

SEQ ID NO: 48684 - DNA, 230 bp, Zea mays
  Clone ID: LIB3067-045-Q1-K1-F4
ggcacgcgtgcgggctggcttgctgacatgggattgacctgtggacagacatgcaggagagcggaccgggtatggatgcacgaagggatttacgaagcgttcgtacaagcagtcatgagtgctgaggacagttacaatgtagaagacagtacatatgagagtacatcgattgacgcagcgactgacgaaactgctgagcagaacgtggatgacgcaatttctgacgcagc

SEQ ID NO: 48685 - DNA, 427 bp, Zea mays
  Clone ID: LIB3067-045-Q1-K1-F5
gtctggtcagtcggtttcgtcgttaaagtcatactgagatggaggagaaagaggcctgggttacgcgggtttcggccccagaaacaactagaaggtccatcgcaaatccaacctgcaaaggctgaagacgaatacgatttcttgcacgacggcagaaggcaggccgaagccaggctacagagagcacttgcccgggtgcactctatgtcacagtacccagaagcgagagagcagtaccacaggcttacaacctgcgttgctgaaatgaaacagtccaggatgatgcaggatgagatgctaagccaggcggctggtggtgcggacgatttcatggctggactggaggacttgatctgcatagatgatgccccgccccgatgtctgccattcggtgaagctgagcctttttacatcagataggcaggga

SEQ ID NO: 48686 - DNA, 410 bp, Zea mays
  Clone ID: LIB3067-045-Q1-K1-F6
cggtacgcgtgggagctaccggcctgagctcccccgaccccgagtcccgaggccgacgccattcctgattcctccatcttccgttccgccgcaccgccgccggagatatgtcgaggctcgctgctgccgccctccgctgcgtcgtcactgcatcgagagatacctcctcatctcgcttcgccgtgtctgcgccggtgtctgctcggctcttctccgcggatgcatccggtgaagccgccgccacggccgcagagtcgcaggatgactctttcttcaaggcatcccgcgaaggattagcctatggaaggttttacagtgtcattggtggaagcagtcgtcttgagaagaacatattgaaaactgatattatccatcaccttgacagatgtggattgtcattggatgatgtg

SEQ ID NO: 48687 - DNA, 419 bp, Zea mays
  unsure at all n locations
  Clone ID: LIB3067-045-Q1-K1-F9
catcactaaatctgttctatgcttctgttcgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacggatgaccaacgaggcccttattaccatcgcgaagaaccggcccaacttcacttgcttccgcctatgcatcattgagcctcgcacaccagattacattacacaccagcctcttgatgcangttttagtgccattgtggaatcatgc

SEQ ID NO: 48688 - DNA, 423 bp, Zea mays
  Clone ID: LIB3067-045-Q1-K1-G1
gagggagcttcttctagggggtggagattagtctacaatccgtaggcgtaatctccagacaaaggttgggatgacatctgctgctgaaagtatcaccgagagcctccgacggtctcgccagatgatggttcaggaagtggaaaggagtgcaagtaccttggcaacatttgatgaatcaacaagtgttctccggaaggctgaaggtgaatatcaaggacaccgctctttgctaatgcgtacccgtggtttgctctccacgatgcaacagcaagatgttcttgataggatcatcctgaccatcggctttatcattttctccttggcggttctttatgttgtctcaagacgtattggtctattgacgctgcaaaagaaactggccgatgccatcagatccggttcattatcagccgatgacatcgt

SEQ ID NO: 48689 - DNA, 441 bp, Zea mays
  unsure at all n locations
  Clone ID: LIB3067-045-Q1-K1-G10
tcgggaatggccatgcccttatgtttttnctttacaccctcaacaggaacggctacagaggctttcataaagaagtccaaaagtgcttgagaaacgcacactacctaaaagatcgcctcacggaagcaggaatcggagcgatgcttaacgagctcagtagcacagtcgtgtttgaaaggccaaaggatgaagaatttgtccgaaggtggcagctggcttgtgaagggaatatagctcacgttgtggcgatgcccagtgtcaacattgacaagctagactatttcctgaatgagttagtggacaaacgggcgacttggcaccaggacgggataagccagccaccctgcattgccagagacgtaggtgttgagaactgtctctgtggccttcacaagtagcgagccttttgctttgcaagtgggttcactcttgagtcgagtt

SEQ ID NO: 48690 - DNA, 267 bp, Zea mays
  Clone ID: LIB3067-045-Q1-K1-G11
ggcccgacccactcgtccgcctacgcgtcctcgctcgcgcgcttcatttccaaccctaccacgcgcgcctcgaggggcgcgccttacgacactacgcgggcgccccaaacgcccgcgtagccgacctccgggccgacagcatccgcacgcagacggccgccctaggactacaccacccgctgcggctacgaaacagcaaccgaggcttagttctcccgatcgcgtaccgcgcggtctacagcgacgacagctaccgtggacaccagc

SEQ ID NO: 48691 - DNA, 422 bp, Zea mays
  Clone ID: LIB3067-045-Q1-K1-G12
gtctcttttccagacttgaagatctctaccggtggcggcaggatctgtgccgcgatggcgacgtcgaataccgcgcggatggaggacggcggcggcgacctgcggagcaccatcaagaagtggaacatcatctaccctgtctacctcaactccaagaagacggtcgccgagggccgccgcatcgccgctgccaaggcctgcccggaccccacctgcatcgagatcgccgactgctgttcgcacctcaagatcccccacgccatcgagttggataaggcgtaccctcgggatttcttccaggtggggagggtcagggtgcagcttaagaaagatgacggctcccccgtcaatcctgcgattaaaacgaagaagcagctgatgatccaagtagcagagctagttcccaagcatcacggaaggac

SEQ ID NO: 48692 - DNA, 361 bp, Zea mays
  Clone ID: LIB3067-045-Q1-K1-G2
cgaaactcgagggcttacatgttgaccatgaaatgactatcaatgatccaaaactccttatggagatgatggatatacaggacgctgtcaatgatcccagtgatgctcaaaccctggagaccatccaatctcaggttaacgcaaagctctgaaacatgatgccgattccttccaggaggcatactacaagaaggatcttgaccgcgcataagaaaccacacaaagaatgacgtactatgaacgagcactagaagaaacagtctagaagctctgagcctgtcatctactgttacacctgccataagtggtaaggcatgtatcttttcctacgttcctagtacatcctgctgtagctgacgca

SEQ ID NO: 48693 - DNA, 389 bp, Zea mays
  Clone ID: LIB3067-045-Q1-K1-G3
agccgccaagcacactcaccactctctcttcattacctccatataggccccctacattctttgatcagtgatcactctcgctgggtctcaccccctcccgcagacggccaaacagaacccacgcgtgcgcgcgcgcccacgagcgagcgatgcctcccctccgccgcgcgcgctccatcctgctcctcctccactacgtggccgcctcccacctcctgctgcgcgccgccgcggccacattgccggaccccgcgccgctcgacccggcactggtcgcgaccccggtgcagcccgccgccgccgttccggggggcacgatcccggcgttccccgcgcagtcggactcgctggcgggttcctcgtccacgtgcccgcttcgcccttccccg

SEQ ID NO: 48694 - DNA, 401 bp, Zea mays
  Clone ID: LIB3067-045-Q1-K1-G4
gagccacgcgtacgggcaattagcactattagccacatctcatttttttaggaagaaagcatttctccgaagaagccgacttcgatagcagaggtggcgaagcagcgcgagctgagcggcacacttctgagcgaggacgacagcaagatgaagaagcagatatcggacctgaaatccaaggagctgagcggccacgacatctttgctcctccggaagacccacggccacgcaactcagagaacggctcgacctcgcagaccccgggcaaaaatgcacacgtaagcaacttcaagttcggcgaggccgacgaggacggcatggtgaagaccgcgaagaagatccccacaaagaaaatcaccgacctcgcgggcaatatcttcaaaggcgacgagaccccccc

SEQ ID NO: 48695 - DNA, 108 bp, Zea mays
  Clone ID: LIB3067-045-Q1-K1-G5
gtggatgcggtttattcaaaaattttaaatataaaaacaaaaaaaaaaaaaaaaaaaaaaggaaaaataaaaaaaagggcggtcgatataaaaagaatggggggtcct

SEQ ID NO: 48696 - DNA, 353 bp, Zea mays
  Clone ID: LIB3067-045-Q1-K1-G6
agaagaaccccccaagcaagggttacgctctgcgtgtggaaacaaacgcccgtggatcaccgccggctcgacgcaggaggaggaaggccacgcgccacggcacaggccggcagggcagggcagagagcccatccaaccggctgctgcgtctttttaccttcgtttgttgacgaaaccgaatggcctccctcctcctgatctccgaaagatggagacggagggtttggtttgtgcgtgagtttttgcacggttgcacgagtgaaatggtgtgcgtgctgatcgccgtgtaaaccctgtcgatacggtatgaaacaagcgagaggcctaaacaagtccctctcgaatttctcgtc

SEQ ID NO: 48697 - DNA, 444 bp, Zea mays
  Clone ID: LIB3067-045-Q1-K1-G7
cctacgcgtcctcggtcgcgtgttctctatactgcacaaggcatgtactacaggagggataacagggtcccttcttattcagaccaaacgtcggaagaaatcatgaagatagttcaagatgcaaggaccatgccgaaatcatccagatcaggctatgggtggagcagtgagtattcggatgaagaagaagagaaggaagaggaacacagaccagaggagcatgaggaagaggaagatgaatacgataggagggtgaaggaggtccatgcaagcggagaactccgtatggacgctcttcacatatgaaagctagtggaagagaaagttgcatgtagataactgggttgttgcggatctgaaggatccagtgggatgtatgcagttttggcttgagaacatggtagtctggtgtctcggtgtattaaattatgttacatgaaaatt

SEQ ID NO: 48698 - DNA, 395 bp, Zea mays
  Clone ID: LIB3067-045-Q1-K1-G8
gcacgcgtccgctgacgcgtgtgtcttcccacgtgtccttggacgcctgggcggacgcgtgggcggacgcgtgcacgacgctgacgacctgcgcgcgaccgaacgaccctccgtcgccaccatgacgctgatcgacggggaggacttccagcatatcctgcgtaagctgaacaccaacgtacgataggaagcagaagatcatgttcgacatgacctcaatgaagggtgtcgggcgccgcttctgcaacatcgcctgcaagaaggccgacatcgacatgaacaagagggccggcgagctgacacctgatgagctggagcgcctgatgacagacgaggccaaccctaggcagatcaaggtgccggactggttcctcaacatgaagaaagcatacaag

SEQ ID NO: 48699 - DNA, 395 bp, Zea mays
  Clone ID: LIB3067-045-Q1-K1-G9
cccacgcgtccgcgctcgcgcgctttcgttcctcctcttcctcgcgctcctcgcggggctcgccttcctcctctacccgtccgccccggccgcccgcgtcgccgacctccgtgtcgacagcttccgcgcgcagccgcccgtcctcggcctcggcctcgcgctgcggctccgcgtcagcaaccccggcttcgtcctcccgctccgctaccgcgcggtctccgccgccgtctcctaccgcggacacctgctcggggccgccaaagcgtggcccgggtccggcgagcttgcggccagggatgaggtctatgcggatgctgatgtgtgggtggacgccgggaaggtgctggatgacgtgatcgagctcatcggggacgtggccgcggtgtcagtgccgc

SEQ ID NO: 48700 - DNA, 372 bp, Zea mays
  unsure at all n locations
  Clone ID: LIB3067-045-Q1-K1-F3
accacttatgtcacattcggttttaaaatgcattccgaatgcgaaccatgtacgtgccaggatcagttattcacgtacacagcaggtacataatatggacatcatcacacagtgctcaaaatagtataaaaggggaataatggttgattacatcatacgtctgagacgtccatatagttcttacaataaatcaaagtgcggaaaagaaacgtagataatcgcggncttcacaggcagccgactgggggttgccgctaacccacacctagaactcgtcgtagtcttggaactcctggaagtctcctccacagcttcatcttcgcctgagcagtggttgcaatgctgacaacctggggggggggggtttggtgt

SEQ ID NO: 48701 - DNA, 436 bp, Zea mays
  Clone ID: LIB3067-045-Q1-K1-D9
ggcttccatcaaagcctacatcttatcctatctgtccctcagagatagtcaactcgctgcacaatttcaggaaatccctctggatctgaagatgattgaggcggaaaaggctggatttgagatcctgaaatctactatggtagagaagctccccaatgatctggaaggaatggagtcatcgatggggaagctttacattcttatcgatgagatctacaaatacgtcgatgatgttgtggaaggacgcgtggcacccgacaacagaattggaaggttcatctctgattcttttgcttcggtgccgaaattgtccccggctgctttcgataagcttttcaatgacaagattcaggataaccttgcgctggtatacctgtcaagcatcacaaggacacaaatcagcatcgccgagaagttgaacactgctgctcaagtg

SEQ ID NO: 48702 - DNA, 423 bp, Zea mays
  Clone ID: LIB3067-045-Q1-K1-E1
cccacgcgtccggacctaattgaccaggttgtctctacaatatacactgatataagaggacacaatattcattcgaaccagttctcggtaacggaacattttagggatggaaatgttcgtccgaaaccccaacctggagtttttttcttctatgatttctcacctataaaggtgatattcacagaagaaaatagatctctactccactacctgacaaacctttgtgctatagtgggaggtgtgttcactgtctcgggtatcgttgactcggttatataccacggacagaaggcactcaagaagaaaatggagctaggtaaatacagatgatcaacatcgaccttgtactggccccatcgtttccaagttttgtggcatgtaaggaggggatatgcctgctaaatacgacaagatgccacttac

SEQ ID NO: 48703 - DNA, 446 bp, Zea mays
  Clone ID: LIB3067-045-Q1-K1-E10
atccggagcagccgttttcccatttacttcgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatccctccctgcctgctgcgtgctatgt

SEQ ID NO: 48704 - DNA, 435 bp, Zea mays
  Clone ID: LIB3067-045-Q1-K1-E11
cgcagagctctcatctcctctctttctcgcgctcgctttgcttcctcgtcgaggtccaagttcctgcattgatggcgaccgaggtggctgagactcccgcgccgttggcggaggcggtccccgagacccccgcggaggcaccggcggcgcccgccgccgaggcgaagcctaccaaggccaagaaggcctctgcgcccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccaaggtgaagaactcctacaagctgcccgcacgcgccc

SEQ ID NO: 48705 - DNA, 442 bp, Zea mays
  Clone ID: LIB3067-045-Q1-K1-E12
cggacgcgtgggcggtacgcgtgttggcttctgggccatcgccgccacccctacccaggtgcttcgtcggtcgcttcgccagccgccaggtcttcgtcggcccatcccccggtcttcgtccttcaatcctccggcgacgagcacccaccagaggctgggaactccaaagaggaacagggtccatggctggaggcgcaggaaatggttcgaacgaggcggtgcaggcaaaggggagtgggggtgatagctccgccgccaagccgctgcccccttgctgcgtcaaggcgagagcggcggcgcccgagtctgaggccaagtgccatgccaccgtggtttcgggatggttcaccgagccacgatcacactgcggtaaagccagcaaggttcagtattacaataacccaatgtggccaggagaggcccattccttgaaagtggagaa

SEQ ID NO: 48706 - DNA, 271 bp, Zea mays
  Clone ID: LIB3067-045-Q1-K1-E2
aattattgcatcaatttccacaacctattagcttcatccggtacccgtgttcaataaaaacaaaccgctacaatgtgtgctttctagctgcattaagctgcttactacgagtatttgggctgtggctttctttttcatgtatctcaccaaatcgttattgttgtgagagctatactacacggtggtatcaagagtatcacaatgcccaacaggcgatggattgagctttcctaattttttcatgataaattaagttctattccctccgtcc

SEQ ID NO: 48707 - DNA, 413 bp, Zea mays
  Clone ID: LIB3067-045-Q1-K1-E3
ctgagcaatgagcttatatgatgtagatgtgcctatcagatgcgagtatgtggctgtattgtcgacccctgcagtttgcgtagaggagaagctgaaggagctgcaaaacaaactggacgccatgtctttgaagcagcccgggcatgacgaactttaaaaactttagaatattccagcgtgaacataaagaagatgtcaccaggaggcatagctctgacagttacatccataacatgataggcatggaagtcaatgaggtatatggacagaaacgggccaagcgcgagaaatgagaatgtagagtttaggtcgcctaccaggctatattagctcgcatagaacattttttttagctgaaatttgatgttgcaattttccagactcatctgatggaatatatagtaagaaacagt

SEQ ID NO: 48708 - DNA, 391 bp, Zea mays
  unsure at all n locations
  Clone ID: LIB3067-045-Q1-K1-E4
cggacgcgtgggcgttacagtcggncttgtaatctggtggtacgacgacatggcggccaccagcagcaagtcgtcgtcgtcctcgagctcggcgcagcgggcagctgccgcactgctcgtggccgtcgtcgtggcggtgtccgtcctggtggtgggcgcggcggcggtgtgcgacatgagcaacgagcagttcatgtcgtgccagcccgcggcggccaagacgacggacccgtcggccgcgccgtcgcaggcgtgctgcgacgcgctggcggtggcggacctcaagtgcctgtgcggctacaagaactcgccgtggatgggcgtctacaacatcgaccccaagcgcgccatggagctttcggccaagtgcggccttgccacgccggccgac

SEQ ID NO: 48709 - DNA, 381 bp, Zea mays
  Clone ID: LIB3067-045-Q1-K1-E6
cggacgcgtgggtgtttcgtcatttgccttgtatacacattcgatggagctcaggccttacatcgaagaacccatgccaagaattcttccatcttcccaactgaacaatcatcggaaaattcggcatgattttgtactttcaaagaaagagtttgttgattcttattgggaaacactagagtgttgttatttaacagctggtttggctgacccgttaagtgccttccctggcagttctgtcccggaggtttgtctcatctgctgtacatcattgatgcataggattatcgcatacgttgaataaatgtacttagcgcctgtttggttgctccccaacttacataaggtagcttctgggcatgggcagtacggtgagaaaca

SEQ ID NO: 48710 - DNA, 329 bp, Zea mays
  Clone ID: LIB3067-045-Q1-K1-E7
cctacgcgtccgccctcgcgtctttccatgcgtccgcccacgcgtccgcccacgcgtccggtgggatgggtggtgcctactacttcaagaacatttggggagagcgtgtggcaattgtcaagccaactgatgaggaaccatttgctccaaataatccaaaaggttttgtggggaaagctcttggacagccgtgcctgaaaaggtctgtacgggttggggagacaggcttcatagaggttgctgcttacctactcgactatggtcactttgcaaatgttcctaccaccatgctggtccagatatcacacacaatcttcaatgtgaactac

SEQ ID NO: 48711 - DNA, 385 bp, Zea mays
  Clone ID: LIB3067-045-Q1-K1-E8
gatgaaagtcaggcttctgtctttacaatgcgtaatgggaccaggaaagtataaaaaaccttctaaagaaaatcaagatgcagtttccaaaatgattgatcagaatcaacattcaaaagaagaccagcttaaaaccttggaaaagatctccggcgctgatgcagtggggattgccaaggacagagataatttgaaatctgtttttatcactgagactgagcaccaagatcagaagccaaatgctagaggacgaaaaggatggtacaaaggtcaaggtcagatgcagcaaaatgcaaacaaacaaggcagttgtggttccgagtcattaaacaagcctattcctggaccgagaatgccagatggaacaaggggcttcacattggga

SEQ ID NO: 48712 - DNA, 385 bp, Zea mays
  Clone ID: LIB3067-045-Q1-K1-F1
cggacgcgtgggcggtcgcgtgggcggatgcgttttcggacgcgtgggtgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtga

SEQ ID NO: 48713 - DNA, 344 bp, Zea mays
  unsure at all n locations
  Clone ID: LIB3067-045-Q1-K1-F10
cataagcgtatgcgatccaagcttgcgtgcaggccctgaaccgaagaaatagaccaggtcaagcttaaagnagcaaccgtcattggagatggactggagtgaagaccatgggctggctgccacacgcatagacttgataacaaactgctagagtagcgggtgctgctttatgctgctttctaagcaactgagcaggtgtttgtgactgaaagaggtctcgttgatcaatctgacagctgcccaatgctggagtcaagcctctacttatgcagacggatgaccaacgagcgcccttattaccatcacgcagaaccgtacgaacttcacttgctctcgactatgca

SEQ ID NO: 48714 - DNA, 417 bp, Zea mays
  Clone ID: LIB3067-045-Q1-K1-F11
cccacgcgtccgcccacgcgtccttagatcaaccatctgcggcggcgatggggatcggtgagcacttcgagggcgtgaagcagcactgggcgagcaacttcgccttcctcgactattacaagaaggtctacggccgcgccgagcccctccccaagtggtccgacgccgacgtcgacgagttcatcgcctccgacccggtctacgggccccagctcaaggccctgcgggagtcgaggaagttcgcgcttgtcggggccttcgccggcgccgcccacctcggcggcgtcgcgctcaagtactccaaggcgccgcacggcgtcgtgctggcgaccgggttcggggcgatcacgggcgccgtgctggggtccgaggtggcggaacactggtaccagctctacaagatggacaaagcagggg

SEQ ID NO: 48715 - DNA, 440 bp, Zea mays
  Clone ID: LIB3067-045-Q1-K1-F12
acccactcgtccgcccacgcgtccgcagtatctattgttcgtgaacaccctcgaaccaagccatattccggatccagtgtcaagttgaaaacaaatttagagattttttgttgtcaaagaactttgttgggatccacaccccaaaattgatttctggatctagcgaagggggtgcagctgtattcaagcttctgtacaacggtcaacctgcttgtttggcacaatcccctcagttgtacaagcaaatggctatctctggtggttttgagcgagtatttgaggtcggccctgtgtttagagcagaaaattcaaacacacacaggcatctatgcgagttcgttggtcttgatgctgaaatggagattaaggagcatcattttgaggtctgtgacattatagatggcctattcgtatcaatatttaaacacttgtctgaaaac

SEQ ID NO: 48716 - DNA, 364 bp, Zea mays
  Clone ID: LIB3067-045-Q1-K1-F2
ggagatagcgcgggcttggagtgggaaggtgacatgtgaactcagagaagaactagcgcggcgagcattgctagccaagctgcaggggtccggagcggagaccggatgagggagacgtcgcttgcgatgtcaccggcagcatccgccgccgaaaccatcgtcgtcgcaatcgcaagcgtcccgagccagcagcagagcagccaccgcgccgcggcgccgtccgtcccgtcgtcctacgccgtctgggagaaggagcggtaaggcgtctgcagctttacgacgtcgtcgtcgtcgtcgtctgccacctacctactgctgctgctgctgcaaggggaaagtaaaaggaacggaaagggggaaggca

SEQ ID NO: 48717 - DNA, 190 bp, Zea mays
  Clone ID: LIB3067-045-Q1-K1-D8
attaaaaaaataaatttaaaaattttgataataaaacaaaaaaaaaaaaaaaaagagaaaggtaaattaatgacagcgcagtgcgctgaataaagcaaaaaacatacgggtggcagggctggggctttcctgctcaggtaccggatcttgctgctattggagcgagtgctatgctcctcgattgtattac

SEQ ID NO: 48718 - DNA, 198 bp, Zea mays
  Clone ID: LIB3067-045-Q1-K1-C2
ggaactcattggttaatagtgtgctttattaatattggtgatgctgatggaactgattttgctcccgttggacggcctgattggttactttgccctgttgactgtttgagaacgtaccgcccaggtttacttatacttactgctttttgacggtactgtacatacagttcgacaatttatttattggcagttcaattc

SEQ ID NO: 48719 - DNA, 438 bp, Zea mays
  unsure at all n locations
  Clone ID: LIB3067-045-Q1-K1-C3
cctacgcgtccgccctcgcgtccgcccatgcgttcgcccacgcgtccgcccacgcgtccgatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccggtacctncacggacaacaacaagaacaaggcatgtggcaagaaatatgaggcagtggcgcgccggcacctctgtacgattaatcgatgccttgagc

SEQ ID NO: 48720 - DNA, 400 bp, Zea mays
  Clone ID: LIB3067-045-Q1-K1-C4
cccacgcgtccgcccttgcgtccgcccatgcgttcgggccaacgcctccaagaaggatgagggcatgctccgggccggcggcggcggcgccggaaagcgcaagaaggccgccgcgagcggcaagcccaagcgccctccctccgcttacttcgtctacatgtctgaattcaggcaggagtaccaggcgcagcaccctagcaacaagagcgttgcggccgtgagcaaggcagcacgggaaaagtggcgctctatgtcagagcaagagaagcaaccctatgtggaccaagctgggcagaagaggcaggaccttcaaagggtggtgccaccagagcgagaactgcatcaccgtctgcaagagcgagggcaataccggcaggttctgcaagctcggggcttgcat

SEQ ID NO: 48721 - DNA, 430 bp, Zea mays
  Clone ID: LIB3067-045-Q1-K1-C5
attacgcatgttccatcacagctggaatgcaaaccccggcgcgcccgaggaggggcgggttggattcaaaccgggcggggctaacaaaaaaggagcaggatgaagccgactactaacacggaacggaacaacgactactaaacgcgcccgatcacgccgcccgagaacgaagcaggaagtgactatgcgcccaaagaagcgcaagcgtctagcattgaacacattgcgggcatgagcagaaacagccgatcaaacaggtcatccagagacgccgatacaaaccgatataatacgttggcattaaaaacacgatagggctcagcatgtaatagaactgaaggaaggatgttgtgagacttgtatgacatgcttaaatttctggataaaatctagcatataataagtctattacatgcttaaatctctagag

SEQ ID NO: 48722 - DNA, 448 bp, Zea mays
  Clone ID: LIB3067-045-Q1-K1-C6
gcgtacaccgagctactgcgctacctctacggcctcgagcgctggagcaacatgtacaagttccgcacgttcctcgacgaaggcgtgacggtgtcgatcggcatggacggcctcgcgtgccagtgccgctgccagcacaagccgctcgaacacatcgagtcgggccatacgcgccagctcgcgggcgagcccgatgcggcggtgttcccggacatcgccgagcgcctgagcattccgcagctgatcgccgcgtacacgatccatggcgcgtaccagctcgggatggagcacgagatcggctcgctgacgccgggcaagcgcgcggatctcgtcgtgctcgagaacgacctgttcgaagtcggccagtacgatatcggccgcatcgacgtcgcgctgacgatgatggacggcgacgtcacgcacgtcggcgacgatttcggcgcacgca

SEQ ID NO: 48723 - DNA, 331 bp, Zea mays
  Clone ID: LIB3067-045-Q1-K1-C7
gataaatctgaggcttgtttctttacattcgcagttgccgcctaagagctttcgccttgccaggcttgagagctagtgctgctaaatccttccttggatgtctgatgcgattcaaatccaattcttttgtgctttggttgtagagggttccgtaggtttcggtctaaaatcgtgtgctttgcaagatcagcttcttgtttggacttcgaaactgaaacctggtccaggcaatcggcaaatcatcctgccatcttgcgatactgtatccaagccagcttaaactcacctggatctgacgtcctgattttctgggccctttcggctgcacatg

SEQ ID NO: 48724 - DNA, 427 bp, Zea mays
  Clone ID: LIB3067-045-Q1-K1-C8
gtttgggaaatgcatttaagcctttgattcgtacaagaacggttgtcagtaccttcttggtcagtttgggcctccgtttgctacgctaaggcttgatttctctcccgtcaagttgactgtgccttcaccgtctcttgcttcaaagcctccactccgagatattaggaagaaccttgaggatatgatttcagcccgtcgttcggctctggcaacctcatcagatgggcagctgaatcctgttccagataagcttctgggggagatgcagggccttttggcaaacgttgacaggatgcttactaggccgtctgagaatgctccttagctctgccaatctgaaggattatggctgtaacctattggtagttagacaactttggtggttctgttagttgtagcttttgcatctaactttatgatgaactac

SEQ ID NO: 48725 - DNA, 372 bp, Zea mays
  unsure at all n locations
  Clone ID: LIB3067-045-Q1-K1-C9
attataatgaatacgttagaaacttgngttcagattcaaagcaacacaagacgaaaacagagtgcctgcaaagcaaacccaaggacattgaggtgctgctctgctagcgtacgtgctacagcatgtcacgtaaggtacacgacgacgacgactacattgaacggagggacactagacgaagtgatcactagtgggtgcatgatctacttctttattatgtgccagtctgatgcatgacacacacgtagctaggacatctttgctacgacgacgactgcatgctgctgatggccacgttcgctgtcatccaacgagcgagctaccttcactatgggtccatcgatcagatgatcttgggttttgttttgatgg

SEQ ID NO: 48726 - DNA, 392 bp, Zea mays
  unsure at all n locations
  Clone ID: LIB3067-045-Q1-K1-D1
cgacgactactgcgactagcctttcgtcgtagattgacggcgtgatggacgagtttacgcttgtgaaattagtggatgttcggaaggaagtgcaatgccctatatgcctaggaattattcggaagacaaggacagtcatggagtgtttgcaccggttttgcagggactgcatagataaatcgatgcggcttggaaataacgaatgcccagcgtgccgcactcattgtgctagtagacgttccttgagggatgatcctaactacgatgctttgattctagctntatatccagatattgataagtatgaggaagaggaacttgcattcagtcgagggcatgaacggcaaggagctggacgggcgcaacatcaccgtcaacgaggcccagtcccg

SEQ ID NO: 48727 - DNA, 424 bp, Zea mays
  Clone ID: LIB3067-045-Q1-K1-D10
ctgtcgcgtgggtcgttgacgcttgggttgagatgttagcaaagaaagtagacaccttaactaaagcaatggaagtggaagctaaaaaggtcagacgggaggttgcatccatggagaaagaagttgcagcaatgcgtgccagtaaagaacaagaaatcagagccaagcggcttggtacgaaaggctctggtagttcacaactgcttcctggaagaaacgcaccacgaagtgggtccatgcgcaacttacaatgatggcagcactaacaccaagcagcattcttggataggtcctctgttccaccatttgttctgttcctatcctattaatttcgtggctaaaatcgtagcacagtgagatgacccaacaatacctagatctgggtaagagtaggctcggatctgatgagaccattgtgggagtg

SEQ ID NO: 48728 - DNA, 442 bp, Zea mays
  unsure at all n locations
  Clone ID: LIB3067-045-Q1-K1-D11
cggacgcgtgggcattaccacattggtttctccgatcagagttcaactcggttctttgccgagtcagataagaaccccaacagtttttaattgcgcgccaatctgttttatatatacggagagagcactcctgtttttactagctgcaaaagggcgtgtttgagactagcggaccgaccggcctgcgcggcgatggatgtcaagtgccggcgtctggaggggaaggtggccatcgtgacggcgtccacgatggggatcggcctcgccatcgccgagcgcctcggtctggagggcgccgccgtcgtcatctcctcccgcaagcagaagaacgtgaacgaggcggtggaggggctcagggccaagggtatcaccgcggttggtgccgtctgccacgtcttcgacgcacagcagcgcaagagcctcatcgagacggncgtcaaga

SEQ ID NO: 48729 - DNA, 304 bp, Zea mays
  Clone ID: LIB3067-045-Q1-K1-D2
agcacagcaccgcatatagcgtacaggatatgtcttgagcgctggcactggcgtaccaaggaggcgcgcgtgaggaagctccaactgctgcggtcactgatgtcactgcaactgatcgaggagcacccgtcagactctgcagtgcacgtcacaccacgagctgtgcgagcgcaacatgagcgagttcatggtggagctgatacttctcgacatggctcctgccgatgcatagactagacgaagtgcgctacaacgcatctacaatgtacgagcggcatatgctggtcgtctgcatgaaacacac

SEQ ID NO: 48730 - DNA, 121 bp, Zea mays
  Clone ID: LIB3067-045-Q1-K1-D3
cccgcgtccgataacacgaccgcagtaaacttacaggatagaattacaacctggcacacgaagaccagggaggcatacaaaaggaagctggaactgaaatgcacagagatgtaaccgcagc

SEQ ID NO: 48731 - DNA, 411 bp, Zea mays
  Clone ID: LIB3067-045-Q1-K1-D4
ccattgagcagggattgcaatatcattattggttatgtgaatgtgaagaaccaaatatcgagggaggatctaaaagaagcattcagaaaatttggagctgtccggtatgtggacttcagcatcggagataattcacgataccttcgctttgaagattctaaggcagctgaaaaagcccgcatgtctgcagtacttgctgatggtggcttgataattaaggaccacattgttactttggagcctgtgactggtgaagctgagaaggattattgggacacaatccgcagtattcaaggaaagtacaaggatagttgaagctacaagggaagggcttcaaataaccagagaggaggaaagcgtttcaacgcgaaacgagatagaaacccagactcggagaagaattctaacaag

SEQ ID NO: 48732 - DNA, 331 bp, Zea mays
  Clone ID: LIB3067-045-Q1-K1-D5
ctcgtgctcggcaggtgaacggttcgattcggaggagcggcgatgcagatccgggtgcagtgcgcgtgcggcgagtcgtcgtgcccggaatgggccgtcgtggagctgcagggcgtggtgcagccgcaggcctccttcgccggcgacatccggggactccacatctgccgcctctgctcctgctcttccacagcctacgcctcgtccaaggcagggttcaccttcacggtggggtaccacgagctcgccggcacatacgtgacgctcaagaagcctctgctggtgctcatgaagaagatggtgatgctggtgctcatgaagagagccacct

SEQ ID NO: 48733 - DNA, 315 bp, Zea mays
  unsure at all n locations
  Clone ID: LIB3067-045-Q1-K1-D6
ctacatccaacgggcatctccgttccgttccgatcctccgctccacgccgccaccgctcctgcgctcctcgcggctcaaacggtcaaatcgcagatccacaggaaaccccaagcggcggccgtccctgctgcggctctgcctccctctgctctccgattcgagcggattccatggccagagatgacgacggcgcgcccgcgcccggcgttccgggccaggtgtacctgcccgcgtggcgccgcgcgtacgaccgactcgtgaagatgctgcaccaggcgtacgcgcatgccgaggagctctncgtcgagcgcgag

SEQ ID NO: 48734 - DNA, 440 bp, Zea mays
  unsure at all n locations
  Clone ID: LIB3067-045-Q1-K1-D7
ccgtagtcctacgagctgtcgcactcatgtgtcaagagacgaaacggtcgacatggctcgcacccaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccgccccctccgcgtcctgctgtagcggcgtcaggaacctcaagagcgccgacagcaccgtcgtcgacaggcgcgccgactgcaactgcctcaagaacgccgncaggggcgtcagcggcctcaacgccggcaacgccgncagcatcccctccaagtgcggcgtcagcatnctctacaccatcagcacctccaccgactgcttcagggtgaactaaaacctagaccacgcgcgacgac

SEQ ID NO: 48735 - DNA, 440 bp, Zea mays
  Clone ID: LIB3067-045-Q1-K1-C12
cctacgcgtacgccctcgcgtctttccatgcgtccgcccacgcgtccgattgactgctactcggaggctagcacctctgtctttgggcaaaagttgcgtgagcaagtcgaggagagactggaattctatgacaagggtgttgcgcctcgtaaaaaccttgatgtgatgaaagccgctattgacagcatggtcaatggcacctcaatggatgatgatgatatcgagaagaccgatgcatctcccaagaaaagcaagaaaaagaagaccaaaaccaaggctgatggtgatgcaatggacgtggataaaccctgcaacgttgctggtggagaagctgagcctggaactgagaagaagaagaagaaaaagaagcataagctggaggaggaagcacaggatgagaacggtgcatcagatactacccctaaagaaaagaaaaagaa

SEQ ID NO: 48736 - DNA, 382 bp, Zea mays
  Clone ID: LIB3067-045-Q1-K1-A5
cccacgcgtccgcccacgcgttcttgttcttcggcatcagccagggcaagcttgttgcgtgttcctgaccggcgagaggctcaagtcccccggcgaggagtgcaacaaggtgttcgtcggcatcagccagggcaagctcgtggaccccatgctcgagtgcctcaaggagtgggacggcaagccgctgcccatcaacgtcaagtaaagaacgccaaggagaagaggaaggaggggaggaaatacgtggaaaaaaaaataaataaaacctgtacacgtgtatgtccagatcgcgtgccgtcgatcgttcttcgttgttgatttttggttgtattgatcgatccgtatgtgtgcgtgcgtgtgtggcgttgctctttcttctttt

SEQ ID NO: 48737 - DNA, 311 bp, Zea mays
  Clone ID: LIB3067-045-Q1-K1-A6
cgacccactcgttcgcctacgcgtcttccttcgcgaccttgaatgacagcctcagccagggcaagcttggagcgtgttccttaccagcgagaggctcaagtccaacggcgaggagtgcaacaaggtgttcgtcggcatcagccagggcaagctcgtggaccccatgctcgagtgcctcaaggagtgggacggcaagccgctgcccatcaacgtcaagtaaagaacgccaaggagaagaggagggaggggaggaaatacgtggaaaaaaaaataaataaaacctgtacacgtgtatgtccagatcgcgtgcc

SEQ ID NO: 48738 - DNA, 261 bp, Zea mays
  Clone ID: LIB3067-045-Q1-K1-A8
atcgatcggaagagatcgttactttttcttgcagaaaatgctgcttccttgtggcctccctcctgagagagatgaagattgaggagctgttgcatagtttcagtgtttccaatgaccatttatgagattgtaacctctatggtactatgtgccatttgtgttaaagctcgtatgcctttgacttgtcttgcatcggtctctatcgtgatacataaacattcggaacttgtatgcattgtaaacgaaatgctggttatgccc

SEQ ID NO: 48739 - DNA, 334 bp, Zea mays
  Clone ID: LIB3067-045-Q1-K1-A9
cactcgttcggagaaggaagccgcttctgccgtcgcctcggctggtgaaggtgcccaggaaaactagagcatttttcagtatgcagcaataattcgacatggtcccattcggttcgtgtcggggccctctcgtatatcgtatcagcagcgtggcctgtgtaattggatatacgtcatctgtacgagcgccatggcccttgaggagctggtgctttgtgttgttattagtcgtccgttgcagattttaaagacatcgggttcaggttgggcgcccctggccctgtttggtcggaaaacaggcgctctttcaaaatgagttatttctttgtaccgt

SEQ ID NO: 48740 - DNA, 360 bp, Zea mays
  Clone ID: LIB3067-045-Q1-K1-B1
cccacgcgtccggcatgaaaactgacgcttggggtgctggctcgtcaggtggggatcaggaatcttcttggagtaaacctattttctctctgggggatcaggaacctacttggaacaacccaaggtttggtgacgatgacaatgtaaataatagaggtgggtttggacgcggaaatcaaggcagagggagagggaggagttttgggggtggtggtggatcatcatggaatgaaggcaacagaaacggtgaatcaggtgggggaaggtctggggaaccatggaacagaagggatttgatggcggcagaggaagaggtcgctttgggcgaagtgaccgcaatcaaggcaacaacttggggtc

SEQ ID NO: 48741 - DNA, 411 bp, Zea mays
  Clone ID: LIB3067-045-Q1-K1-B10
cctacgcgtccgatttcagctaattatgtaaatagctgcagccttttgcttgcaggaagtgcattttgtttaatttgtaagcttgcgcaaaatgctagtagttgctactacgtaggaacctaggtcatgctttaattttgtggtttcgctttgtgaaacgagaatgcaacacgtaataaacgaaaaacaccggttggctttacaatgaaaaaaaaataaaaaaaagaaataaaaaaaataaaaaagaaatagataaaaaaagaagagaataaaatggaaatgagaaacaaggagaatgggcaacggtctttaacgactaaatgattgagcttgcggtgctattctttatcgacgtatagacggagttcatgtaaaatgtattgaccgtgcttgaatatcgatttgtaaatg

SEQ ID NO: 48742 - DNA, 331 bp, Zea mays
  Clone ID: LIB3067-045-Q1-K1-B11
cgcagcagtagccatttttttgtctccttaggccttgggtgctgaggccgacctctgcgtcacgcgtagcaggaccttcaaagggtggtgccaccagagcgagaactgcatcaccgtctgcaagagcgagggcaataccggcgggttctgcaagctcggggcttgcatgtgcaccaaagagtgtgtccgaagtactgacgctgctggtgctaataaagccccacagcagcatttgagttgatgagtagtaaagaagaacgcttttgttatgccagcgcaagctctagaattcgaggccgagatgaccaaaaataaatgattttgttactct

SEQ ID NO: 48743 - DNA, 364 bp, Zea mays
  unsure at all n locations
  Clone ID: LIB3067-045-Q1-K1-B3
cggtacgcgtgggcagttagctagcgtgtttaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcngcggcggaccggcaggccacctgcaactgcctcaagagcatg

SEQ ID NO: 48744 - DNA, 420 bp, Zea mays
  Clone ID: LIB3067-045-Q1-K1-B4
gatggccccaacccttaccggtaccgtctagtttctcgacgagccagtgcccaccttacgctggtagtaccaccaaggggaaggaagtgggtgtacaattttcttcgacgagcctcagcgccgatctgtctggaccggtttctgggaatgaagcgcctctagttctgaagaacaaagccccgcgctggcacgagcagctgcagtgctggtgcctcaacttccgggggcgcgtcaccgtcgcgtctgtgaagaacttccagctcgtcgcgtctgttgacccttccctaaacgtccacgcagcggagcaggagaaggtgatcctccagttcgggaagatcgggaaggatatattcaccatggactaccggtacccgctctcggcgttccaggccttcgcgatctggctgaccagcttcgaca

SEQ ID NO: 48745 - DNA, 328 bp, Zea mays
  unsure at all n locations
  Clone ID: LIB3067-045-Q1-K1-B5
ctccccaacttcgcctcccaactcccaattcccacccccactccctcgctcaccagaggaactagcggccaggcaaagccgagccgcaaccgcgaagatcttgcgtggcctccttttcccagctcgtcactgtgccgctcgtgtccttcactcccggtccgcccaaccaataatccatcgatccatccaccaccaccaccccgctgcggcgatgtgcggcggcgccatcctctcgggtttcatcccgccgtccggggtggcggcggcngcngcggcggcggccaagaagaagcagcagcagcggtgccgtgtgactgcngacctgcta

SEQ ID NO: 48746 - DNA, 256 bp, Zea mays
  Clone ID: LIB3067-045-Q1-K1-B6
cggctcgacccactcgttcgcttgcaaacttagcgtcccagcttcgaataccgacccgcactggctcgatcacgggaggggctagttgccaggcgagaggccagtccgcaaacgataagatccgacgtggcctactgccgacatctcgggactgtgccgtgcgagtgcatcactcctggtccggccaaccaatgctccatccatgcatgagccaccaccacgccggtgcggcaacgtgcggcggcgccatactgtc

SEQ ID NO: 48747 - DNA, 448 bp, Zea mays
  Clone ID: LIB3067-045-Q1-K1-B7
atttggaaggatctataaattatttcattataggacattgaagacatcaggaactgtgcctttgtccaaaagcaattgctgctagctgctattgatttggttgatgccaactccaaaactggtggttacattgtttactcaacgtgttcgataatgattccagagaacgaggcagtaattgactatgcacttaaaaagagaaatgtaaagcttgtgccttgcgggttggattttgggcgtccaggattcatccggtaccgggagcatcggtttcatacttctttagaaaaaacaagaagattttatcctcatgtcaataacatggatggattttttgtagctaagctgaaaaagttgagcaatacaatccccgtgacgtctgagccgtctaaagcatctgaagaagcagctaaggttgatggcgaagatgagaaagctatttctaatg

SEQ ID NO: 48748 - DNA, 405 bp, Zea mays
  Clone ID: LIB3067-045-Q1-K1-B8
cggacgcgtgggcggtcgcgtgttcggtcgcgtgggcttcggcgtcttcgacggccacggctgctcccacgtagcaaccatgtgccagaacatgatgcacgaggtggtcgcggacgagcacaggaaggcagattgttctggcgaagagacggcgtggaaggccgtgatggagaggagcttcgcgcgactggacgagcaggccgccagctgggcgaccagccgcagccgcgacgagccctcctgcaagtgcgagcagcagaagcccttgcgttgcgatcacgtggggtccaccggcgtggtcgccgtcgtcagccccacccacgttgtcgtcgccaacgccggcgacttccgggccgtcctattccgcgccggcgttcccgttccgctgtccgtcgaccacaagcc

SEQ ID NO: 48749 - DNA, 440 bp, Zea mays
  Clone ID: LIB3067-045-Q1-K1-B9
gatgattattacacttcacactttcaatcaccgaggcagatgttgtgtttgtgggacaagctgcaggctggaaaagctcaatgttgcaatatgagatagcaacattggaggtggtggtactggtaggcgtttctgtggtggtagtgcctatccttattcatgaaggagaacctagaagctagaagccttgaaaataaattaaaccctcgagatgactaacaaattgccatttaacggatttttttggtatagctgaacaggcggtgtttcagctggaaatggaaacagggggaatgggcagcggcctgtaacgactttctgattgagcttgcggcgctcttctttctcgacgtatagacggagttctgtgagcagtatggaacctgcttgggtcttgatttgtaaatgggacgggtagaaagcttagtcaaataactatt

SEQ ID NO: 48750 - DNA, 418 bp, Zea mays
  Clone ID: LIB3067-045-Q1-K1-C1
atttcaccgtgtcattaaacatttcttttacattgttatccctggccttagcatgcggttcctaaagcctccttccaatcaagttcatcctaaaattcttgaagtatggataggttcaatagatggaacccatgttccagtatcaatgtcacccgatcaagccgcaccattcaggaataggttgggagtagttgtacttggttccctgcagctgacaggaaatattggtcatatggagacagttctgcacagcgttctgagtgccgatatgagctatatatatgttgcatttctccatgtttgggctcagcatgtaatagaactgaaagaaggttgttgtgagacttgtatgacatgcttaaatttctggataaaatctagcatataataagtctattacatgcttaaatttctagag

SEQ ID NO: 48751 - DNA, 419 bp, Zea mays
  Clone ID: LIB3067-045-Q1-K1-C10
ccgccgcctccgacattggccctttgtctccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaagggtgtcgagggtgcaaccaagtttc

SEQ ID NO: 48752 - DNA, 332 bp, Zea mays
  Clone ID: LIB3067-045-Q1-K1-C11
gtatttttcatgtggtaaccgtttagtttattcatgaccctaaagtcggcgtcatatttgatgcacggtcattgatccaagccctaaccattctcatatctgaacatatggatatgtgtgtatcaaaagttcagaacgtggtcatgtaactgaaaatgtaaaagttgtaagctgatctttcaagtacaaaaatgaatgtaaagtccctcttaatttattgttttactaatcgatccatagtgcgaatactcatgtttttatttcagctagcactagtgttgcaattctgcctgacttgacatgattaatgaaaaatgagacatgtatttttc

SEQ ID NO: 48753 - DNA, 441 bp, Zea mays
  Clone ID: LIB3067-044-Q1-K1-G7
gaactaagagcgttttctaggctttaatttattctaaaaatgaataaaagaaacaagaagcattatgattttgagttagcaaaaaaaaagatagcagcaaccgactagatcaaaatttgaaaaactcaaatatagattcacggggatagatatgcaataagattcatgctatgttctgttagttgaatggttgaacatgcatgtatctttcttgaattctgtctgcagcaacatttgctgccgtcgtccttggatgtgtcgcaattgttttgcttcagactctaaacaacaggaaaagattcaacagaaatggaggtaaactactgaatgcccagggcataaccacctacaccaaaagggagctgaagaagataactaatggctacagcaaacgccttggacgagggcactttggcaatgtttacgagggcaccatcgtcg

SEQ ID NO: 48754 - DNA, 267 bp, Zea mays
  unsure at all n locations
  Clone ID: LIB3067-044-Q1-K1-H10
cgaccacgcgtccggttcacagtgccgactggaatccccgcttagataacgagaccnnaacggggccngccgagaacgctgnccgaaagcgggagcgaccgcaaccggggacgggaggagccggnccnccaacacacaaaagcgagggccacaaagcagccagagcccggaggcagacggcaccagacagagcancnagnncaggaagagccgcagaagaagggggcggaaaggacagggaccangagaagggggggaagaagaaaa

SEQ ID NO: 48755 - DNA, 301 bp, Zea mays
  Clone ID: LIB3067-044-Q1-K1-H11
cggacgcgtgggctgtcgcgtgggaaattaaatatccaaagaaaaaaaaaacaaaaaaagaaagagtaaataaaaaaaaaggccgggccaaaaaaaaagggcggccgcgcaaaaagacccaagcaaacaaacgcgggcaggcaaccacgaagcgcgcaaacagaaacaccaaaaccgaagacacaggccacccaaaaacaacgcccaacccggaaaaacccaggaagcccccaaccaaaccgccgcgcaagacaaccaaagggcaccagcggacgcaacaacacaacagcccgcacgcacc

SEQ ID NO: 48756 - DNA, 321 bp, Zea mays
  unsure at all n locations
  Clone ID: LIB3067-044-Q1-K1-H12
ctacactacctatccaccctnaggccacattagaccttggcgggcccccgccatacgttcagttcggagaacacaatcctgcccccagagtctcccgggacaagctcgctgatggcttcgcggtgcgacctctgcgacacgcccaagggcaagaaggaagacaagccgaggggcttcttctactgtttcagcgagtgctattagcacgagccctcccaaaggggaacactccgataagctagcaaatactgaacgaacaccggctctccccagcttcgatgccctgcgacttaagccaatgtcagcccggcaagtcccagg

SEQ ID NO: 48757 - DNA, 343 bp, Zea mays
  Clone ID: LIB3067-044-Q1-K1-H2
cacgacctttgactgtacccattggaatacaggtccacctacatccgcaagggtacgtacctggagggcatgtccatgacgccgcctgcagccccgcccacggtgacggaggcctactgcctgctcaaccttggggacagcatcaccacggaccacatctcctactcggggaagatccccgagggcacacctgcggccaagtatctgctcgagtatggcgtggagcccaagaactttagctcctatggtggccgccgcgggaacaatgaggtggtgatgaggggagcgtttgccaatattaggatcgtgaataagcttcttgatggcaaggctggtccctgga

SEQ ID NO: 48758 - DNA, 375 bp, Zea mays
  Clone ID: LIB3067-044-Q1-K1-H4
gttcttgatcagatgtgactctactagactggtcagatggctacggtcggaatagtcctggacttcaactggtacgaggctcttacaaactcacctgatgaccaagcagcagcataaagagccaggcacttgcacattgcctggccagtagatccattgataaacggacactatccacagataatgcaagatctcgcgaaggagaggctgcccaggttcactcctgagcaggctaaactggtgaagggctcggcagactacatctgtatcaacgagtacacatccagctacatgaaggggcagaagctggtacagctggcccccagtagctactgtgccggatggcaggttcaatatgttcgtgcacgcaatggc

SEQ ID NO: 48759 - DNA, 430 bp, Zea mays
  Clone ID: LIB3067-044-Q1-K1-H5
cctacgcgtccgccttcgcgtcttcggatgcgtgggtacaacaaaaacatggagctacgactcgattcccaaggtacaatcgtaattatgttcaaacaatttttaagtcgtcctgcgctccttctattacgagcaacgttttatattctgtgcttgcataataaatcgaagaaatcctgacaccaatcgaactgaagatcctgaaacgcacgttaataccgttgacgtccgcttcacccagctcgattttcagtcttgtaataataattgagaactccaatgaactgagagttactaatcgctccatgagtctgaagcgtgcaaaaatttaggtcgcagctacacaaatttacacgctgttctatattctatattctatattatatttaggtcgcaactacccgtgaatctcctattttgaaaggtcact

SEQ ID NO: 48760 - DNA, 455 bp, Zea mays
  unsure at all n locations
  Clone ID: LIB3067-044-Q1-K1-H6
gggctacgcgtacggctactgcagtggcttgaaactcggcgtataattaggctgctcagaaggctacggacggaacagtgcagtttcaagctagtgagaaggattacctcggagacatcagtcgagctcaagattctctctgaaaaatggcggcttctcctcgctggcgtcatttttcagtgcattcatggtttggccgctcatggggttcattatttgcaccggccggggcccacccttcaagatcttggcttcatgattcttccggagcttgggaaagaaaggggttacatcagtgagacattgtttacgttcatcttcctcgcctttgtgttgtggacatttcatcctttcatccttcagactaaacgcttctacactgttctgatatggcgcanggtacttgcattcttatgtgtttctcagtttcttcgaaatataacattctatgcaac

SEQ ID NO: 48761 - DNA, 317 bp, Zea mays
  Clone ID: LIB3067-044-Q1-K1-H7
ctgtacgcgtgggcatttgccgcattctttccttgaaagaatcctgaggaaaccagaaagtgacgcataagcagaggagctgatgccgcatcaaaacgctttattaccagataagtcgactgtgcttgaccgagcaatgatcgagcataatctccttagtgccagtaaactttacacacatatcagcttagatgagcttgggacattactggggattgatccaagagctgctgagatgatagcagtctcgagatgagtgaatggtgatcgaatgctgagctcaataaatcaggatgaggctgagatacattttgatg

SEQ ID NO: 48762 - DNA, 450 bp, Zea mays
  Clone ID: LIB3067-044-Q1-K1-H8
acgcgtccggttcttgatcagattgttgacttttacttgaagggaaagatagctccacaatgcttcaagaagtttgctgagacagccgagaagtgtgtttctgatcagagtattgaccgcccttcgatgggcgatgtgctctggaacttggagtttgcccttcagatgcaggagagcgcggaagagagcggaagcctcggttgtgggatgtcggacgagggcactccccttgtgatggtcgggaagaaggatccaaatgacccgtcgatcgaatcgagcaccaccaccacaaccaccacttctttgagcatgggcgatcagagcgtcgcgagtatggactcggatgggctgacgcctagcgccgtcttctcacagatcatgaaccccaagggcggtgaggtaaaactggtcccattcgttaccttgcattcattcagcatgtttttttca

SEQ ID NO: 48763 - DNA, 338 bp, Zea mays
  Clone ID: LIB3067-044-Q1-K1-H9
gacccacgcgttcgcttgccaaggccttctgtattgcaagttttaataggagttattaggggggcattggaaatggtgtctatgaaggcggaggtgacatgtgtgcgcgacatgcttcgcggggacgatgcctatgagatgcgggtgaagcttatcaagcaagtgccggaggaatacccctacatggatgatgactagttctattttagtgcaagattgcttgtttggattttgacatcgttttcgtcgatggtccgtagttctgctataacctgatatcatacgaggaaagctgcgtctgttttgcttgtgtattgtagaaatcatacataatcttt

SEQ ID NO: 48764 - DNA, 389 bp, Zea mays
  unsure at all n locations
  Clone ID: LIB3067-045-Q1-K1-A1
cccatcgccgccaagatgcagatctttgtgaagactctgacggggaagaccatcactttggaggtggagtcctcggacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaagctctccgtgctgcagttctataaggtggacgacgccacaggcaaggtgacccgncttcgcaaggagtgccccaacac

SEQ ID NO: 48765 - DNA, 424 bp, Zea mays
  Clone ID: LIB3067-045-Q1-K1-A11
gcgatgagattcggctacctcccttcgtgggcagtcgaactttctgcacttatccgcgaagctatctgcgtcggcgacaccagtgtcggtcttggtgcggaggggacgaacgaggacgaggatgcgtgccctctgccatcagacttgttgtggcgggagccattttttgatcagatgatcacgaacagatacagaccagggcatctgtgctcacgtcgatctgatgcgctttgatgatgggatcgcgatcgtctcgctcgagtcagcctgtgtgatgcgcttcagtcgagcagaaccagcctctgactcaccgaagcaagggggcagtgccagtgaatctactgcagaggtccccgttctgctgaacccgggctcccttgcgctcatgtctggcgatgccaggtatctgtggatgcatgagatt

SEQ ID NO: 48766 - DNA, 413 bp, Zea mays
  Clone ID: LIB3067-045-Q1-K1-A12
cccacgcgtccggcttacattcttcgtttcattgctggtgctggtgtgctttctggctatgaccagctccagatcctcttcttcggaaagaagtacggttccggcggtgcttaaatggagaaatatgatgacgaacaagagcagtgtgtgttcccggtcctttccaatcaggatctggtgaagtttttgcctttcatatcgaagaaattaataattcatgtagagggaggattcttacaacaatttgttttggatggagacttagatctccaaacactcgtaactatcctactaggtggtgacatcagtccccaaaaacgtctatggtcatagagtctgcccttcgtttgtcagtcgggcaatttttcttgcatacaatgccttcgtttaagtatcggatgagttgctgcgac

SEQ ID NO: 48767 - DNA, 285 bp, Zea mays
  Clone ID: LIB3067-045-Q1-K1-A3
cccacgcccacgcgtgcgccctcgcatccgcggatgcaatcccaaacccagaagaccatcacagggggagtgtaaaacacaaacaggccagacaaagcaaaggccacgacccatcacaaggaccccatccaacccgcaccagcagccgcccatctaccccggcaagcagctcgcggacagtcacaccctcgccgactacaacacacagaaggagcccacccaacacctgctgcaccgactccacgcgggcgccaagaaacccacgaagaacacagacaccaagcc

SEQ ID NO: 48768 - DNA, 315 bp, Zea mays
  unsure at all n locations
  Clone ID: LIB3067-044-Q1-K1-G6
ggaagagagagctcttcgcctttctcctccgccttagagcgacgtcgctgccggagctcgatacctatgggtggcttcgggacctcgcgccctgcctccgtcgccctctgcgccttcctcaccttcctcaacctcttcgccgtccttctcgccgtcggcgccgagcgccgccgcagcaccgggaaggtgatgccggacgagtacgacgagcggtcctactgcctctacgacactgacgcctncacggtgtacggcgtctccgctttcttcgtgctcctgctccagcaggccattgtcaacgccgccacgtggtgc

SEQ ID NO: 48769 - DNA, 299 bp, Zea mays
  Clone ID: LIB3067-044-Q1-K1-E8
tcgcctacgcgttcgcggtcgcgtgtgtgatgcgctgcattttatgattctattgccaggtcataggctattgttctgatgatccgtagctgcacatcacttattgcctatctttgtaggttttccactgtgaataggttagtctactacttttaacaatttggttcattctttttccaccacagatacacctgtacctagaatgctttaatagatcctcatacgaaatggacattgtacatttcttttaacaagtcagtctcttgctcattataatctggaaccatttgcaattaaaa

SEQ ID NO: 48770 - DNA, 242 bp, Zea mays
  Clone ID: LIB3067-044-Q1-K1-E9
gattggtttcctcattaaatataatagcatacaatcaggagacgtagctgattattaaagagagggtaaaaaaaaaaaaaaggccgggcaaaaaaaaaaaaaaaaaaaaaaggaaaaaaaaaacaaaggagggccgcacagaaataacaaacagagaaaaaagggccaataagacagacgagagacagcggagagggcaccgatagagatgaaaagccggcgcatgtagaagaaagggggca

SEQ ID NO: 48771 - DNA, 168 bp, Zea mays
  Clone ID: LIB3067-044-Q1-K1-F1
gacccacgcgtccgcccacgcgtccgaaatataaaataaaagataaaaattcaaaaccaaaaaagaaaaaaaagagaaaggataaaataaaaagagggccaggcaaaagaagcacaagcaaaccaaagagggcaacccacacaaaagtgccttgacggagggacccaa

SEQ ID NO: 48772 - DNA, 186 bp, Zea mays
  unsure at all n locations
  Clone ID: LIB3067-044-Q1-K1-F12
gacccaggcgacccctgcgccgaagccaccgccgtagcaagcgtacattgaacacccacaaaccaagccacaaggcggggccaccgtcaaggagggcacaggacaacagaccaagcgccgacaaagaaccacgccgggagccacaccccacaagagagaccnggacccagcgaacggggcgcagca

SEQ ID NO: 48773 - DNA, 272 bp, Zea mays
  Clone ID: LIB3067-044-Q1-K1-F2
cctacgcgtccgccctcgcgtccggaatcgaagtacagggcctgctagatgctatcgcgcagagcatgaacatgccgtacgctaagtccaggtactgccgtggtgtccctgaccccaagatcaggatctacgatgtcgggatgaagaggaagggtgttgccgagttccccgacggcgtgcacctcgtctgctgggagaaggagaaagaccccagcgaggcgctcgaggctgcccgcattgcccgcaacaagtacatgaccaaatgtgcagga

SEQ ID NO: 48774 - DNA, 427 bp, Zea mays
  unsure at all n locations
  Clone ID: LIB3067-044-Q1-K1-F3
gatgatcatgaactcttccttctttcnacgctgtaactgaagggtctcagtgttaggcacttaggctatctccagcaagataaaggccacgaatcccgggtgtggtgctggcgtggaggcagcaggcaagaagaagcagcagatctaccgatggaccgcgagtgaccgtgactgcgagctcatggggctcatgtggctgctgcagcgcaatgccacacggtacggagcggcggccacggccgtgatccgggccctaatggccgtggacgaggcgttcaccgcaggggtcgcggtggcggcagatacgggggcagccgtggcgtgctcgctgcccgtggacgacgacatgcccctnccggccgagtacgcgcaggtcagcagggccagcgacgcgcctcgtctctgctgcttcctgctcgtgctgctc

SEQ ID NO: 48775 - DNA, 371 bp, Zea mays
  Clone ID: LIB3067-044-Q1-K1-F4
cctacgcgtccgccttcgcgttcgtgcttgtggtgcaggacgggccgccgccgggcggtttcgcgcccgtgcgcttcgcccgccggatccccacctcggtgcccagcgccaccgccatcttcctcaccaccttcggtgctttcgcatatggcatgtaccaggtcggccaggggaacaaggtccgccgggcgctcaaagaagagaaaattgctgctcgcagtgctatactgccgatgctccaagcagaagaggatgaaagatttgtcaaagagtggaagaagtgtcttgaggaggaagcgaggatcatgaaagacgttccaaggtggaaaggccgccagagcgtgtaccactctgggaaatggattcccccg

SEQ ID NO: 48776 - DNA, 364 bp, Zea mays
  Clone ID: LIB3067-044-Q1-K1-F5
cctagccgcggccattagcgcctagtcttacgggctcggccgcttcgccgtcgacgagcacaacaggcgcgagaacgcgctgctggagttcgtgcgcgtggtggaggccaaggagcaggtggtggcctgcacgctgcaccacctcacgctcgaggccgtcgaggccggatggaagaagctctactaggccaaggtctgggtcaatgccatggctcgacttcaaggagctccaggaatttagccacaagggggacgccaccgtcttcaccaacgccgacctttgcgccaaggaaggtggacatgaacctggttggcgtgaggttccagtagaggatcctgtggtcaaagatgctgcacaccatgc

SEQ ID NO: 48777 - DNA, 412 bp, Zea mays
  Clone ID: LIB3067-044-Q1-K1-F6
gctgcattctctgctggtcgcttagtataagcaatattttgtgtgcttagggaaggtgtttcgtctgcagaggcagcaccatgcactcttccattaagtgtaacatttaatgattcttcacctctacgggcaattcgatctgcatcatggaaaccattttgattgttggctgcaactccatttgctattctagcccgagaaggcagcccttgttcactttcatcatcgttgttatgcttggagacaatcccagctccagtgttgctttccccaacatttgcaatacccgattttgttgttcggctctttgacttaactaggtcaggatcctcggagccatgttttcgctgaacacccaaaattggctccagaaaagttgtccatattctcatcactttatctaattgatctg

SEQ ID NO: 48778 - DNA, 391 bp, Zea mays
  unsure at all n locations
  Clone ID: LIB3067-044-Q1-K1-F9
gacccacgcgttcgctgacgcgtgggcaattctgtccggaattgcattacgagacgaagcagcagacgaagcgagccaggatccttagnaatacgggggtacgcgtatgtcaccagcatgctcttagcacaaataatgtccagatggctgcagagctggtagcagtagcagaccagaatgctctatgtatgtttcacgtcctgatggcagatgtgcgcgagaaagcaaccctatttatctgagggattactacgagatcaaggaaaatgaggtcgcgttcttaaaagagcggacggggtgcagacagaacgcgatcgccaagatcgtcgaggacaagcacaaggacaagctcccgtccaactttcgcaagctcctgctttgccagctcaag

SEQ ID NO: 48779 - DNA, 305 bp, Zea mays
  Clone ID: LIB3067-044-Q1-K1-G1
ccactcgtccgcctacgcgtccgcctttgcgttcgccctgcgttctcccacgcgtccgaaccaagacctgatcagttacttcatgtctgaccctgtccacggtgccatcgaagtctgcgctcagctgaggcccactgttgacatctcagtgaccgctgatgcagatttcgtgcgcccagagcttcgacagtcttcataagcttgtatggatccgcagtgtgactgcaatggctagcttgtaagaacttaatatgcctgggctcttgaactctcagattgtgcctgtatagctcatgtttgaggac

SEQ ID NO: 48780 - DNA, 209 bp, Zea mays
  unsure at all n locations
  Clone ID: LIB3067-044-Q1-K1-G10
aaagaacaacgcagggagccacaccccaaaanagaaagcnggaccaagcgaagggggcgcagccggacgcaagcgaccgnacaacggacaaccagcgcganaggcacaanccccgcagccggacaagcaaacggcgagcacnggaggccgagagcgagcacgagaggacggcccagcgacaagagcagaaaaggcaaacacacacaggc

SEQ ID NO: 48781 - DNA, 402 bp, Zea mays
  unsure at all n locations
  Clone ID: LIB3067-044-Q1-K1-G11
cctacgcgtccgccttcgcgtccgccttttnattccatgcaaaacaacgtgtgggtttagaatgactaaccagttaaactatttgtcaccagctattatcaccaaaaatcatgcaggtaatatcaagaatataaaaactcggccggtggggaaagaccgccccacggtatttcactaagaagagctcaatcagagcatgagctggccccctcatacatagggatgtctcccctatggttcgggccttgacccatgctttgaggcccaacccacatgaccagcctcttacacgagggctcgttcacccatgccgactaagagaaccagcgagtgacgttttttttaccacagtctgaaatttgatctcacagggagtcgaacctaggatctgagtggtgctac

SEQ ID NO: 48782 - DNA, 438 bp, Zea mays
  unsure at all n locations
  Clone ID: LIB3067-044-Q1-K1-G3
ctcggcttaacgcgtttcgggtgcccattggcctctggcccctagccctcgccctcccttttctattgctccgaagcccgagttgcgagctgtctcctccactcttctccttcactgtcgcagccgccccttgtagaagcttcgaggctgctgctgctgcgcccatggccgcggaaggcaagacgccgtccctcgccgaggagtattcacttccaccacaggaagttccagtggaaaaggcagctgaggagaagccctctagtggtactgagtctgaagctgctccctcaaccaatgatgaaactcctccatctgtagaagacaagaatggaacttctgaagtacaagatgctgctgaaaatccagaggcagaagaaactaacactgctgcanaggaaacacctgctgtagaggaagcaagtgagactaccgaggagg

SEQ ID NO: 48783 - DNA, 384 bp, Zea mays
  unsure at all n locations
  Clone ID: LIB3067-044-Q1-K1-G4
aaaagatcttgcgcttcattatgtatgttgtagtccgnggagctaccctngtgacgggtggngataggttgggtgacaggggttgctacatccatccaacgattttctcagatgtccaggacggcatgaagattgctcacgaggagatatttgggcctgtgcagtcgatcctcaagttcaaagacctcaatgaggttatcaagagggcaaacgcgagccagtatggattggccgccggcgtgttcaccaacagcctggacacggccaacaccctgacgcgcgcgctcagggccgggaccgtctgggtgacctgcttcgacgtcttcgatgctgcgattccagttggcgggtacaagatgagcggcatggggagggagaagggcc

SEQ ID NO: 48784 - DNA, 373 bp, Zea mays
  Clone ID: LIB3067-044-Q1-K1-E6
cgtctcgcgtccacttcccgcgtctagtcctctcctcgcgtgcctctcgcctccggcgccccaggccgtgcttgcctgccgcgcccaccgccggtccgcgctcgcgcctacacggagcatcaggagttcaggcgcggcgaacaggggggagaagcagccaacctcgctcgctactcgctagcctagtcggcggttgccatggggatcggctacgtagtgggcgttctcggtggcgccatcctcgcccacgccgcctacgccaccatccagtaccgggcggtgctcaagatcacggaggaagagttctcgcggccgcccatggatgtgatgatggagttgctcctagggttggctttgtgcatgtgggcaggtc

SEQ ID NO: 48785 - DNA, 345 bp, Zea mays
  Clone ID: LIB3067-044-Q1-K1-G5
gatcgttcataagtgtgcagattattatttggtgggcccatatggcctaatctgacaccaatgcatatcgtcctgagctgtacaaacagaaactacaggccaataatagcttaatttttagagtacaaaaatctgttatttgcctgatagtttatctggagcagtttcattttacatatgactgtaatttgtgagaatgtacatcttacgatttttgttgaccagtattcataggtttttagttagcaatgtgttgttggcccgttgctagtccttgtaatacaagcccacctgtttatttttgcgcatggcaagacttaacctggaaaaaataaatacaaaatt

SEQ ID NO: 48786 - DNA, 447 bp, Zea mays
  Clone ID: LIB3067-048-Q1-K1-B10
cccacgcgtccgagtttatctaccggtattcgtcgaaggagcgaatcttagcaggggtgggatgcacttctctcagggcgatggtgaagtttcgttttgtggagcaattgaaatgagtggattccttgagctcaggtgcgagatcataagaggcgggatgaaggaatacttgaccccagttggtccgacaccgctacacgtgaaccctatctttgagatcggtcctgtcgagccgcgcttctcggagtggctagtgtttgagggcataagcgtggatgaatctgggaagcagcatttccttgatgcgtcagttgcttacaagcgtgcagtcctgaacgccattgagtacattgctagatttgggtactcaaaggagcaagtgtatctcttactatcatgctgtccctgtgaaggtaggatctctggaatagttgactctcctaatgc

SEQ ID NO: 48787 - DNA, 473 bp, Zea mays
  Clone ID: LIB3067-048-Q1-K1-B11
aataatccgggccgacggatggacccacgcgtgcgccgagctcattgctgctggcatgtagaagtttgcttcagtcccatgtggcgggggcggggtggctgttgcggcagctgcccctgctgctggcggcgctcctgcagctgaggcgaagaaagaagagaaggtggaggagaaggaagaaagtgatgacgacatgggcttcagcctcttcgactaagcctgtgcaatagtcaagagtattgtttttgagtcgcggaagcagagggaagaaaaatcgtagtcatgtttggactttaactttgttttatgttggaaagtacttgaaagacttttcctgtggtaattctaggcgtaggttgctgtgctggttggggtttactggtgaaccagagtttttctatctcccactatgaatttgttacctcaagttacctggatgttcactattttgttggtacatgtcgattttgcct

SEQ ID NO: 48788 - DNA, 445 bp, Zea mays
  Clone ID: LIB3067-048-Q1-K1-B12
cacttgctctctttctccccagtttcaactgccgcgcatcctccgccgccgcaggaaacgctactccatgtacccaggtctgcgtcgggcccttgccggcgatgagaacccgtcagttccaaagatggctcgtcgtggattgatggaacaggacttaagcaaactggatgtgacgaagcttcaccccctgtcacctgaagttatctcacgccaagcaacaatcaatatgggtaccattggccatgtggctcatggaaagtccactgttgttaaagctatatctggtgttcagactgttcggttcaagaatgagctggaacgtaacattactataaagctgggttacgctaatgcaaaaatctacaaatgtgaggatgacagatgtccgcgaccaatgtgctacaaggcctatggaagcggaaaagaagatagccctctatgtgat

SEQ ID NO: 48789 - DNA, 407 bp, Zea mays
  Clone ID: LIB3067-048-Q1-K1-B3
cggacgcgtgggtttgaagaaatggctatttcaacaaataattttgatctatcagcccgagttgggcaaggaggttacggcaaagtctacaagggaattctaggcgatggagcacttgtagcaatcaaacgagcacacgaggattcccttcaaggttcaagggagttctgcacggagatagagctactatcaagattgcatcatcgcaatttggtttcattggttggctattgcgatgaagaggatgagcagatgctggattatgaattcatgtcaaatggcactttacgtgatcatctttctgccaagtccaagagacctctaagttttggcttgaggttgaaaatcgcattgggtgctgcaaagggaatttttgatctacatactgaaacagatccacctatatt

SEQ ID NO: 48790 - DNA, 257 bp, Zea mays
  Clone ID: LIB3067-048-Q1-K1-B4
cccacgcgtccgtccacgcgtccgatcaataagacatatctggtagaatcataaccataggatacgaccctaatcgaaatgcatacattcgtctcatacactatggggatggtgagaagagatatattttacatcccaaacgggctataattggagatactattgattctggtacaaaagttcctatatcaatgggaaatgccctacctttgaccgatatgcccttaggcacggccatacataacatagaaatcaca

SEQ ID NO: 48791 - DNA, 363 bp, Zea mays
  Clone ID: LIB3067-048-Q1-K1-B5
cagcctgcctgtccactgttggcttggtgacttcctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagcccggacaagtactggagcccccaccccaagaccggcgtgttcggcccggcggcggtggaccccaagctggccgctggtggcgcgccggacgccggcgcggatgctgc

SEQ ID NO: 48792 - DNA, 440 bp, Zea mays
  Clone ID: LIB3067-048-Q1-K1-B6
cccacgcgtccgcccacgcgtccgcggacgcgtgggttccactccgacattcacgtgcagctgtcgggagcaggcaatggcgccggatctaagcgaactcgccgccgccgcggcagcccgtggcgcctacctcgccggcgtcggtgtcgcggtcctcctcgctgcctccttcctcccagtagccgagtcgtcctgcgtgcgagataactcattggtgagagacataagccaaatgccgcaaagcagctatgggattgaaggattgtcacatataacagttgctggtgcgctcaatcatgggatgaaggaggtggaagtgtggcttcagacaataagtccaggtcaaaggacgccaatccacaggcattcctgtgaagaagttttcactgtcctcaaagggaagggtacgctcttgatgggatcaagctcactaaagtacc

SEQ ID NO: 48793 - DNA, 440 bp, Zea mays
  Clone ID: LIB3067-048-Q1-K1-B7
aatatctggtcccaaccggtggcaacaagaacctttctgacagtcagttttgacttgccgctttgtcacggatgcaaaggccaaagacatgaggtgccagcaccttgatggaactgccattgagccacctacctgtccaaaatttggtgttaaccccgttgcccacctctgtctccactgcataatcaaacaaggcctaagtacaacccttaatcgagatcccaaaatctgcccaggcctcgtactaagagtgatcaaacaaccaggtgatttttcacaaatttgaactatgagattttatctgcactgaattgtttctgtttctccaacgccctgcaggctgcttttttcgatctcttatttcttttggattaggttcagaatttcagttttcatgcattcattcatgttccaggcagttttatatcctgaaaagaatt

SEQ ID NO: 48794 - DNA, 404 bp, Zea mays
  Clone ID: LIB3067-048-Q1-K1-B8
ctcccttgaggtgttgcctgagaggtgctgctgaccgagtagcatcattgaagagttagtgtcgagcacttggattatgtgatcgatgtgcagagaagtggttccaagggcacaagtgtgccaacatggtgcaacttcacgccattgaggaagtctaggatttgctcaccttggatgaagctatagtggaagtcattgaaccagcagaggaactgatgatggttgtatccctgtctaatgcggcatggtccggatctgacacgatatcaaccatgagattacagggtcagattcagcgacataatctcttggttcttattgattcagggtcttcacatactttcctcaatgacagtcgtcgaccactattgttcggagtccaagaattgacaacaccaattaca

SEQ ID NO: 48795 - DNA, 441 bp, Zea mays
  unsure at all n locations
  Clone ID: LIB3067-048-Q1-K1-B9
cggacgcgtgggcgcgcggcggtcgcggatgcgcaagcagcgccacctcgacgagctgagcgcgcatgcggcgcacctgcgccgcgagaacgcgcacgtggccaccgcgctcggcctcaccgcgcagggcctcctcgccgtggacgccgagaacgccgtcctccgcacccaggccgccgagctcgccgcgcgcctcggctccctcaacgacatcctcgcctgcatgaacaccaacgccgtcggcgccgtcgccgtctccctcacagccgccgccgccgccgccgtcgcttcctccgacccctgcctcgccttcgacggcgccaccgtcctggacgacctnctcagatcctgccccgagaacatgttccagtaccagctctgctagctccagaccgcgcgaagtcaccatggcagcgcaaaacaccttcttttcttttcttt

SEQ ID NO: 48796 - DNA, 166 bp, Zea mays
  Clone ID: LIB3067-048-Q1-K1-C1
cggacgcgtgggtatagtgttcagtttgcgttcattacattcgattcgttgcagcttgtgttgtatgtagcctttttgacgtgtagcacgcttggtgttgagagcaatgtacacctgtactgttgggttggttgtgattatacacgcggttttttttggagctagc

SEQ ID NO: 48797 - DNA, 448 bp, Zea mays
  unsure at all n locations
  Clone ID: LIB3067-048-Q1-K1-C10
cttcactatgctgtctttgaatgttcaccaaattcaaccacagaaattctgatgcaaaggacaccaaacttttttggtatattgcaaagtttggttagtatttggtccaagaaagagtttattcagtcatattcagtggagcaacaagcttgtatcctttgagccactgaaaattacattgcttcattttttatacaagtattatttggcatcattctccttaataaatgcagatatcactgcagcaattggattatgtttggaaaagctaacagaaaaagaattagaaacaactaaagatgtattgaattctattcttcaaggagtaagctgtgagttcacccttgtacattagcttaccagaatttgatatgagtaacgataacatcttcttgctgatttgttnttgtcactctaggcaggttagagagcccaattgatttattac

SEQ ID NO: 48798 - DNA, 449 bp, Zea mays
  Clone ID: LIB3067-048-Q1-K1-C11
cggacgcgtccgcccacgcgtcctagggcacacgcacggcacgcagatacatatagagagaggttagctatagcttgcacatctatttaactaactaactaactggctagctagctcgatcggcagagcaaagcgaaagcagcaagaagcaaagcaatggagaaccctgcgagtgtgctagttctaccagcgcagttcaccaaactcaccttccgaaacctgtacatccgccgggccgggccgggcagcagggagataaccgaggagggcaggtgcgacctggacaagagatacgtgagtgacttccccgtctacgacggccgcggccccgacgccagccttgtggcccgcgtgcaggggatcaccagcgaaatcgggaacgcgcaccaactgttcgtcgttgttttcgacaccgacaggctcaagggctccacgctcgtcaccaatgg

SEQ ID NO: 48799 - DNA, 405 bp, Zea mays
  Clone ID: LIB3067-048-Q1-K1-C12
agcgcaggtacgctcatctaccaaagaagactacaacgaggacccagtgccagtgccggggcttaacgacacacggagttccacttcagctaccatggaagaggcagaccttccacaggtggtggcggttcccgtccccgctctaaacagcacagagggcgacgaaggagacagccctccggaagacgaaggacgaggcaggccgagctaccagaggaccttgtcaggcgggctgcagagccccagagccacccaagtgccccagagggcgatcctcgagaggatgaagtccaagggcgagttgtccaagtcgtaccagctcgggcacaggctgtccctcaaatggagcaccggggctggcccgaggatcgggtgcgtcaaggactacccgatggagctccggat

SEQ ID NO: 48800 - DNA, 314 bp, Zea mays
  Clone ID: LIB3067-048-Q1-K1-C2
caaatgcattgactagtggtgtgactagctatgccactacaggtgatgctatatctgagggcttcgaaagaggatcgactgcaggagcgcctgagaagggctcgagccttgaatatgccttgcaaaatgactcgactgcacagtaagctggtgtgacagcaactgggaacaacaccgatctcttcaaggacttgctaagctacttggtacagtaaggcacaccgtatggtacacctgatccttctgggtagatggaggtcatcatcgacatgatttgatcactgtaacaatcactatctcactgattgatcagc

SEQ ID NO: 48801 - DNA, 358 bp, Zea mays
  Clone ID: LIB3067-048-Q1-K1-C3
caagaactgtcgcaatgggaggtctccgaaagagaccaggtggtggttccatgatgacggcgtgtgatgggtgttccgattattgttgtcctgtatgcatttagttgccagactatatgggagatggacttatttcgaacgacccatttgaccagaaattaacatgctcttgtggtttgtagatgaatgtgcatcagcgtcggcctgtactttctgattcttacaccgtcgatgatatatagaataatgtttgtatcttgtcaatttacggaacagacatgaaattcaatgcaggtcactggtttctgaatcaaaaaaaaaaaaataaattaaaaaaaaattaaaaaaatattaattt

SEQ ID NO: 48802 - DNA, 314 bp, Zea mays
  Clone ID: LIB3067-048-Q1-K1-B1
cgccaatgttgtcatccaacgttctggctgcacttaccctgagaagcctgacttcaactggagccggttcagaatttagagtcttatggcatctggtctgtataattagtcgggttcgccttggtctgtttacggcacattctagtgtcaccgtacaggtcaaatgttcatgcgtgtaaggcgtgtcatactgtcatggcactctacaagtgcatgtgccagaaacgtgcatgcgtctctcggttacggactctttacagttgcatctaaaacaattcaaagcaccttgcggtgcatccttgaaaagttggggc

SEQ ID NO: 48803 - DNA, 386 bp, Zea mays
  Clone ID: LIB3067-047-Q1-K1-H4
ggaattccgacctacgacgtatcgcccacgccgttcgcccacgccgtccgaaaaatgaattgtgacacagaggagctctactaagggcaatggtaacatcaagcaatcgagttgcataagatggaatgtgcagatcgagccaaatcaaaaagaggaacatcattactggagctccaattcatactacccgtcgactatatatgaacgaagcctgcctagagctcaacatgaagctgaatcagcagcatgtcaaatcgaaatagatggaaacgacttcacacaacaatagagcacgctgtactggctacaaatatgtttctccaactgctcggagaaagacctactgaacaatactagatactaataccattgcctacacattacag

SEQ ID NO: 48804 - DNA, 305 bp, Zea mays
  Clone ID: LIB3067-047-Q1-K1-H6
cccacgcgtccgctagccagccggcaaatatgagctgctgatggtaatgatgatgataagaggccactgctaccctactacgtaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaagg

SEQ ID NO: 48805 - DNA, 430 bp, Zea mays
  unsure at all n locations
  Clone ID: LIB3067-047-Q1-K1-H7
cggacgcgtgggcgacacgacaccaataatggcggcggcaaggacaaggagcctgctcggggcggcgttcctggcgctggcggcggtgccggcggtgctctgccaggcgccaggccccgcggcggcggcgccgcccaacaagggcccgccgaacgttacggcgatcctggagaagggcgggcagtacacgacgttcatgcggctgatgaagtcgacgcagcaggacacgcagctgaacggccagctgaacaactcgttcggcagcgggtacacggagttcgcgcccaccgacagcgccttctccagcctcaagcccggcacgctgaacaagctgtcgcagcatgagcaggtgtcgctggtgcagtaccacgtcctgccgcagttctactcgctcgactccttcgagaccgncagcaaccccgtgcgtacg

SEQ ID NO: 48806 - DNA, 212 bp, Zea mays
  Clone ID: LIB3067-047-Q1-K1-H8
cccacgcgtccgcccacgcgtccgcatctaattccaccatggccgcgcgccacagcggcgcagccgatggatccttccatgttcctccgtccgtccgccttgctacaagcaggcagccacaccaataagctagctcttgttgttgttttgtatgtttgattgggtgtcccttcccagtcgagatggaataaaataaatcatcaggcgccaat

SEQ ID NO: 48807 - DNA, 441 bp, Zea mays
  Clone ID: LIB3067-047-Q1-K1-H9
gccagtcagccacatcactagctagctgtgcagaggcaatggcgtccaaggttgagctggtggtggaggtcaagtccccggctgacaagctgtgggcggcgctgcgcgactccacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaggcggacggcgagggcggcgccgtcgtcagctgggccatggagttcgacaaggccaacgaccaggtgcccgacccggacg

SEQ ID NO: 48808 - DNA, 327 bp, Zea mays
  Clone ID: LIB3067-048-Q1-K1-A1
agcaacagcaagtcagcaacctacctagctagagctatcactatcagtatcaggtacctagagctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcagcaggcgggagaggacgtgaagcggccggacacgctgcacgaggggacggtgctgatcccggggatggggcgctacgagatcggcagccactacatcccggacatcggcgggctggaccacagcattccc

SEQ ID NO: 48809 - DNA, 415 bp, Zea mays
  Clone ID: LIB3067-048-Q1-K1-A10
aggagcttctgagcggagagaagtgaaggccttctgcagctaccaagtgacaaaggcctggtgtctgatccatccttccgcccacttgttgacaaatacgcagcggacgaggatgctttctttgctgactacgccgaggcccacctgaagctttcagaattgggatttgctgaggcgtaaagtgagagagaacgaaccagaagagtgtggtggttgtcgtcggccggcaggccttgtgtttttgttgtctgcttttctcttgaatgaaaatgtgatgaactctgctgaagatgtaatgtgtatgttgtcatggttcatttttctattttatttatctataatatctgtcggagaagctttgatatgaagcgggatctggttcggaacactgattaacgatgccaatgccttcaca

SEQ ID NO: 48810 - DNA, 446 bp, Zea mays
  unsure at all n locations
  Clone ID: LIB3067-048-Q1-K1-A11
attgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgngcaagcttggtgccaagctgaccaagctcaccaagtctcaggccgactacatcagcgtgccgatcgagggtccctacaagcctgcccactaccggtactaggcagccagcacacggcttgcagctcactcgggcccgtgtgtgctatgaag

SEQ ID NO: 48811 - DNA, 446 bp, Zea mays
  Clone ID: LIB3067-048-Q1-K1-A2
cccacgcgtccggacccacgcgtccgctcgcaattttcaagatgcgagaagatgatctactgcgcgtccaacatatcggtgatgtgattgatattttgcaaacaaccacacatcatctatatgaccctgatgaactcctgacattcgcgtttgacaagattggttcaatgccaacaaatacaatcacaaaggaaaggaaaaagcaggagactgttgtcctggctgagcttgatcaaagaacaagacggctgagttcactcaagatggatggatagtttgtaaaatacaagttcttgaaagctgtagtcttggcctattcggcacctggtcccacagcgtatgcttcactgagcgaaaaatcatgggtctaccgaatactgggagatggaaagctgcagtatgtgtttgttgaacacgagtttttggacttcatattgtgtgctttt

SEQ ID NO: 48812 - DNA, 455 bp, Zea mays
  Clone ID: LIB3067-048-Q1-K1-A3
gaagaaatggtacctcacaccatctgtcattgcgcttatgggaggactgcttccttttggtagtaggtctattgagatgtactttggcttcacatcgttctggaactataagggctactatgtttacgggttcatgtcgctgggctttctgatactcatcattgtcaccatatgtgtaacaattgtcggctcatatttcttgctaaatgcggagaactaccactggccatggacttcattcttctctgctgcttccactgccgcgtatgtttacctatactccatatattattaccacatgaagaccaagatgtctggattctttcagaccagcttctataacggctacactctaatgttctgcctacgcttatgaacactatgctgtgccgactagtatcttggatcgacatttgttgtgaagaagatctacaggaaccataagtgtgactaat

SEQ ID NO: 48813 - DNA, 441 bp, Zea mays
  Clone ID: LIB3067-048-Q1-K1-A4
cccacgcgtccgcggacgcgtgggattgtgcaactccatgatttgaagtattcctggcatgatcttgtatcaagggggaataaaaatgctttgaccattctgagcctatgggcaccagtcttagctatatacctgatggacatccacatttggtacactcttttatcagcacttgttggtggcgttatgggtgccagagatcgccttggagagattcggtcaattgaaatgcttcataaacgttttgagagctttccagaagcgtttgctaaaaacctttccgcttcaaggatacctagcagacgcattgatcgtgtaaatgaatcagaaattacaactaagacgtatgcctcaatattttccccattttggaatgaaattatcaagagcttgcgtgaagaggactatatcagcaacagggaaatggatctgcttatgatg

SEQ ID NO: 48814 - DNA, 278 bp, Zea mays
  Clone ID: LIB3067-048-Q1-K1-A5
cccacgcgtccgcaaagttatttcataaatttgctcgaatcatctttgattctgggcctggtagattcaacgcatacgcttgtaccaaatctgggcagtctgataagagccttaatcaatcatgcctgctattttctatggaagcagctatgacacatatgccccttcaactctatctacaactgcttcgtcagcaaagacaatcgatgacatgatcacgctctgtaaactaggataaacactttctgaaatacctacagaagtatacaatcagatct

SEQ ID NO: 48815 - DNA, 412 bp, Zea mays
  Clone ID: LIB3067-048-Q1-K1-A6
cggacgcgtgggtgcgcctctacatttcttctctctctgctcctccgcctccgcctgatgcatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctgcaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgggagccttctgacttcatatggcaa

SEQ ID NO: 48816 - DNA, 413 bp, Zea mays
  Clone ID: LIB3067-048-Q1-K1-A7
acgcacgcgtccgatcgagtccaagcattcaccggagaatcctaaatcacactctccagtaaccgcgcgcttgtccagccgcatctctagccgagtctatctcctcctcctcctccgccgccgcaactatcctaatggctcgcttcgccgtggtcgccgccatcgtcgccctcctcgccgtcgtcgcggcggcgcaggccccggccgccaccccgaccacagctcccaaggccgcgcccaggatggccccgctgccgccaccccctgtgcggtccccggccaccgtcccggcgccggccgtcaagccgtcgaccgccgcggcgccgaccccgctggcctctcctcccgccccgtccaccgaaggccccgtcgtctctgcgccgttcgtgaaagccccgaccctgtccgtcttc

SEQ ID NO: 48817 - DNA, 418 bp, Zea mays
  Clone ID: LIB3067-047-Q1-K1-H3
cccacgcgtccggtgggggtcctcggaaatgtgttggagatcaatttgctctcctagaagcaatagtggcacttgcagttgtgttgcagaagatggatatgcagcttgtgccagatcaaaagattaacatgactactggagctacaattcatacaaccagtggactatatatgaatgtaagcctgcgtaaagttcagcaagaagctgagttagcgctgagcgaatcgaaatagatggaaacgacttcagacaagaatagagcacctgaactggctacaaatatgtttctccagtttctcgttgaaagctctactgtactatactagatgtcaatgcgtcggcatacagattacagattcgcttctcttgaaacatgaaaggatccttcgctggctgattcgtttggctattcgtgtgt

SEQ ID NO: 48818 - DNA, 443 bp, Zea mays
  unsure at all n locations
  Clone ID: LIB3067-047-Q1-K1-F9
gcctgctccccttcgtctgtgatcatgtcttgcagcatcggcaagtgcaactgcggctcgggctgcgcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaagcgtataaatataattaatagcagcgtctaaataagatcctgtcaactgcacccgccattatcgatccatggtcgctcctggggttcatgttcatctgtgtaacgtgctcgcngtcatg

SEQ ID NO: 48819 - DNA, 418 bp, Zea mays
  Clone ID: LIB3067-047-Q1-K1-G1
atttgagaataaggatagggaattcttggtgacagtcactgtaaaaagattggtgataggtggtggtacaatgcatgcaaaaaatgcacccgcacagctgtggctcatggggattcctacaagtgcagcgatcaagtttgcgctaacattggcacgcctagccagaggtacaaactgcttctcgatgcaggggatgagacgggtgacacagacttcatcctctttggtcggatggcgcaacacatcatcaagaagccgtgcgatatgctcattgccaacaatccgatcggctttattcctgatccaatcacagatctgctcgagaagacgtatctatggaatgtgagtttctctgaccacacaatcaatactggaaatatttgtttccaggtcaacgcaatcgtggcagagataggta

SEQ ID NO: 48820 - DNA, 453 bp, Zea mays
  Clone ID: LIB3067-047-Q1-K1-G10
cggacgcgtgggcaaccggcggtccatcttgagaggaccaagaaacagagagagcggttgtacgtccgagtcgtcgcatcaggtcccctcgattcgccggcggcggcgccaccaaccaagctcatacatctgaattgactagtccaactcagggatttctttggggaccaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagctaggccaggtcattcaact

SEQ ID NO: 48821 - DNA, 446 bp, Zea mays
  Clone ID: LIB3067-047-Q1-K1-G11
caggaacacttatctagccaagcaagaagagtgcacgaagaagatccgagatttgggcttgttgcctgctgatgcttttgaagcgtacaagaggaaacaagaaacagctacataagatactctatgactgtaatgagcagttgaagcagtttagtcatgtgaaccaaaaggctcttgaccaatatgtgaacttcacagaacaacgcgaacaactgcagagaaggcgagctgaacttgatgccggtgatgtgaaaatcatggaactcatatcggttttagaccaaaggaaggatgaatccattgagcgcacatttaaaggggttgcaaggcacttccgtgaaagtgtttctgagctggtgcaaagtggtcatggatatttggttatgatgaagaaaaaggatggggatgcaattgatgatgatgaagaagaagatggacctcgtgat

SEQ ID NO: 48822 - DNA, 106 bp, Zea mays
  Clone ID: LIB3067-047-Q1-K1-G12
cccacgcgtccgaaaaaaaaaaaaaaaaataataatttaaaaaaaaaaaaaaaaaaaattgtaaaagttaaaattcaaaaaaaaaaaaacatgactcccattttat

SEQ ID NO: 48823 - DNA, 455 bp, Zea mays
  unsure at all n locations
  Clone ID: LIB3067-047-Q1-K1-G2
cgcagaaacttcttcttcgaagttgaacaaagttcttcttcctaatccatttgatagaccgcgtgctgttttcctcgtgcaaattgctgggttcgatgttcctagcttcgtatctgaaggcagcaacattttcaagaccaggattgaaggtgcaaacatcgctgatacagggcttacagataaggatgacttaattgtcattcattcggatgaatctctagatctctctcgatcagattatcttgataatgaactttccagcttggcaaactggttggagggatcttatcagaagtctaccggcaaactagtcattcccttggagaatggaaacagtcttactttgcaacttgataaggaagcagacaaggaattcatgtccagcttggctttccttcttaagactatttgaagggcgatccanngtcatgaagatttctcaagtgtcgtgaacc

SEQ ID NO: 48824 - DNA, 439 bp, Zea mays
  Clone ID: LIB3067-047-Q1-K1-G4
cccacgcgtccgcccacgcgtccgcggactcgtgggttttactatcaggaacatctctggattggcactgagttactacgggcaaatctttatgagtttcagaaatataaccaggagtcttgttacgaggtgtacttttcactgcccagaatacaggctatagctcgacaatgcttggaggctttggtgtacttgcatcatttaaacatagttcactgtgatctgaaaccagagaatatccttctgaagagctacagcagatgtgaaatcaaagttattgatcttggaagcagctgcttcttgtcagataacttaaacttatatgtccaatcacgttcttaccgatctcctgaggtcatcttgggtttaccatatgatcagaaaattgacatttggtctcttggctgcatcttatctgaactgtacactggtgaagtac

SEQ ID NO: 48825 - DNA, 447 bp, Zea mays
  unsure at all n locations
  Clone ID: LIB3067-047-Q1-K1-G5
gctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgngcttgctcttaacttctcagtgttctattatgagattct

SEQ ID NO: 48826 - DNA, 305 bp, Zea mays
  Clone ID: LIB3067-047-Q1-K1-G7
gctgagcgttcacgagcgcaacctctcgtttgtcgcatacaacaatgtgatcgggactcgccgtgcttcatggcgcattggctcttctattgaacagaaggaggagtcccgtaagaacgaagagcatgtgaaccttatcaaggaataccgtgcgaagatcgaggctttattgtgttatatcttatatgtcatcctgaatttgctttactcccacctagtgccttcttctactgctgctgaatcaatggtcttttaccttatgacgatggtttactatcaaaggtatcttgcggaatttaagactg

SEQ ID NO: 48827 - DNA, 269 bp, Zea mays
  Clone ID: LIB3067-047-Q1-K1-G9
ctccaaaatatgattcgtctggtctggcgtgcgtgagtccagctcgtgtgtcgtgcgtgtctctgtgtgaggtgtcgtcgggcgtgtgtatgtatggacagtcggccgcggcggcggcggaggtgtgcgagtggtggtggtggtacgtgcttcgacgcgccactgtttgtcgcggcgatcatgtactaccctgctgcgttttctggttatcaatgagatgatttatttgattcttttcagcctgggcactaataagcgcacccagtttt

SEQ ID NO: 48828 - DNA, 434 bp, Zea mays
  unsure at all n locations
  Clone ID: LIB3067-047-Q1-K1-H1
cagacggcggtgcaggtcgtcaagggcccagggccggcgcacccggcgatgcccggctagcactggggcgacaccacggtgatcgacgacgcgctgacggacgggcccagcgcgtcgtcgtcgcggctcgtcgggcgcgcccagggcacctacatgctggcgtcgctcacggagtctgtgctggcggtgttcatgaccgtggcgcttacggccggggcctacaacggcagcgccgtcgtcgtcgtgggcgcgacgacgtctcggcgggcgtcagggagctcgcggtggtcggcggcaccggcgcgttccggagagctacgggccacgtgctgtggcggacggccaggatggagtcccgggaccacatggtgctggagctcgacgtctacgccaccgtgccggccgctagttcggcttcgnctccgcgcgccgga

SEQ ID NO: 48829 - DNA, 451 bp, Zea mays
  unsure at all n locations
  Clone ID: LIB3067-047-Q1-K1-H10
aatattgatgcgttttgggctcgtctccattaggaaaacactaagcgtgaaaaggctgatagagagcgaatgcagcaatttgttactctcattacaagctcaataaataaggacttaccatctaatctggagaagtcacttaagaaagaaatttcttcacttgggcctgttgttgctcgtgcaattacgcctattattgagaagtgtctaacctctgctgtttctgattcagttcagaaagggttgggtgacaagttgttcaatcagctggaaaagtctattactggaaaacttgaagctacacttgccaggcaaatccaaatccagttccatacatctggaaaacaggctcttcaggatgctttacgtactagctntgaatcattgcttgttccagcgtttgagcaagcatgcaagacaatgtttgagcaaatagatggtgcatttcaaa

SEQ ID NO: 48830 - DNA, 392 bp, Zea mays
  Clone ID: LIB3067-047-Q1-K1-H12
ggagaggaagagtcttgcctgcttttcctttttgaactttcttttgtgccttcacctgtgttacattttgagtcgagggctcctcttaaattgtgtgcagaggggctcgattttgttaccccagaacaaggcgcatgtgcgtcggcgtcgtcttctgccaccgtatctatcgaccttatgtacatcttcatctatatatagtatgagttttgatgtcatctatttcttggatgtctcacaaggttatttatttgtaaaaaaaaaaaataaaaaaaaataaataaaaaaaaaaaaaaagatacaataaaaaaaccccataaaaaaaaaaaaaaatacatatataaaacaaacatctaatataaactatacttactttcattatacttacatac

SEQ ID NO: 48831 - DNA, 451 bp, Zea mays
  Clone ID: LIB3067-047-Q1-K1-F8
cggacgcgtgggtgattggctattatgcttaagaagattctaatgaacggatggtggtgtatgaacggctttatcatggaagcttacataagctactctttgtaagatcagatggtcgtgtcatggactggtctagacgtttgtaggttgccctgggtgctgccagacgtctagctatcttgcatgatgaaggaccctttcaggccatgtacagcgagttctcaactttgaacatccaaatagataaaggttacactgctaagctttcaagatatggttgtgatggcttcaataccgaggagatatctaatgcacctgtgtctgcagcaaacctttcggtggagaccttgtagaagggtttactcactcccaagagcaacgtatgtagctttggagtcgtgttactggagctaatcacttggaggaagaaccttgatcccaattattccaa

SEQ ID NO: 48832 - DNA, 273 bp, Zea mays
  Clone ID: LIB3067-047-Q1-K1-E4
catttgtaagctaggtgggcttcaacgacattaaaaataaataaataaatgtatgtaactactatccaaatttctcatataattttatttttcattatatatttacagtataataaacatactcgatacattcacacaaccatcctagtatataaatctgaactgatataaaactaaattaaaatatacaaacctatctctttaaaaaatcaaaacaaacatacacatgcattctacaatatatcattaactaatttaaatccaaatacaata

SEQ ID NO: 48833 - DNA, 321 bp, Zea mays
  Clone ID: LIB3067-047-Q1-K1-E5
tagacgtacgcatcagtataagcttcctaaagctcgtgctcgctaacatacatagtcaaactgtatgaggtggcggggacaattgtatgctaggtgggcttcatggacattaactataaataaatgaataaatgtttgatgtatgaagatcagctctagtatgctatgtatgactccatattcgtcgtattatgacatggtgtgctcatgaagtcaagtgtgactagtgtatatattgtggaacgataacaattgcataattaaagggctgtgcagtggcattagaaaatactagcttaacgatgttgtcaatatgatcag

SEQ ID NO: 48834 - DNA, 372 bp, Zea mays
  Clone ID: LIB3067-047-Q1-K1-E6
atgatacacagcaagcgcgagcatatgatgattgccattagagagtagcgacattaacggtgttccccacttctttcccctcccgttcaatctcactggtctttgattgtattatatgtgagcatccatcattctgtgaaaaaaaaacaaaaaaaaaaatataaaaaaaaaaaaaaaaaagaaagccctataaatgatccaagacaaagtcatgcaagaatgcgacgacaaacacattctctggtgaaactgatttataacttagctctcgtactggagctatgacttgactgctaaatccctggggtcatccaacgtattcgatatacggcaaatacctcttgtaccagctcacgctgaccctaactgact

SEQ ID NO: 48835 - DNA, 285 bp, Zea mays
  Clone ID: LIB3067-047-Q1-K1-E7
gatagacataggtttggtgagaataaggtttatgcctttaaggactaattacggcaggggggtcctagtatgatagacaagtaatataaatagtagagttattgtaagggaatattagagtgattaaatgtctatgactgataaaataagaataaggtttataaactatggcaagagatgaaggttgtgaaaatatatgtgcttcaagaagttagctatgatcatagtattataatgactgatgaaactcattcaaagcatgattatgatactcaagatatgata

SEQ ID NO: 48836 - DNA, 438 bp, Zea mays
  Clone ID: LIB3067-047-Q1-K1-E8
cccacgcgtccggtcgcggcggcggtcctggcagcggcgctgctgctgctggcggcgggggccggtacggcgtcggcggcggtgagctgcggcgaggtgacgtcgtcggtggcgccgtgcctcgggtacgcgatgggcagcgcggcgtcgcctctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtc

SEQ ID NO: 48837 - DNA, 453 bp, Zea mays
  unsure at all n locations
  Clone ID: LIB3067-047-Q1-K1-E9
cggacgcgtgggcggacgcgtgggcggacgcgtggggacgccctcaaggaggacgccgggtccaggctcaccatggtctccaccgaggagatcctcctcgagcgcccccgcgccccagggagcaaagctgaggagtcagctgcatctggtgatccgctggctatggcgagcaagggaggtgctgttctcatggtttgcagaacctgtgggaagaagggcgatcactggacctcaaagtgtccgtacaaggacctggcaccaccgactgaaactttcacggacaggcctncaacgtcagatggccctcctgcaccaggtggtcctgctaagggagcatatgttcctncaaccatgagaggaagtgctgataggactggagactcgatgcgccgcaggaacgacgagaattccgtccgtgtgaccaacctctcggaggacacccgcgagcctgac

SEQ ID NO: 48838 - DNA, 387 bp, Zea mays
  unsure at all n locations
  Clone ID: LIB3067-047-Q1-K1-F1
cccacgcgtccgcatgcgcgcgggcatagagcggttccccgacctacacttctaccgcggtggccgtcccgtggcggcgccggagagtcccatggagtgtgacctcgcgtggcgcttccgacacgctgccaacgccatatgcaccggccggaccacatactacaaggactaccgacggttcacgcttacccgcgacgtcaacacctgcagcctcgtcgtcgacaccgtgggtgaataccactcgggtgtgggtgccaagcgcaatggacggcacaaggggaagaaagggaagaagggaaagcaggatgcacctgtgactgacttcgtgccggttaagacacagattaggctggacgagaacactgncaacaatgaggctgctggggc

SEQ ID NO: 48839 - DNA, 449 bp, Zea mays
  Clone ID: LIB3067-047-Q1-K1-F10
ccgaagcccttttggagataccccatgcagtacatcagcttccactactgggcactgcagggccagtgccagaacgacatgaagggcctcgtgttcgacaaccagtacccggaccaacccaagatccccggggacttcatcctcaagtacatcttccagatcaacgtggaccgttccaagtggatcgacctgtcggtcattttcagcatgatcttcatctaccgcatcctcttcttcctcatgatcaagatcaacgaggacgcgctgccgtggatccgcggccacatcgcgaggaagaggatgcagaagaagggccctacccccaccatgggcaagacgccttcgctgagaggctacgtcgtcgatccggagctcggttccaacgagggctagaagtcgtgcttgttcttttgggtagcggaaaaaaaataaggtgtttctcccccccg

SEQ ID NO: 48840 - DNA, 133 bp, Zea mays
  unsure at all n locations
  Clone ID: LIB3067-047-Q1-K1-F11
gatgagttcggtgttccctttcgtgtggtttccatcttgctactgttagcgtacccaccgtcntgggccattccgtcgctgttgacgcatgtatttttcttgtgctatggaaccttgcttttggtacggtact

SEQ ID NO: 48841 - DNA, 370 bp, Zea mays
  Clone ID: LIB3067-047-Q1-K1-F12
cggacgcgtgggcggacgcgtgggcggactcgtgggctggcttctcctccccctcttaggcaatgtcctcgggttagggttccttacggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaagcccagtcccgtggcgg

SEQ ID NO: 48842 - DNA, 431 bp, Zea mays
  Clone ID: LIB3067-047-Q1-K1-F2
cccacgcgtccgcatgcgcgcggccatcgagcggttccccgacctccacttctaccgctttggccgtcccgtggcggtgccggggagtcccatggagtgtgacctcgcgtggcgcttccgccccgctgccgacgccatcggcaccggccggaccacatactacaaggactaccgccggttcacgcttacccgcgacgtcaacacctgcagcctcgtcgtcgacaccgtgggtgaataccactcgggtgtgggtgccaagcgcaatggacggcgcaaggggaagaaagggaagaagggaaagcaggatgcacctgtgactgacttcgtgccggttaagacacagattaagctggacgagaacactgccaacaatgaggctgctggggctgcaacggagccggtgtttggtgttggtgaggctgtcaatgaca

SEQ ID NO: 48843 - DNA, 357 bp, Zea mays
  Clone ID: LIB3067-047-Q1-K1-F3
cggacgcgtgcggaactgccatcataaggtacgcgatacatatgcggaattcattggtggcctacttctacacgctgttcagagaggctcgagtaaatggcatctctgtcatgcgtcctttatggctagaatctcctgacgatcaagaaactcatcacactggcgaggcatccatggtgggacccagacttttagctcaaggaatatacgactagggccagaaatcagtgtcggtctaccttcctgggaaggagtcatggcatgactcgagaaatggatctgcatacaagggaagcgcgacacacatgctacaggatctagaagatagccattccagcttccatagaggctgtacaa

SEQ ID NO: 48844 - DNA, 432 bp, Zea mays
  Clone ID: LIB3067-047-Q1-K1-F4
cccacgcgtgcgcacacgcgtgcgcagtttcctgttttttactatcaggtacatctgtgtattgtgactgatgtactaccggcaaatctttatgagtttcagaaatataaccagcagtctggtgactaggtgtactattcactgctcagaatacacgctatagctcgacaatgcttggaggactcggtgtacttgcatcatttaaacatagttcactgtgatctgaaaccatagaatatccttctgaagagctacagccgatgtgaaatcaaagttattgatcttggaagcagctgcttcttgtcagataacttaaacttatatgtccaatcacgtgcttaccgatctcctgaggtcatctcgggtttaccatatgatcagaaaattgacatttggtctcttggctgcatcttatctgaactgtacactggt

SEQ ID NO: 48845 - DNA, 390 bp, Zea mays
  Clone ID: LIB3067-047-Q1-K1-F5
cccacgcgtacgcccactcgtccgcggactcgtgggttttactatcaggaacagggctgggttgacactgagttactacgggcaaatctttatgagtttcagaaatataaccaggagtctggtgacgaggtgtacttttcactgcccaaaatacaggctatagctcgacaatgcttgaaggctgtggtgtacttgcatcatttaaacatagttcactgtgatctgaaaccagagaatatccttctgaagagctacagcagatgtgaaatcatagttatagatcttggaagcagctgcttcttgtcagataacttaaacttatatgtccaatcacgttcttaccgatctactgaagtcatcttgcgtttaccatatgatcaaaaaattgac

SEQ ID NO: 48846 - DNA, 448 bp, Zea mays
  Clone ID: LIB3067-047-Q1-K1-F6
gcttcatcgaggtgtgctggttgccaaggttctggctttaaggtccaaatccggcagtgggggcctggaatgatccagcaaatgcagcatccttgcaacgagtgcaagggttctggagagacaatcagcgacaaggatagatgcccacagtgcaagggtgataaagttgtgcaggagaagaaggttcttgaagtgtttgtggagaaaggcatgcagaatgggcagaagatcacattccctggtgaagctgatgaagcgcctgacactgtcactggagatatcatttttgttctccagcagaaggagcatcccaagttcaagagaaagggcgatgacctcttctacgagcacaccctgaccttgactgaatctctgtgtggcttccagtttgttgtgactcacttggataacaggcagctgctgatcaaatcaaatccgggcgaagttg

SEQ ID NO: 48847 - DNA, 441 bp, Zea mays
  Clone ID: LIB3067-047-Q1-K1-F7
cccacgcgtccgatacgtaacatttctcgtcctgtggatgttcctgacgttggtcttctatgtgatctgttatggtcggaccctgataaagagattgttgggtggggtgagaatgacaggggtgtttcctacacctttggagctgacatagttgctgagtttcttcagaaacatgatctagatttgatctgcagggctcaccaggtcgtagaggatggctatgagtttttcgcaaatcgtcggcttgtaacaatattctcagcaccgaactactgtggagagtttgacaatgctggtgcactgatgagcatcgacgactccctagtatgctcgttccagatactcaagccttctgaaaagaaaagaaaagcaggagctgagaacatgccaaagcccggtacaccttccaggaagataaaaataagtgttacccgcatttag

SEQ ID NO: 48848 - DNA, 371 bp, Zea mays
  unsure at all n locations
  Clone ID: LIB3067-047-Q1-K1-E3
cccacgcgtccgcggactcgtggtcgcttttctacttcctctaactctatgatatcgccgagaccctcggcgtctcggccgacttctccgacatcaactacccatccctgaataaatgtttcatctatcacgaccagctctagtatgctctctatgactccatcttcgtcgtattatgacacggtctacccatgccgcccaccttcactagtgtatatatgntgaacgacaacaactgcatcaataaagaactctgcactcgcattagaaaacacaggcttaacgatctcgtcaatatgatcagctaccctgtcaactgcactgtcccgattgcagcacatgttctcaagaatgctggtacttatcatgag

SEQ ID NO: 48849 - DNA, 418 bp, Zea mays
  Clone ID: LIB3067-047-Q1-K1-D1
cccacgcgtccgcggacgcgtgggccgaagctgctctgtcctttgaagatacaaaagatgcttgggccgaagctagcataattggtggaaaattttttaccgatatctgggataatggtggccgagagatggccggagaaattattcgaagaagtgagaagggcattcacgatgctagagaagtagctgaggctgctgacaagagcgcagaagccgaaggtcaattaggtactaaataatagttcttatcgtgttgtaatctttaggcttttaagatctgtttgcgatttgtaatagcaatgtagccgggtcctgcttcagatccgactaaagcgccttcggaccctcagccgaagggggacgacgaaattaaaaagatggccgaagatatcatggaccaagttgttgatcgaactgt

SEQ ID NO: 48850 - DNA, 437 bp, Zea mays
  Clone ID: LIB3067-047-Q1-K1-D10
cccacgcgtccgcggacgcgtgggcgccgtttccgcattcgactccgccgggttcggtgtggcggtgcagccgcccggctccagtgccgtggatttcagtattcaggatgtcaagggctcatccaaaagcttccccaagcacgaggtgaagcatgtctctgaccataagaacgctgcccggtgtgcgaaatttagtcctgatggaaagtattttgcaactgggagtgctgatacatccattaagttttttgaggttgctaagattaagcagactatggtaggagactctaaagatggccctgccaggcctgtgatacggacattttatgatcacacacaggccatcaatgatctggattttcatcctgagagtccaatactgatatcagctgccaaagacaggacaataagattctttgacttttcaaaaaccaatg

SEQ ID NO: 48851 - DNA, 408 bp, Zea mays
  Clone ID: LIB3067-047-Q1-K1-D11
cggacgcgtgggcggacgcgtgggcgtggttgagcggatcgagatggcggcgtcggatggtgagtaccgctgcttcgtcggcagcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgctgaacgccatcgagggcatgaacggcaaggagctggacggccgctacatcaccgtcaacgaggcccagtcccgcggcggccgtggaggcggctgcagcagctaccgtggtggccgaggaggctgcggctacagcggtggcgggcgccgtgatggctgcggcggctacagcggtggctg

SEQ ID NO: 48852 - DNA, 358 bp, Zea mays
  Clone ID: LIB3067-047-Q1-K1-D12
cccacgcgtccggacgtcactcctctctctctgggtctggagactgccggaggagtgaggaccgtgcttatcccgaggaacaccaccatccccaccaagaaggagcaggtgttctccacctactcggacaaccagcctggtgtgttgatccaggtgtacgagggcgagaggacccggacccgcgacaacaacctgcttgggaaattcgagctctccggcatcccaccggctccccgtggtgtcccccagatcacggtctgcttcgacatcgacgccaacggcatcctgaacgtgtctgccgaggacaagacgacggggcaaaagaacaagatcacaatcaccaacgacaagggccgtc

SEQ ID NO: 48853 - DNA, 351 bp, Zea mays
  Clone ID: LIB3067-047-Q1-K1-D2
agctacgtgaagaagatggttgggctccttcgtccactctccgccgccgccaccttacggctcgggcccgccacgccactcactggttcctcagtctccgctagttccgtcggcggcaggcggtggagaagcgtgagggcggacgccggcgggggctggctatccgggctgctgggcggcaagggcggcggcgcgtccacggcgatgatggtgacgccgggaaccgtgaaggccggcgaccccgtcctgcacgagcccgcgcaggaggtggcgccggtggacgtgctgtccgagaaggtgcaaggcgtcatcgaccggatggtcgacgtcatgcgcaaggccccaggcgtc

SEQ ID NO: 48854 - DNA, 427 bp, Zea mays
  Clone ID: LIB3067-047-Q1-K1-D3
caactccacctcgccggcggtggactggtgtgacgactccgcgggggagatggactctgaggacgcagcgccttcctcctccatgggcatcagcatcgccattggcagcatgatggaggtcgacgccgacgaccgccaacccagtccgcctcccgacgccgacttcttcaacgccttccccgacgacttcgacgaccaagacctcgactgattgccgccgccgcttctttgctcgcccggaccccttccgccagttgggagtcgtatacgaacctacctacttccaaggaagcaccagtcatccatcaccttgtacatgtttttatgttgcagcactagtggtgtttaattgtcagctgcgatcatgtgagaacctgacctggtacattatgtatataagaagaaatagaaccctgtaacttaatat

SEQ ID NO: 48855 - DNA, 455 bp, Zea mays
  Clone ID: LIB3067-047-Q1-K1-D4
acaaaggtgtttatgctgacatctataatgttcccttcaaagcgtttgatgaggttcttgatatggaaagagatgaagtggttcttgaagaagaggaggaagaagaaggtgaggtatatgttgaaggcgatgacatggaagagatggatgacatggaagactttgaaggcctcagtgatggaggcacggatgacgatgatgttttggatgatcccgtatcaaggaaatccaagggatcctcttcttattcgaagcaaaatgtcgggaaaaggtctaggaaggttatgactgacgtggaagaagacgaggagataaatacgaggcaaaggcaaagggcgtgagtgcgagatgtgcaactgcaacgacggttatatgatgtcagatgccggcaggcatccacttctgatgtatgttggatcattttatacttgccttcgtactgtaacgcggagtgc

SEQ ID NO: 48856 - DNA, 424 bp, Zea mays
  Clone ID: LIB3067-047-Q1-K1-D5
cggacgcgtgggcgatcagactcacattcttttccgaggtagcaaattaactgaggtccggcgtgactcattcattggagactcacgcactgtcatgatatcatgcatttctcctagttctggctcttgtgagcatactctgaacacattgagatatgcagacagagtgaagagtttgtcaaagggaagcaatgccaagaaagatgtgtctttggcagtgcctttaagagagtcgagcccttcctcactgccttcagatgtaccctcattctctgcatctgaagtgatgaatgatatcaccgagagaaacaattttggttggcccaagcagcagtatgttaaagaacggcctgctacgacatttgttgaacgaatgcccaaagtgaaagatgccgtggagttcggaacatcagacagtgcttat

SEQ ID NO: 48857 - DNA, 435 bp, Zea mays
  unsure at all n locations
  Clone ID: LIB3067-047-Q1-K1-D7
gcaaaactgaactttgctgataatgctgtttttagacagaaagaaatatttgcactgcgtgatactactcaggaagaccccatggaggtcgctgatgccaaagcagatttgaactatattggtcttgatggagagattggttgcatggtgaatggagcaggattggccatggcgaccatggatattataaagttgcatggtggtacgctcgccaattgtcttgatatcagaggaagtgcatcagagggtcatgttgtgcaaactctcaagatactgacttcagatgatagagtgaatgcaattctagtgaacatttttggaggcattatgaaatgttatgtgatagcaagtggaattgataatgcagcncaacatgttgacctgaaagttcctgaggtagttcggttggaaggcacctatttataccaaggaaag

SEQ ID NO: 48858 - DNA, 155 bp, Zea mays
  Clone ID: LIB3067-047-Q1-K1-D8
aaaaaaaaaaaaaaaaaaaaaaaaaaaatttaaaaaacaaaaaaaaaaaaaaaaaaaaaagggatactaataaaaaaagtcacaaacaaaaacattcaatatcactacctattttatctatctaggtatttttatttatatttcctacattttac

SEQ ID NO: 48859 - DNA, 446 bp, Zea mays
  Clone ID: LIB3067-047-Q1-K1-D9
cccacgcgtccgctctgtgatcatgtacatcaacaccatgatcagttttaacatgctggaggctgcgcgtatcaatggtgtgaagaggttcttctatgcctcgagtgcatgcatttaccctgagttcaagcagcttgacacaaatgtgagcttgaaggaatctgatgcctggcctgctgagcctcaagatgcctatggcttggagaagcttgcaaccgaggagctgtgcaagcactacaccaaggactttggcatcgagtgccgcgtcggccgcttccacaacatctacggccctttcggaacatggaaaggtggccgcgagaaggcaccggctgccttctgcagaaaggctcagacatccacggagaggtttgagatgtggggcgatggtctccagaccaggtccttcaccttcatcgacgagtgcgtggagggtgttctgagat

SEQ ID NO: 48860 - DNA, 443 bp, Zea mays
  Clone ID: LIB3067-047-Q1-K1-E1
cccacgcgtccgcccacgcgtgcgagagctcatgctgtcgtagaggcctcgtcgagtgcgtccggtacgcctaattctgaggatgatgataagcggaaaaaagtgtcccgccaagacgccaatggcaaagagtcagagccgcccataaatggggcgcaacctgaagtaccatccattgcgttcttaaagaaaagaattaaaacagttctaaggtcctgtcgagataggaaccctaaggagagcacattacgctctacttacgaggatcttcaccttgaaacggcgagcgccgaaaagcgggtaaaaatcgcccaggccctagaaaatctgtacaggcgaagccaatatttccggagtaacacaaggcagcagccccataccgacttgattattcagatctgcgattgggagcgtacgaagagggtaaagaattcactggtgta

SEQ ID NO: 48861 - DNA, 438 bp, Zea mays
  Clone ID: LIB3067-047-Q1-K1-E10
attgaagtacctgaagtggtcttaatggccttaatcagccttcttccgaccataccacagagcctgtcctgctgatgctcctcctcttccgcctccatctccaaaagcagcagcaacaataatgggttttgttgcatgcttacacaggctacttacatcaagaagtatggcatcacatatgatggcgtttcctgtcgctgttgggagaataatgggtttgcttaggaatggttcggaaggagtagctgctgaagctgctggacttgtggctatgctaattggtggtggtccttgtgattcatctatcttaatggatacaaggggagaatcccatgccacctacatgcatgcaaagtctgtactattctcgcaaccaatgtatgttccgatccttgttaaccggttgaagccaatatcggtgtcaccatttgtatctct

SEQ ID NO: 48862 - DNA, 378 bp, Zea mays
  Clone ID: LIB3067-047-Q1-K1-E12
cggacgcgtgggtaactcgtctgctcgcatttcctcccaatccatcccgcctccaaaccggaactgcaagtcgccccgcatcgatggcgcccaaggccgagaagaagcccgcggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctcctctaaggccatgtccatcatgaactccttcatcaacgacatcttcgagaagc

SEQ ID NO: 48863 - DNA, 315 bp, Zea mays
  Clone ID: LIB3067-047-Q1-K1-E2
cggacgcgtgggcggacgcgtgggtggagttattttgttcacagcgaacgaataatacggtgttgttagtttcttttttttttcccgcttctttgtctgcgaggatttattggttaaattgtgtactagtcaattgttatggtacagcgaaaaagagagaagaggatgatggcattcgcagcgaggtgttgagattccgttgtagccatgcatttgcagccgattgtttggtactggtcaaagttctgtagtagtcataatactctgctcaaaatatagaaagaagaatggcttcgtcaatatcagatgttgaga

SEQ ID NO: 48864 - DNA, 456 bp, Zea mays
  unsure at all n locations
  Clone ID: LIB3067-047-Q1-K1-C9
actagttctagcgcgacccgcagctggcgcggctgctgcagagcatcccgcagcgcaaagtgctgtgcaccaactcggaccgcgcgcacatggagcgggcgctggagcggctgggcgtggacgaggccgccttcgacgccgtcgtgtgcttcgagaccatgaacccgcacctgttcggcgacgacggtggcgaccggcgcccggccgtggtgctcaaaccggcggtggacgcaatcgtcgccgggctgcgcgccgctggctccaacccacgccggacgctgttcctggacgacagcgagaggaacatcgccgcggggaaagcgctcggcctncgcaccgtcctggttggcaagagcgcgaggagcaaggaagcggactacgcggtggagagcatcggcgcgctccggcgggccatcccggagatctggggcgaggccgcttgacgctccttcgaca

SEQ ID NO: 48865 - DNA, 422 bp, Zea mays
  Clone ID: LIB3067-047-Q1-K1-B5
cccacgcgtccgtgacaatgcttcattatagaggcgaatgtcttcagaaagtaatatgtgatattatctgaggaccatgactccaagtgcttttgagtcagcacttcgtcaaaaggatggagagcttgcttcttacatgtctcgcttggcctcattggaatctattcggaattcactggcagaggagttggtgaaactgacagaacaatgtgaaaagttacggactgaagccgctgctgtgcctggcttaagggctgaattggaagctctgaaacaaaggcacttccaagctctagaactaatgggggaacgtgatgaagagttggaggagctaagaaatgatattgttgacctaaaagagatgtacagggagcaagtggatcttcttgttagccagctccaggcattgggtgctcgtgtat

SEQ ID NO: 48866 - DNA, 418 bp, Zea mays
  Clone ID: LIB3067-047-Q1-K1-B6
gttcgccgccggccggcccatcggcaaggtggacctgtcgtggaactacctcgacttcgagctcagcaggctggtgttcccgccggagctcacgtacctggacctgtcccacaacctcatccgcggcaccgtgccgctgtcgctggagcgcctgtccacgctgcagaagctggacctcagctacaaccgcctgtgcggcccgctccccaaggggcacggcgtcatcaagcacgggtgcaagccgtacgcgcacaaccagtgcagcaaagggaccccgctcgcgggatgccaggacctggagtgagtgagtgagccggtggccatggttttctatactctgctatgctctccctcgccggcgttccaatcgtgggtgtgtgtgaaggacgacggtacggtgcctggtttagttatagac

SEQ ID NO: 48867 - DNA, 415 bp, Zea mays
  Clone ID: LIB3067-047-Q1-K1-B7
cggacgcgtggggtgtgcaaggacctcagtgtcgtggacgagctgggcaacaggaagggggcgctcggcagccacacgctgcacgtcggggacctcaagcacacgctcaacttgggagtctgatggccgagaggggaatggctaccaagtaccaacgtgaaggcagttggaatttggagggctggatgggtcggaggcagtcggaagagaaggttgtcagaattggttcggcaggtgtctaataaaggcttactgttgggaaagaattggatccacgggcagctttttagtcatttgtttggaggcattggattcattggagggtcgatttgtgattgtaatcacgataaatgtaatggattggaaattcggaaggggccagatctctttttcatacaaatcacgtgatttagtg

SEQ ID NO: 48868 - DNA, 425 bp, Zea mays
  Clone ID: LIB3067-047-Q1-K1-B8
gtctgccatggccagcgagaataaggtctttgggttcgaggaagtcgccaagcacaacggcaccaaggactgctggatcatcatcgccggcaaggtgtatgacgtcactccgtttatggatgagcatcctggtggagacgaggttttgctagctgtaactgggaaagatgctacagctgatttcgaagatattggccacagtgattccgcaagggacatgatggagaagtaccacatcgggcagatagatgcttcaacaatcccagcaaagcgtgctcatgtgcagccccagcaagcacccagccatgcagacaaggataatgacctccccatcaagatcctacagttccttgtgcccattatgatcctgggccttgcatttggtatacggcagtacaccaaatcagagtagtaactattcttag

SEQ ID NO: 48869 - DNA, 376 bp, Zea mays
  Clone ID: LIB3067-047-Q1-K1-B9
cccacgcgtccgcctggcgccgccagatgccacgcctcgcgctcaccctcggactcgaggaacaaatggccgatatcattgaggaactgattgctaagaggcagcagcttgatgctgtaaatttcgcttatgaggctgggcttcaggagaagttccctccagttcctcttttgaagtcctacctggaagactctaagaagacatcaaccgctgcttcagataattcaagcactagcagcggccaatcagggagcaatgtgaacaagaaagaacagtctgcactgcgagctgtcatcaagtgtgttgaggatcgtaaactagaagctgagtttccactggaggggtcttcggaagcaactttgaggaactagagaaa

SEQ ID NO: 48870 - DNA, 447 bp, Zea mays
  unsure at all n locations
  Clone ID: LIB3067-047-Q1-K1-C1
gtccgatctctctcccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcgagtccaacgcagtgcagttcacgctcgagcacgaccttggcgacggcaagggcttcgtctcagctggaaccttctcggcccgcctcaagaccttcgcccacggcacgcagaccctcactaaacttcgctttacaaggaatgattttactgangatgataaaaccgcgttc

SEQ ID NO: 48871 - DNA, 449 bp, Zea mays
  Clone ID: LIB3067-047-Q1-K1-C10
caaagtggacaaccctgtcgccctctcggtctccctcgagcttttcttgtgcgcagccggagccgctgcttttcgttcgtcttcatcctacgcgagggcgaaacccacaaaccctctccctcctgtactccggccgacacatccaggggcgatgacgctgggtagctccggcgccggatcgagcgtcgtcgttcctcgaaacttcaggctattagaggagctcgagcgtggagagaagggcattggtgatgggacagtgagctatggaatggatgatgctgatgacatctacatgcggtcatggactggtaccatcattggccctcacaatttgctttgtgacaaagactatccggagaagccaccatctgtcagattccactcaagaatcaacatgacatgcgttaatcacgagacaagaatggttgatccaaggaagtttggtttgc

SEQ ID NO: 48872 - DNA, 394 bp, Zea mays
  Clone ID: LIB3067-047-Q1-K1-C11
cccacgcgtccgcaaaaaagaaaaaaacctcaaagagattcctctaaccaccaccaaccgtagacgatcctcctccgccatgatgcgggacggcgtgcctccgtcggtggccggctccggcggcgcggcgggcggcgacgggcccaggcgatgctcgcagtgcgggcaccacgggcacaacgcgcgaacctgcacggcgcggcccgtcaagctcttcggcgtgcgcatcggggacaagcccatccggaagagcgccagcatggggaacatcgcgcacctcgccgcggagggcagcggcggcagggaagaagggtacggctccgacggggagcgcccgcacaagaagcgaagtgaggcatggactgaagaggagcacaagaaagttctgcttggg

SEQ ID NO: 48873 - DNA, 378 bp, Zea mays
  Clone ID: LIB3067-047-Q1-K1-C2
cccacgcgtgcgtccacgcgtccgaccactcgtctttccacgcgtccgcccacgcgtccggccaggcgtcctcccacgcgtgcgcccacgcgtccgcaacacatggttgatcaactgacagaacttcataaaaaagaacaaatgctttgtgaagcaaataagtgtcttcgaagaagactggaggagagcaaccaggttatatggcagcatgcgtgggagcaaagcgagcggcattctgaagtgcagccgcagcagctcaatggcaataacttcttccatcctctcgattgtgctggtgaacccacccttcagatagggtatccttcataggcactgactagctcatgcatgaccaccttgctgccctcgtggttgcca

SEQ ID NO: 48874 - DNA, 423 bp, Zea mays
  Clone ID: LIB3067-047-Q1-K1-C3
ctggaggcgacctggcaaaggtccagcgtgccgtgtgtatgatcagcaacaacactgccgttgctgaggtgttctcgcgcatcgatcacaagttcgaccttatgtacgccaagcgggcgttcgttcactggtacgtcggtgagggtatggaagagggtgagttctccgaggcccgtgaggacttggctgctcttgagaaggactatgaggaagtcggcgcagagggtgcagatgacgagggtgacgagggcgatgactattgagtagccggttaataattagttcgctggtgcttaatggttgagttattttgagtatactctgtatgggtccactccattgcgtgctgctgctgtgtgtttccattttgtattttgtgataaattgttcgtagccccctattggccatgattgttggtcata

SEQ ID NO: 48875 - DNA, 449 bp, Zea mays
  Clone ID: LIB3067-047-Q1-K1-C4
gttgggttcaagggttttgcagtgccaaaggagcagcaggataaggttgtcaaatttgagtttcatgggcagccagcagaaatcaagcatggtagtgttgttatagcagcaataactagctgcacaaacacctcaaatcctagtgttatgcttggtgctggtcttgtagctaagaaagcttgcgagttgggtcttgaggttaaaccatgggtgaagacaagccttgcccctggatcaggagttgtcacaaagtacttgcttcagagtggtcttcaagaatacctcaaccagcaaggattccatatcgatggctatggctgtaccacttgcattggaaactctggtgatctcgatgaatccgtatcaactgccattacagaaaatgatgttgttgctgctgctgatatgtcgggtaaccgtaacttcgagggtcgtgtgcaccccttaac

SEQ ID NO: 48876 - DNA, 202 bp, Zea mays
  Clone ID: LIB3067-047-Q1-K1-C5
agacgctctactggcgcggcgtcgtcggttttgtgtgccactgctatcctgtgatctgggctgagtggctcctatcgtgttatgtttctgtcggttcttatctatctgtcgctgtgtggtttacaacttacgtcgtaagactttattcccccgctttgctactgggttattaagtttgtcgttattgttttcttgatctcaa

SEQ ID NO: 48877 - DNA, 253 bp, Zea mays
  Clone ID: LIB3067-047-Q1-K1-C6
aaaaaaaaaaaaaaaaaaaaaaaaaaaaattaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaatataaaaaaaaaaaacaaaaacaaaaacataaataaaatatttataaaatattaaataattacaaaaatattataaatataaaaaaaaattacatat

SEQ ID NO: 48878 - DNA, 243 bp, Zea mays
  Clone ID: LIB3067-047-Q1-K1-C7
attattgtttctattattataataatgcttctccctgttcctatggacctatagtagtgtactagtatgttgcgagggagcgagtagaccgtgtgtttcgctatcgtgggactagaataagccatgccaatgaacatgagccgaatagaggctacgtactgttattgtatcagtactagtaccctatatatatgggcgcactacagttctgtgatgtaatggattctgctagtatttgactct

SEQ ID NO: 48879 - DNA, 449 bp, Zea mays
  unsure at all n locations
  Clone ID: LIB3067-047-Q1-K1-C8
caaagtctcgtgctgtcagtactttggacatctggccttggaagtacttggttccatggatgagggaagatctgtttgcaaggagagatgccaggggtgtttacaaagttcatagtagtaagaaggttaatgcatatgatgtggacgatatggttatgccattacatcggtacatcaatgatccagttgcccatgaaatcattcataatggggctacctttcagattactgggttaacgaacaactcatattttgatggagcacatgaggttcgacattgtgtcaggaagcatccagatcttggtcgtattgtgcttgaagttgctaagaataggctggaccagatgctatatgtaggacttacggaggatcatgaagaatcagcgaggttgtttgctcatatggtaggagcacaggtgctttcacaatctgngacattgactttagat

SEQ ID NO: 48880 - DNA, 420 bp, Zea mays
  Clone ID: LIB3067-047-Q1-K1-B4
gaaaaatgagatggaggagaagaagggcctgtacgccaagttctggaatgagtttggcagatcagtcaagctgggtatcattgaagacgcaactaacaggaaccgccttgcgaagcttcttagatttgaaagtaccaagtcggatggcaaacttgccttccttgacgagtacatttcaaggatgaagccagggcagaaagacatcttctacctcacgggaagcagcaaagagcagctggagaagtctccgttcctcgagaggctaaccaagaagaactacgaggtcatcttcttcaccgaccctatggacgagtacctgatgcagtacctgatggactacgaggacaggaagttccagaacgtgtccaatgagggcctgaagctgggcaaggactcgaggctcaaggacctcaaggagtc

SEQ ID NO: 48881 - DNA, 393 bp, Zea mays
  Clone ID: LIB3067-047-Q1-K1-A1
cgatataactgtcgtcgtggtattcctcgattcggatgccatgagcaaagctagctggagcaaaagcccctcggtttctctccgagggggcggagtcgccctccctgcgaagtccctcgcacctttctcagctccggcacggctgaacagcacctactgaagttgctaccactctcgaaaggaagaacacagtgcagatctgcagcggtgagagagagagaaaacagcaaccaagtgtagcgttacagttacacctgctgagttgttgctctttgcaaaactactgtctagacttcgcctggcaattagtgtactgatagcgaggtaaaaaaagttagattatgtgttagcgacacacatcctttcaccttcttttatctccctcgattacta

SEQ ID NO: 48882 - DNA, 438 bp, Zea mays
  Clone ID: LIB3067-047-Q1-K1-A10
gccgctaccgcattattacagagagaacactcctagccatgcctgaaaatggtattggcgtgttcggagatgttggctttgcttacattggtgcaaaagcaccaggagggggtgcagttggagtttaccttgggattactggaaaaaggatatcatcacctgctgatgctatgttcataggccttggtactcactatgtaccttctgcaaatttgggttcactcaaggagtccctgctgagtgctaacttcaccaatgatcctcatagagacgttgagtcagttctgacaggatacaagaaagaaccagagtctgaaccacaactaaaaaagcttttgccatatatcatttcttctttcagtcctgataaatcagtggctgaatctgtggaagagctaaagaaatgtagccgaagtggtgatgctgcaatggcagaat

SEQ ID NO: 48883 - DNA, 412 bp, Zea mays
  unsure at all n locations
  Clone ID: LIB3067-047-Q1-K1-A11
ggaactcgcggcacgcgtccgctctgcctctcagcgctggtgctcaatcttcaggtcgtcccgctccctacacacccgcggtccggtgtgaacctccatgacgtctgcaaccactctccgatctgctgtcgtgacctcatccagccgtgctgtggcagtggatcggagttcgctccagctctgattatccccacgtccagagttacaagaagatcaagcttggttgtggctgctgctgtgttgcctcctcttgttggaccgaagagagggaggagagaagcagctggcgtgcagacttctactcaggtggtcttttattctctatggtgcttctaggatacatcntctccagaagcaccataagtctngtcttgggcattacaccaaggctagccactctgctacttggcac

SEQ ID NO: 48884 - DNA, 442 bp, Zea mays
  unsure at all n locations
  Clone ID: LIB3067-047-Q1-K1-A2
cgcccagtcgtcgtcctacgccgccgtgccgtgcgggggccccgtgtgcgcggggctgggcatctacgccgcgtccgcctgctcggcggcgcagtgcggggcttcttcttcggctgcgggcacgcgcagagcgggctgttcaacggcgtcgacgggctcctgggcctcggccgcgagcagccgtcgctcgtggagcagacggcgggcacctacggtggggtcttctcctactgcctcccgacgaagccgtccaccgcggggtacctgacgctgggcctgggcgggccgtcgggcgccgcgccgggcttctccacgacgcagctgctgccgtcgccgaacgcgccgacctactacgtcgtgatgctgacggggatcagcgtcngcgggcagcagctgagcgtgcccgcgtcggtgttcgccggcgggaccggggtggacaccg

SEQ ID NO: 48885 - DNA, 426 bp, Zea mays
  Clone ID: LIB3067-047-Q1-K1-A3
gttctagatcgcgagcgggcgagggttactcgaaggcgaagcggagtagtggaagcagaggcgggagccatggccgtgatggagaagctcaagatctttgtcgttaaggagcccgtagtcgcggcctcctgcctcatcgctggattcggtctctttcttccagcagttgtccggccaatcctggattcatggcagaccgcggaacaagttcctccacctcttctaaatgatgtggttgcaggtgtcaccggcaagaaaaagtagtgaacttgcattgttttctcatgccaatgttgccccacattttcttccccgtgttttttctggcgaccagattggaaggcttttcccaagagtcacggtcttgaactctagatggtatccgcggaataatcattgtaccttgatcatatactgcaatgtggc

SEQ ID NO: 48886 - DNA, 175 bp, Zea mays
  Clone ID: LIB3067-047-Q1-K1-A4
cccacgcgtccgaaaaaaaaaaaaaaaaattaaaataaaaaaaaaaaaaaacaaaaaaaaggaagggggacataaaaaatataggataccagctaacgtacgtcgtcttgcaacactctaaactcttttatatggccacctaattacaactcactggccgctaaaatacaacgta

SEQ ID NO: 48887 - DNA, 422 bp, Zea mays
  Clone ID: LIB3067-047-Q1-K1-A5
cgttgaggctgaccagatcgtcgtttggttgaaggagtactttgacggcaaatggacgccgttcaggaagtctgagcctattcctgaggtcaacaatgagcctgttaaggtggttgtcgctgacaacgtccacgacttcgtcttcaaatctggcaaaaatgtccttattgaattctatgccccctggtgcggacactgcaagaagctggcgcccatcttggacgaggcagccaccactctccagagcgacgaggaagtcgtgattgctaagatggacgctactgccaatgacgttcccagtgagtttgacgtccaaggctacccgaccttgtacttcgtgaccccgagcgggaaggtgacatcctacgacagcggcaggacggctgacgacatcgtcgacttcatcaagaagagcaaggaga

SEQ ID NO: 48888 - DNA, 444 bp, Zea mays
  Clone ID: LIB3067-047-Q1-K1-A6
cctcaatgccatgaacaagctcagcaccatgaagccgtggtccctgtctttctccttcgggcgtgccctccaggcgagcaccctcaaggcctgggctggcaaggtggagaacctggagaaggctagagctgccttcctcgccaggtgcaaggccaactctgaggctaccctcggcacctacaagggtgatgctgccgccgacaccgagagcctccacgtcaaggactacaagtactgagttgcttctctttgcgtgcccgttttggaactcctgcctacgagctaggttgcggagtgtggtttgctcgttagagcttattttcggacatccaaaaaacatgcttcctatgtgggatgatggttatctttatatttgtatgttaattagtctctttgctggtaaatttcgtgtaagttggtcctgccgatggagaatcgagcagc

SEQ ID NO: 48889 - DNA, 154 bp, Zea mays
  Clone ID: LIB3067-047-Q1-K1-A7
caagaaatgtatttactttccagatgttttcccctccttttcaaattaaagatgttttggctttccagattttggtatgcttgtagttaaatctacactgtagataaagaaatgtttgtggagaagtaaaaatcccttatttggtcgtcatggt

SEQ ID NO: 48890 - DNA, 356 bp, Zea mays
  Clone ID: LIB3067-047-Q1-K1-A9
aaaagattgattctgagaatctgctacatttggcatttagtgtgttccttttcaactcagagtatgagctgctacttcagcaaaggtccgcgacaaaggttacctttcctttagtttggaccaatacctgctgcactgcatgtttatcaaaagttatcgctcctgctcgcggaaagtgagcttgactgttgccggggtggaagtatcgttttggactgatgcatgagtgctgcggaggggtttgttgtttggttgtttgttcggtgaccgaatcgcgagctggacgcctgtttaatccgtgcttatacatcggctgaagtaacagcaataagagggacaatccgtagctctttccg

SEQ ID NO: 48891 - DNA, 396 bp, Zea mays
  Clone ID: LIB3067-047-Q1-K1-B1
agctgctctcgtccctagaaataaagcagctcctccgcggggcggcgaactactacccatcgccgaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgatggaggctacttcaatgcaataatgaccttcccccagaactatcccaacagcccgccatcagtaagatttacttctgggatgtggcatccgaatgtttatccggatgggcgtgtttgcatttctattcttc

SEQ ID NO: 48892 - DNA, 219 bp, Zea mays
  Clone ID: LIB3067-047-Q1-K1-B10
gaaatgatctatctggctggtgctgtgcttgcttgttggttacctcgtggaagcttaaagtatctcgtcttgttgacatccttgcagttgtcgcgtgaacaagtaatctatgatggcaatgtttgcctggtcatgaagtattattactttcgttgaaaccgtgatgctattaagacttaattttttttatggaacatcgaatgtaaggcatacatggtt

SEQ ID NO: 48893 - DNA, 211 bp, Zea mays
  Clone ID: LIB3067-047-Q1-K1-B11
gacgcgttcgcccacgcgtacgcggacgcgtgggaaaaaaaaaaaaaaaagcaaaaaaaagaaaaaaaaaaaaaaaaaaaaactaaaggtgaaaccatttatactatcaaaacttaattacgcatacagaacacataaaagtaaagcaaacatggtacaaaaaaaaaattaacagaccgcaattgtccaacgatctaaatgataaaacctt

SEQ ID NO: 48894 - DNA, 310 bp, Zea mays
  Clone ID: LIB3067-047-Q1-K1-B12
accacgcgtccaaaaaaaaaaaaaaaaaaaaaaaaaaaaaataaaaaaaaaaaaaaaaaaaaaaaaaaaaagaaaaagttaaaaaaaaaaaaaaaaaaaaaaaaaaaaaaaaaaaaataaaaaaaaaaaaaaaaaaaaaaaaaaaaaaaaaaaataatacaacttaaaacaaacccttttaaactccccttactaaaaattttataaccaaaatataaaacattcctaatttaaaaaaccttcctaataataaaaaatatcccaattataaaaatccccaatatcccaactctcaaacaccctaataaaa

SEQ ID NO: 48895 - DNA, 259 bp, Zea mays
  Clone ID: LIB3067-047-Q1-K1-B2
caagttgcgtggcaagaaatagctttcctacgagtttgtgtcccggagcatcataatagggggaggacaaggcaagctgtctgcttatttgtctatgtttggtatctcaagtcctgcggactgtttctgttggcacaagagggaataaatgtgttcacggacctgttatgctttcttcttgtcatattaccttgctctaaacatttttgatgaagctgtcaaggtaatatattttctctaaatatttagcctaacaaaa

SEQ ID NO: 48896 - DNA, 286 bp, Zea mays
  Clone ID: LIB3067-046-Q1-K1-H9
aataagaatttctactctcttaaagaaaaacaataataaatggggatggcagaattaaatatgctataatacctaacgaaagtagccatgagcggagagaggtaaaggcgatcggctcaagcgcccgtcaagaaggccacgtacaggaactccaaagctggcctccagttccctgtgggaaggatcgtcaggtttctcaaagccggcaagtatgccgagagaagcggcgcccgcgcccctggttacctcgatgccgtgctcgagtatcttgccgctgaggttcttg

SEQ ID NO: 48897 - DNA, 419 bp, Zea mays
  unsure at all n locations
  Clone ID: LIB3067-047-Q1-K1-B3
ctctacgacatcaacaccgaggagtccagcatcggcctgcgcaatgtgcggtcctttggaaccgaaggtcggaagaaagacggagtgcagattcctgctagcgacaaagtttacgagtatatcctcttccggggaactgatatcaaggatttgcaagttaagtcatcaccaccacagccgccaccaccacaagcagcttccctgcacaatgatcctgccataatacagtcacattattctcaacctgcatcaacgtcatcaagtttgccttcagctgggggtgcagttttaccagactttagctcccaggcagttcaatatgggcttcagaggccaacctttcagagtaaccttcctctctaccaaccagggaatactccgtggggctcttcagtggcacctncagcaggaaaatgctc

SEQ ID NO: 48898 - DNA, 384 bp, Zea mays
  unsure at all n locations
  Clone ID: LIB3067-046-Q1-K1-G3
cgagttggattgggttcaaagttgggcttttggacagctgtggtgtgcacggcagctctgtgacttgtgaggaggaagggaggaagaaagcggatccatggcgtcgaagcggatcctcaaggagctcaaggacctgcagaaggatcctcccacctcttgcagcgcaggccctgttgccgaagatatgttctactggcaggcgacgattatggngccatcagatagcccatacccctgtggggtaattttgggtaactatcaactttcaaccgaactaccaattcaaccaaccaaaggtggattcaagaacaaaggttaacaacccgattttaaccagcaccggagcctttggcttgaaattttggaagaaccatggaacccttg

SEQ ID NO: 48899 - DNA, 347 bp, Zea mays
  Clone ID: LIB3067-046-Q1-K1-G4
ccgattcttatgtcagatccgtcagatgtttgccattcgactctaccatcgataatgcggataggcgatatgacctagttgctgacgattgctggaagatgcacgagctgagaccgcaggcaaaatctgttgatgatgcaaaatcctagttacttacaactgtgtcacatgagatcacaacacctatgaatgctctcctcagaatgctgcatatgcttttaggaacagatctaactatgacacacaatgattatgcacaaactgctcaaatgtgtgccatagcattgatcactctgctgaatgatgtacttgagcgatcaacaattgtggctggaaagttatagctt

SEQ ID NO: 48900 - DNA, 439 bp, Zea mays
  Clone ID: LIB3067-046-Q1-K1-G6
agctttctcaccgttgaggaagggcaacatattcctccgcctgcaaccaatgcctatgagatctgtttcctgcgctgccaagaaggatacaacagacaaggtttgtgagattgtgaagaagcagcttgctcttcctgaccatactgaagtttgcggtgaatcgaaattctctgaactcggtgcagattcactggacacggttgagattgtgatgagtctcgaggagcacttcgatattagcgtggaggagtccagcgcacaaacaatcgccacagttgaagacgccgcggacctcatcgacaagcttgttgctggcaaagcgtagttctgtaccttctctatcgttgtcctaccactctaggtctatcccttgatctaagtttctatggtcttaagatttgtgattttctccgcacttgtgttgctatccccgtgtcgt

SEQ ID NO: 48901 - DNA, 150 bp, Zea mays
  Clone ID: LIB3067-046-Q1-K1-G7
cggtctcgtggtctgacgcgtgggtaaaaaaaataataagactgcaaccaattctggaaaagagcaaaaaactacgctggcaaaaaaggatacacctgacaaggtttgcagagactgaaagaactcaacgagctgtttatggatattctg

SEQ ID NO: 48902 - DNA, 444 bp, Zea mays
  Clone ID: LIB3067-046-Q1-K1-G8
cccacgcgtccgcccacgcgtccgcgcttggcttgataaccaagggatcgtacaaagctcgccgctgatggagctaggtgctcccgtccatagttttcacaagatgggctgccaatccaagatggtaatgatatgttgagtttggcattccatcaacaaagaaactgtcgcgagatgcattggaggctctggaagtttcacaacaacacacaaaaaaagtcttcccaaaagaagtcccagtcgacctatagctatagtcctcattcttgacgcttcaggttcaagaaaaggaactttatgatggaaaaatggacttcagtctgctcaaccccttcatgttactgtgccggccgagatgtgcttggtcgctggtggttgagatttcagatcaggagctctggagtctggactctggactgcagcgagccaaatcagtcaccggtt

SEQ ID NO: 48903 - DNA, 419 bp, Zea mays
  unsure at all n locations
  Clone ID: LIB3067-046-Q1-K1-G9
ggattaacggttcttccagtaaatgcaatcgttggaagctacattacgaacttgtttgaggataggcaaattttgttggcatctgaagtcatggttctcattggtataatcatgagctttcgtttcacacctcactactccattccgcaatatgtcatttcagctctcatcacatttgtattttctgaggtgcttgaaggagtgaatctgtccttgctctcacgagtgatgtcgtcaaggctttcccgagggacctacaatggtggactcctttcaacagaggccgggacgttggcccgtgtagtcgcagacgccaccattactgcagccggttatctatgcacggacctncttctcaatgtcactcttctgccacctcttgtgatctgcatagtctccatcgcagcatcactctacac

SEQ ID NO: 48904 - DNA, 411 bp, Zea mays
  Clone ID: LIB3067-046-Q1-K1-H1
atgaactatgctggaaatacagtcagaagctctataccgattggagccatagcagtacagggtactgtgtacacagagactgtagaatcacccaagcccaaacttggaatgtggggggccatacaatttacactgtatagtctgtttctgtgaaatagctgaaaagttcatgggaagatcgtgtcaatatttcatatatatgtatcttgtttgacacagaacagacggagaaaaatattggtttcgcgcatatatgaaatttcaaaaatttcgctttttagaaatttggtacaatgctgaatggctttcaagaacttgcgtttcacaaaaaccttcatcctgttttgaaaatgggaccccacctgttgggccaaattaaaccccgcgggttttggggttaccccggggggg

SEQ ID NO: 48905 - DNA, 415 bp, Zea mays
  unsure at all n locations
  Clone ID: LIB3067-046-Q1-K1-H10
gaaagcaggagatggagaagttactgctatagcaggaagttatgaggacctcgcttctggaatggtgctatgccagctacagtgaggttttcagttcctggatgcacttctgcgccgtgcgcatatttgtagagagcattcttagatacggtctgccaccatcgttcctgtctgccgttcttgctccgtctacaaagggcgagaagaaagtgaggagcatcttagaggacctttgcggcaatgtccatagtatttattggaaaggcgaagatgacgtggcagttgctggtctgggaggtgaatcagaggtccatccttacgtctcattcaccataaactntgtttgagcattactggtgttacgccgtcaagtaaatcgaaacgatggaatggttctgtacattgctagtgttac

SEQ ID NO: 48906 - DNA, 309 bp, Zea mays
  Clone ID: LIB3067-046-Q1-K1-H11
tcggactcgtgggtcctgacgcttgtgctgtctcttggggttctagatcgctagcgccttccttttttttttttttttttttttttttttttttttttttttttttttttttttttttttttttttttttttttttttttttttttaaaggaattctaacatcgttcgtgtatacctttctttttacccctcaagggaaaaaactaaagttttgttcatctcccaccaaatcttttccattattcttggggtgacttgattttttacccatcccttgaactttgctgggccgaaatccgaaacctttgg

SEQ ID NO: 48907 - DNA, 335 bp, Zea mays
  Clone ID: LIB3067-046-Q1-K1-H12
gtaacgcactgtaattggctggagccaatccatccactctacaatgtcgccctagataaggaccatacagcctatgagttcttctcagaagagtgatctaatgttagaacctaagaacaatcggctaaggttgtgtacgattgtgatatttgcacgaatgatggttacttagtcgtgttataccagggtatttgtatgtttggtcaggtggattgcctggataaatctctctgttgtaatggtcgagtcccgaattatgtttgtaatggtcgtgtcccgaattattgtactggtgtgcattattagttgaaatgcaacagaagtgtatgtctaaa

SEQ ID NO: 48908 - DNA, 361 bp, Zea mays
  Clone ID: LIB3067-046-Q1-K1-H2
ctgaactatgctggaaatacagtcagaatctctttaccgattggagccatgcagtacagggtactgtgtacacagagactgtcgaatcacccaagcgcgacttggaatgtggggatccatacaatttccactggatagttctgtttctgtgaaatagctgaaaagttcatgggaagttcgtgttaatcttttttatatatatatcttgttggcggcagaacagaagcagtcaaatattttttttgcgcatatgtgaaatttcagagatgtcggtggtgagagataggatacaatgctcgttgtatttcaggaacttctgtaacacgagaacattcatcatgtgaaaaaaatgtaactcaat

SEQ ID NO: 48909 - DNA, 201 bp, Zea mays
  unsure at all n locations
  Clone ID: LIB3067-046-Q1-K1-H3
tcgtctcggaccctgcccnttgcagctcgtcatgggaagaagtcatggtgccctcacgtatggccccttgtgaaaggggtcgtgtcgtgaggggctgctcaaagtctcatcgagaaatngcatgccgtctcaagcttctgcgtgcccttgcctgaggacctgctgactcaggcccctgattatgtnncaagctgnngtgaa

SEQ ID NO: 48910 - DNA, 277 bp, Zea mays
  Clone ID: LIB3067-046-Q1-K1-H4
cccacgcatgcggccactcgtgcgtctatatcgcgagctggcataaatacctatctgagtgttctggacaactgtctacttgttaagcactaaaacggcacgcatggtgcattgatgatatcagtatcaggcatacgaatcagactccacatatctagtggcgggttgtccctacttgagtaccgactcgagagcctcgtgcactgggtcggcctatatggtactctttgatctgatgttataaacctatgtggctattgctaggtaatgctaaaga

SEQ ID NO: 48911 - DNA, 343 bp, Zea mays
  Clone ID: LIB3067-046-Q1-K1-H5
gccagcgcatggtcgcggcggcttccgacgcgctgtcggcggccgtgggccccgaggtgtcgcacctcggctggggccactggtacacgctgcgggagctggaggaggccaccgtcgcgttcgctcccgagcacgtcgtcggcgagggcgggtactgcatcgtctaccgcggcgtcctcgccgacggctaccaggtcgccgtgaagaacctgttcaccaccaggggacaggccgaccggaagttcagggtgaaggtggaggccatcggccgcttccggcacaggaatctgttccggttactggcctacgtgcccaagggcgcccaacggttcctggggtccaa

SEQ ID NO: 48912 - DNA, 450 bp, Zea mays
  Clone ID: LIB3067-046-Q1-K1-H6
gttttgacatgtaacactgtttcagtagataatgctgattgtcagatttgctgccgctctacagaagattaagcgaccgtctgtttcaagaattattcatacagttacttgtgattctttcaagcagcagttacaaaatgtccaagttgtcttggaggttggccagcacccgtaggacggtgtccacgacgacagggtccgcgcccagcatcctgtgcagctgcgcctcgacgctagagcccaagacgtcgcccacgaacctgtacacctgagcgaggcgcaggtcgtccggagacagggggaactgaaccgtctcgacgtccggcgccagtgtaccaccatcgtcggcgcaccaggccgggcaaccggcggcagagcggtgagggtgccgcggcggcacggcgaggaccagcttcttgtccgctctgaggaagtgtttctgggcgtggc

SEQ ID NO: 48913 - DNA, 433 bp, Zea mays
  unsure at all n locations
  Clone ID: LIB3067-046-Q1-K1-G2
tcgtctcgtgagtaatactcatatgagtaacccttctcgtcatggtgacatggtctacttgacatnctgtgaagtgaagtatattcagcaaggagctgaaggagtagnagaagtnggaagaagnttctgtatntggacaattggtaaacaaatctatagatcatccacatatgcctgcttgaatacacaatagcctgacttagggcatcccgttctgctaagggaagccattctgcaaaaataattccatgtaatgtagtaatgtacaagtagaacacttctttcctttgaggtcacaacgaagctaacttaatcctctcccccccttgtgtcaggacaaaaaacgtgcaaataggctttgtagttgtagttcgtttttgctaacatgtatacggttgaccattattttttggagaagtatacatcaaaagtt

SEQ ID NO: 48914 - DNA, 408 bp, Zea mays
  Clone ID: LIB3067-046-Q1-K1-H7
cccacgcgttcgcggacgcgtgggtgctgctacagcatcttctgcctcttactcatccgtactgccttctgttgccgttactcctgtggcacaaaatactcggcaaaagaggaggcccgcagttgattccagatcatcaaatgcaattccctctggaaacggcttcacagatcaatttaacatcattcagggtgtcagcgacgtatcaatttcaggcaaagtaagaaatatccaagataatggcttcatagatgaagttcgcactgggcagccatccgtgctaacagctgctactgccaacggaccaggacatgacaaatgtgcaaatattaccagacatggttatggtggaaaccaccagggaaggaccactgggacgacttacctttccagaggatgaaccaactt

SEQ ID NO: 48915 - DNA, 377 bp, Zea mays
  Clone ID: LIB3067-046-Q1-K1-H8
gagctccctccctcctctctcttcttcttcgtcgtggtgtggggcatctcgcaccccaggcatccctgtcctcccgctcgccggtgcgcgcgcttttctagggtttccgctgccccagccgccaaccccgctcacctctcgtcagcggcgatggcgtcggcgtcggtgtcggccccggtggcaggggcaggggccgggggcgggaaggacgaggagctcgccgatctggtgcggcgcctcatggacgccctcgctcgctacgctgatcgcctgcccttcgaccttgatcgccagacacttcgttcacttactacacttgctgcgatctcgatcacacttctgtttgccttgaaaaatgttgagagcttcctaagagc

SEQ ID NO: 48916 - DNA, 395 bp, Zea mays
  Clone ID: LIB3067-046-Q1-K1-E6
actctgcaagggcttcggatcccacaccgaggaaaggagaagagagggtcggaataatggcggccgaggagggtgccgtgatcgcgtgccacaccaaggacgagttcgacgcccgcatggccaaggccaaggagcagggcaagctggtggtcatcgacttcatggccccctggtgcagtgggtgccagatgatggccccggtgtacgcggactgcgccagcaagtacccttccgcggtcttcctcgaggtcgacgtcgacgaactgctggaagtcgcgaagatctacggcgtccatgtgatgccgaccttctgcttcatcaggaacggcgagacgctcgagagctttgctaccgtcgacgaagacgagctccgggacgccgtcaggaagtacgcc

SEQ ID NO: 48917 - DNA, 382 bp, Zea mays
  Clone ID: LIB3067-046-Q1-K1-E7
gtgttctattacacaaaagaggcaaaaaacaaaagccggtaacggaaaccctaatcccggcaaatcccgaatccctctcgaatttctatttaatgttcctgttcttcccctccgatccgatgtccccaactgcgctcccgtcggcgatcaaacaccggatcgcggcactcgccgccgttgaggaggaggtttccggcgctgcttccagcgccttgccgtcagcaccatgaggaagaagctggacacgcgtttccccgttcctcggattaaaaggatcatgcaaccagatgaagacgtcggcaagattgctcaagctgtacctgtcctagtgtccaaagcattggagctatttctgcaggattaatgtgataggacatatgat

SEQ ID NO: 48918 - DNA, 439 bp, Zea mays
  Clone ID: LIB3067-046-Q1-K1-E8
ctctagaaccttccgagaatccgagttccttctgcgtcccttcacccttctcgttgcgctcaccacaggcaattcgaccgttcacagagaattgaatcatggaaggagggggtagcaacacgcccttctaccgcggcaacagcaccgcactcgccaccaacccttctgctgctgctgctgctgctgctgcgaatggggcacagaaaggggacagggaggctgccatcgatgccgagatagtgagggttaacgacctaccagctcatagttcctacgccatacaccgcatgaaggtgctaaacaaacttcgtcatctgctgtccatcaagaagactacatctcaagatgaggagctcgaacttctcttcgcaagcctttcaatctaaagtgtatccttgataagccagtattttaaccctgctaagggagcccactcttc

SEQ ID NO: 48919 - DNA, 376 bp, Zea mays
  Clone ID: LIB3067-046-Q1-K1-E9
gcagggcaggttttgcgaggcaaagcccgacgtctacaagcgctgggccaagtccatccacttcgcgctcggcgactccatctgggtcctgtacccgccgagccaggactcggtgctgcaactggcgccggcgggcttcgcgttctgcgacctgtcgcgccctgtggccaggctcggcgacggcaactcattattcaaccttaccgcgcccggtcgcgcctactacgccagcggcgcgccgggccactgtcgcaagggccagaagctctgggtcgatgtgcccttgcccaacgggacctaccttcagccctacgtcaccgacctcgacgcgctcgcgcacaccctcgtcgtcgacccgaacgacgggttcgcgtcc

SEQ ID NO: 48920 - DNA, 219 bp, Zea mays
  Clone ID: LIB3067-046-Q1-K1-F1
cgttcgtttgcgtccggattgctcggcgactccgacctcgtctcctgtgagatcagctgcggcggtacgcttatatgactactggacggcgtcttgctgacaggaagagtgactagttccagatgaacatcacacagagcggttctgcgcctgagaccacagtgacaaagagcaatgactaccctgtttgacctgtagcactgggagaattcacatttg

SEQ ID NO: 48921 - DNA, 429 bp, Zea mays
  Clone ID: LIB3067-046-Q1-K1-F10
gtgggagtggagggggtggatcgggtggtgggagtggaggcggaggatctggtggaggcggcagcagcggtggaggcggcggatctggtggtggtggaagcggtggcggcggcggatctggctgcgggccgacgagcggtcgttgccccgtggacgcgctgaatctgggcgtgtgcgccaacttgctgaacgggctgatcaacgcgaccctggggacgccgtccaggacgccgtgctgcacgctgatccaggggctggcggacctggaggcggcggtgtgcctctgcaccgtcctcagggccaacgtcctgtgcatcaacctcaacctgcccatcaacctcagcctactagtcaactactgcggaaggcgcgtacactcgggcttccagtgcttctgactatcacacgcgcatcgatcgatcgatctgg

SEQ ID NO: 48922 - DNA, 173 bp, Zea mays
  Clone ID: LIB3067-046-Q1-K1-F11
tatcacacttacgatctaattgagcttgacattacagttcaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaataacaacatatataaaatatctaaatata

SEQ ID NO: 48923 - DNA, 198 bp, Zea mays
  Clone ID: LIB3067-046-Q1-K1-F12
aaaaaaaaaaaaaaaaaaaaaaaaaaaaaataaaaaaaaaaaaaaaaaaaaaaaaaaaaaaggaaaaaaaaaaaaaaaaaaaaaaaaaaaaaaaaaaaaaaaaaaaaaaaaaaaaaaaaataaaataatgttaccaagcatttaaattttatttaattgtaaaaaccctatactaaatcaacttactaattcatttaa

SEQ ID NO: 48924 - DNA, 414 bp, Zea mays
  unsure at all n locations
  Clone ID: LIB3067-046-Q1-K1-F2
tcgcccacgcgtccggaaaacgtggttgaagtgatcggccgatgttgcatcttattgcatctcatgcatggcaatgttgatgcatcacaggtttcagctatctatgcccagaagtctgtaccaagtatatcagtgattggactgaatggagttctgctgccgaatcatgatggatatatcaactctgaaaatctgaatgaaagcattgagaaagcgtgggctgctcttcatctacaggagacagcagcgaccttgttgacagcatcacttgctacaagaaatgctgaacctgtgaattctgctactactgttttgtcagctcaaggcggctcttctactgtagacaatccttctgattatccagtcaatcaccagatgtttctggtgccagtgaagtngctcattcaactgatc

SEQ ID NO: 48925 - DNA, 228 bp, Zea mays
  Clone ID: LIB3067-046-Q1-K1-F3
cccacgcgttcgatgccctgaatgctacaaaggcagctgtcgaggaaggtatcgctgtaggtggcggctgtacccttttgaggcttgcatcaaaagttgatgcaattatagagacccttgagagcgatgaacataaggttgctgctgaaattgtaaggaagtgcttgagctatccacttaaattgattgcaaataatgcatgcgttaatggcagtgtggttactgaga

SEQ ID NO: 48926 - DNA, 406 bp, Zea mays
  Clone ID: LIB3067-046-Q1-K1-F4
catatgcaataaagggagaggggctcttcgaaggttcggactggctcagtaacacgctcaaatctggaagcagctaatgagccttcgcctcgtcatgaatcatttgctggaggctaaagaatagccgatgcttgcaagtcagcgctcaaatcccattctctttgttttaactccagaagttctacaccgccatcaattatctgtaaagtgcgtgttaaatttcttggatactacattagatgtaccctcaggttgagatcaacaataggtctgcggaaaatgacgagcaaactgtgccactgtctttacccgtaaatctcatggatcatgacaagtttttttatgtaccccaatatgattaaacttacttgacaaaactaaaaatccgtatcatttaacaaaaagg

SEQ ID NO: 48927 - DNA, 202 bp, Zea mays
  Clone ID: LIB3067-046-Q1-K1-F5
ctcacacttacgaaccgcgttatctccgatctcgcattgatgacaatgctggcgtttgggctgacacctgacctgtacgggcctacgatctggtcgacctctgtcagataatgaactttcgaggatcaatactgagactctgaaacggttaccgcattccttgaaggcagcatgcacgcatgtctcccaatgatcacgcaga

SEQ ID NO: 48928 - DNA, 123 bp, Zea mays
  Clone ID: LIB3067-046-Q1-K1-F6
cccactcgtccgaaaaaaaaaaaataaaatataaaaaaaaaaaaaaaaaaaaaaagaaaagggtaaataaaaaaaaaaaaaaaaaaaaagtaaatggaactacatgttactttattaagcata

SEQ ID NO: 48929 - DNA, 303 bp, Zea mays
  Clone ID: LIB3067-046-Q1-K1-F7
cccacgcgtccgcccacgcgtccgcccacgcgtccgctcaaaccctagccgcctgctgcgagtttcagagctcaggaatctgcgccatggcgagtgagacggagaccttcgcatttcaggctgagatcaaccagctgctctcactcatcatcaacaccttctactccaacaaggagatcttcctccgcgagcttatctgcaactcttccgatgcgctggacaagatcaggttcgagagtctcactgacaagagcaacctcgatgcgcagcctgagcttttatccacctggtccaaaccaaggc

SEQ ID NO: 48930 - DNA, 434 bp, Zea mays
  Clone ID: LIB3067-046-Q1-K1-F8
cggacgcgtgggcggacgcgtgggcggacgcgtgggggcggtatcaaaattttccatcagcttgggagccagccgaagctcaagaatggagaaatgtcagccatatgtccagtcgtcagtcacttcccgtgacaagcaaaagttgtttgtccgattctttggtgtgctctacagagtgttcaacaagatgaacttcatgctgctgttggacgacgattgggagccactgatggataattaccggcctttgggaataaaatctctgaggttcagcacattttctcttggaaatatgtcaccaaagatagaagagcaaaaaattcagtacaccattcataccattggaggaagcgtaactgcagttcatggattttttgtccaacttggtgtcaatgtggatacgagtgactgggagcttcaaactctgggaagac

SEQ ID NO: 48931 - DNA, 211 bp, Zea mays
  Clone ID: LIB3067-046-Q1-K1-F9
cccacgcttgctccgactcgtggtctcacttcttcggtctgtatcaagacttcgggtcagggtttaattccatccgaatctcaagattgcataaatgtcagccatatgttcacacgtcaatcacttaccactacaatcataagaatggtgaccgaatctatggtctgctctacagagacttcaacatgataaactttatgctactgttgga

SEQ ID NO: 48932 - DNA, 201 bp, Zea mays
  Clone ID: LIB3067-046-Q1-K1-G1
aaacagccacgtctcccagatctaactccctgcgactcacgaatcccagagagcctgcatggcgacgcaccgacactgcctccgactactgctcgtggacgccgacctcgccctcgccggcgtacctgctcgcgcggcgctgggctgaggtcgcggccagctgctgagcggataggacccgatccctgacgtgagcgactc

SEQ ID NO: 48933 - DNA, 247 bp, Zea mays
  Clone ID: LIB3067-046-Q1-K1-E5
cggacgcgtgggaaaagaaactgctgatgatcctgttagcaatcagtagtttgaggctagttccacttgcactgtatccgatcactaaattggcatgtaaccatagagattattaggttactcataccacgctctgatgtccaaccattaatgtattggtataatgcgacgcagggtataccatgctcgtccattccacggcgcaacaaacctcgaagagttgatctgtattattcaagctggtgca

SEQ ID NO: 48934 - DNA, 311 bp, Zea mays
  Clone ID: LIB3067-046-Q1-K1-G10
cccacgcgtccgcccacgcgtccgccacgcgtccgattgccgaggaactacttgtatttatgctttatagacttccctctgtagcgttgaaactttaattgacacgatcggattgaagcaaacaatgcatgtaacttagtttaaatctctggtctgtgtattgcaacaatggtgcagttcattttagcatgcatcgtcggcaagtttgtagttaggagtcgtgattgaaatgtttgtctttccaatcccggcacaggttttcttgtaatgctatgacgacaatctattcggattccatggttttgtggtgt

SEQ ID NO: 48935 - DNA, 414 bp, Zea mays
  Clone ID: LIB3067-046-Q1-K1-G11
cccacgcgtccgcggactcgtgggctcgaccagctcaaccctagtatggtctagccaccaggctatgctgacgtggaggagaagctgacgctctcccatcgctccgatcagaccgaggcttatattacaggccactgcatggtgatatataatctatctgctgccctgctttggaatggcatccttgtaggctgctaccgagatgttcacgacatgagttgggctggagactgcacggttcagactatagggactggtgaaatcggttagatgacgcgacgactgattgcaacgccacgccgtagccgaactgccatatgacggtactgccgtgctatctgattgatccattgttgtatacgctcgcatgggatctgaattgtcttgtatagtgacacgtcaatagactacact

SEQ ID NO: 48936 - DNA, 349 bp, Zea mays
  Clone ID: LIB3067-046-Q1-K1-G12
cccactcgttcgcccactcgtgcgctagaccagctaaagcctaggatgtacttgggtccaggctatattgacttgcctgagaagcttagaaactctaatcgctcagatcagaccgaagctgacattacatgtcactgcatggtaatgtataatctatctattgcactgctttggaattgcatcattgtatgcatcttccaagatgttcacttcatgacttcggatggaaacagtacggttcacactatatggacaggtgaaatcgacttgatgacacgataactgaatgcaacttcacggcatagcagaactgtcatatgatgttactggagtacgatctaatagatcc

SEQ ID NO: 48937 - DNA, 396 bp, Zea mays
  Clone ID: LIB3067-050-Q1-K1-A8
gccgggtggaggcccgcggcgtccggtgcctttgccggtgccggtgccggcgaggccccgggggtccgccgcgtcctcaggatccaccacaacccgcgcgcgctggcccgcttcgaggagtaccgcgacctggtccgcgcccgggccgcccggcgctgcggcggcgagggcgccgtggtggaggagcgctgcatcgcggacggcaacgagcgcctgcgcttccactgctccaccatgctctgctccctgggcggcggcgtgtgcgggagcccctactgctgcgtgtgcagcaccctgcggcaccggcgacgacgtcgagctgctggtgtacaaccccagagcagtgctcccgtgctttgtcatcctctacagcagcagctagtcggtggcatgaca

SEQ ID NO: 48938 - DNA, 436 bp, Zea mays
  unsure at all n locations
  Clone ID: LIB3067-050-Q1-K1-B1
cccacgcgtccgcccacgcgtccgcggacgcgtgggctacaacgagtacaactacagcaagttgcggctgtggcagctggccgactacgaccgcgtggtgttcgtggacgccgacatcctggtgctgcgcgacctggacgcgctgttcgcgttcccgcagctggcggcggtgggcaacgacggctcgctcttcaactcgggcgtgatggtgatcgagccgtcggcgtgcacgttcgacgcgctcatgcgggggcgccggaccgtccgctcctacaacggcggcgaccaggggttcctcaacgaggtgttcgtgtggtggcaccgcctgccgcgccgggtcaactacctcaagaacttctgggccaacaccacggnggagcgcgcgctcaaggagaggctgttccgggcggacccgnccgaggtctggtccgtccac

SEQ ID NO: 48939 - DNA, 326 bp, Zea mays
  Clone ID: LIB3067-050-Q1-K1-B11
gatatcaagataggtccatcaaaatgtattattgattgacacagacaaatatatcaagaagattgttaattttttaaaaaaaaaaaaaaaaaaaaaaaaaaaaaaaaaaaaaaaaaaaaaaaaaaaaaaaaaaaaaaaaaaaaaaaaaaaaaagacaaatatataaattacaaatcttacaacaaaaaaaaacaaataattagattaccataaataaaaacacaatttaaataatttacaactttattaactaataaatcatattatgaaaaccaattaaataaccaaataaaaatttattatactctacacaattttttaaaata

SEQ ID NO: 48940 - DNA, 111 bp, Zea mays
  Clone ID: LIB3067-050-Q1-K1-B12
cctagatgcagaatcttacgtattggttttggttccttcgagaagtgcaaatgcaagacgcatctattcccattgagtgaatacaggactaccacatgaagtatttgcttg

SEQ ID NO: 48941 - DNA, 404 bp, Zea mays
  unsure at all n locations
  Clone ID: LIB3067-050-Q1-K1-B2
gaggctgcaggtaatgtcgctgacattcggttggattttcaagctgttcaggagaatgctgtctattggcggggagtactttatgtaaattaccaatccaaatttattatgaggatatcattgtcaaatgataaataccaagtaatcaagccacctgtagattttgaatggtttgaatttgaaaatgaatccaggctatccaaaaacctttatttgggaaaatcagagaaaggggtgtactgtgctttgcgttatccgtcaaccgtttccttttcgatttacattctcgatgaatctgacggcaaaacggagtggataatgaagcctcactattatctcgggagtcaaggaatngacgggcctggaccctggactctacaggatatcaactataactgtgacac

SEQ ID NO: 48942 - DNA, 434 bp, Zea mays
  Clone ID: LIB3067-050-Q1-K1-B3
ggaggaggtgagccaccggaagcggagacgtgagtagtcgaccaaccccgtcggtccggggactccggctgcggcgcggcgtgctagatcgctaccgaccatggtggtggaggagatcgccgagggggtgaaaaacctcaccgttaccggagatgcggcggcttcaggcggagaggggcagaggaggggcggcggcggcagcagcaaccgcatccaggtgtccaacaccaagaagcccctcttcttctacgtcaacctcgccaagaggtatatgcaacagcacgacgatgtagagctatccgctcttgggatggccatagcaacagttgtgaccgtggcagaaattctgaagaacaatggatttgccgttgaaaagaaaattaggacctctactgttgaaataaacgacgaatcaagagggcgtccattccaaa

SEQ ID NO: 48943 - DNA, 433 bp, Zea mays
  Clone ID: LIB3067-050-Q1-K1-B4
gctgcaggttcgttcccgagaagttcgaggagatattcgccaggcacgcgaggacagtccgcgacgccctgacctcggacgagatcgaccagctgctccaagcgaacagagagcccggggactacagcggctggtaagtaattaatgacggtaatttccctccccgatgctcgctcctgcctgcagcaccagctctctcactctctccgtttgtcttttttctgtcctcgaaagggctggcgcggaagcggagtggaagatcctgtacagtctcggcaaggacggggacggcctcctccgcaaggacgtcgcgaggagcgtctacgacgggacactgttccaccggctcgcgcccagatggaaatctcccgacagcgacatggagagaagctgataagcgtggtccgggagaacctgaaccggtctggacatg

SEQ ID NO: 48944 - DNA, 429 bp, Zea mays
  Clone ID: LIB3067-050-Q1-K1-B5
agcgatcccactcccgatcagcagctgatcgctcactcttgcagctcggtcattcttgaggggctctagctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggacgagccagctgccccggcggagaccgagccagctgccgccgctgagcccgaggcggcccccgtggcggcggaggaagagacgccaaaggaggaagagacggcaaaggaggcggagccggagccggagccggcggcggctgaagaggtgaaggaggaagcggcagcgcccgct

SEQ ID NO: 48945 - DNA, 427 bp, Zea mays
  Clone ID: LIB3067-050-Q1-K1-B6
cccaacaccacctcgcctgcgatcttcgtatcctccgtcgcgtcgagcatcgatcatgtggggctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggatgacaagggcaccattgaagttgttggcactgataaagagaccaccacccaatgccatgac

SEQ ID NO: 48946 - DNA, 432 bp, Zea mays
  unsure at all n locations
  Clone ID: LIB3067-050-Q1-K1-B7
cccacgcgtccgcccacgcgtccgcccacgcgtccgcccacgcgtccggtatgattgcctggagccagtgcttcttgttggtaccctgcaggataacttcttggccagcttcttgctcgggtggggtataaccattggtgctggccttgcctcctaccccattgacactgttcgccgtcgcatgatgatgacatctggtgaggccgtcaagtacaacagctccttggacgctttcaagcagattgtcgcaaaggagggtaccaagtccctcttcaagggtgctggcgcaaacatcctccgcgctgtagctggtgctggtgtccttgctgggtacgacaagctccaggtggttgtcttcggcaagaagtacgggtctggtggtggctaaggatgtataatgatgatgacgacgaacaacanacatgatgtttt

SEQ ID NO: 48947 - DNA, 432 bp, Zea mays
  Clone ID: LIB3067-050-Q1-K1-B8
gaaagctattaaggctgcttccgagggtcctctcaagggtatcatgggttatgtggaggaggatctggtttctaccgacttccttggtgacagcaggtcgagcatcttcgacgccaaggccgggatcgctctgaacgaccacttcgtcaagcttgtctcgtggtacgacaacgagtggggctacagcaaccgcgtcgtcgacctgatccgccacatgttcaagacccagtagagggttttccccctgcttctcatggatggttgctgcttgtgtatgccgagaataaatgtggatgtcgccaggttcatgctgagtctggacatgttttgcacttttgtttccatttctgccatcatctgtggcagatccgctcgctaatatgggacctgagattagctgtttgctgcttgtggtgaggttgcagttttgtt

SEQ ID NO: 48948 - DNA, 449 bp, Zea mays
  Clone ID: LIB3067-050-Q1-K1-B9
cccacgcgtccgctactgcccaacatgggcacttacctggaattatagaagacaaaattggctgcgtgaaattattggttatcatgctgatatcatctgtctacaggaggtacaagtaaaccatttcgaagattttttttcacctgagcttgacaaacatggatatcaggcgctttacaagaaaaggacaacagaggtgtattctggaaatcctatggccatagatggatgtgctactttttttcgtagagacaagttttcacatgttaaaaaatacgaggttgagttcaataaggctgcacagtctttaacagatgctattattcctgctgcccagaaaagagtggctttaagtcgattgattaaagacaacattgcactaattgcggttttagaagccaaatttggtaatcatggagctgaaaatcctggtaaaagacagctccttt

SEQ ID NO: 48949 - DNA, 435 bp, Zea mays
  Clone ID: LIB3067-050-Q1-K1-C1
agaagggggctgtgcctcaggactacgaggacttcaagagaatgctggcatccctatggtgggagttgtatggaagaggtggcaactctagctgctcttctgcctttgagcatgtgtttgttggtgagatcaaaggacggggacaaggggagagtgaggtatcaggcttccataactggattcagttttacctggaagaagccaagggaaatgtggattaccaaggttatatatttccaaggcgccgtggtgaatcgcctgattcagagatacagctgctgactgttcagtttgagtggcatggcgtgctgaaatcggtatccagcacgttgattggcgtcagtcctgagtttgaggttgcactctacacgttgtgcttttttgttggaggggaagataaccgcgtcgatattggcccgtatagtgtgaacgtca

SEQ ID NO: 48950 - DNA, 104 bp, Zea mays
  Clone ID: LIB3067-050-Q1-K1-C10
agcagctaaggagcctccgcctcgtcatgaatcatttgagcgtgttactgagccagtgcaagacattttcaataaatggagaggacctcttttaacgttattac

SEQ ID NO: 48951 - DNA, 448 bp, Zea mays
  Clone ID: LIB3067-050-Q1-K1-C11
gttgatatggctacaaaaggccaaaaggttgctattaagattattgcgaacaattctgatgagcagcagaggagcttcggcagacactttgatatggaagatgagcttgtcagccggatatcaagaagatctattgatattttgaaacagaactacagggaggatttgacaactgaagactggaaacttgttgtaaagttgaaatcaatattgaagatacaatgaaaagccccctcccctaacacacctgcccatgaatttgggagttgtggttctgtggcgccacacctatctctagttctctacaccggagttccccagggagggttaccaattttgatacggtttgatttttgtaatttgctcggaaggcgcttcattttacaaccacattccgtaataacataatattttgtgtttgtttctgtacttttcatgaactctgaag

SEQ ID NO: 48952 - DNA, 266 bp, Zea mays
  Clone ID: LIB3067-050-Q1-K1-A7
aaaaaaaaaaaaaaaaaaaaaaaaaaataatttaaaaaaaaaaaaaaaaaaaaaaaaaagaagaaaaaaaaaaaaaaaaaaaaaaaaaaaaaaaaaaaaaaaaaaaaaaaaaaaaaaaaaaaaaaaaaaaaaaaaaagccgcccccttttaaaaacccccatctttaaaccctcgtcaaccactctttatctcttttaatatgtccccaaaattaaaaatccatcccccttcacataaaaactcactaattcaaaaaccccttact

SEQ ID NO: 48953 - DNA, 446 bp, Zea mays
  Clone ID: LIB3067-050-Q1-K1-C12
cggacgcgtgggtgaaggagagcagcccggaggagggggagcaagcagcagccgtcggtggaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctagcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaagagttcatcgacattgtggagaccgtatacaggggcgcccggaaaggccgtg

SEQ ID NO: 48954 - DNA, 418 bp, Zea mays
  Clone ID: LIB3067-049-Q1-K1-H12
aggcgtgcgcccacgcgttcggatctgttttgcttagttcttccagttccagcacgggggaagtggcgacaaagctgcggacgcagtgggagcagttcgtgcaggcccggcagttctggagcggcctggacctgggagtcctcgacgtcgaggtcaacaggatggcgagcatcctagaagcagcaggaacccgaatcggttcgtcggcgacggcctacatgctgtcgtggctgtcgagctaccagatgcagcggccgacggccatgggctcgccgagcatcgtggccgccgcgttcgtcaccgtgaagatgcagttcacgctgcagcaggcgaccatcgtcaacactcgtccaccaccatgcatcggcggctgcccggcgtgcgagtgcgggtgcgaggaccgctgcgtgcagccact

SEQ ID NO: 48955 - DNA, 144 bp, Zea mays
  Clone ID: LIB3067-049-Q1-K1-H3
cccacgcgtccgaccacgcgttcgaaaaaatttaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaataa

SEQ ID NO: 48956 - DNA, 466 bp, Zea mays
  unsure at all n locations
  Clone ID: LIB3067-049-Q1-K1-H4
tggcccgaccgacgcgtgcgccccactcaccatcccggccccttttcctccgtttccctcgtgacaaaccctgtcctatccgtctcccttcgggccgctgttacaggtggcccacggctcgcctcccgtctccgggtccgccgcgtcggcgccgccgtcgcccagctccccaccacgaatccggaggtagcttctggggagaagaagatcagatggtcatcaagggctgtgcggtcttttgcgatggcagagctggaggcccggaagatgaggtaccctaccacaggcaccgaggggctcctcatgggcattcttgttgaaggaactagtggcgcagcaaaacttttgcgtgctaatggaaccacacttctcaaagtgcgtgaggaggcagcgaatgttcttgggaaatcagaaatgttntactttagtcccatgcattcaccattgacagaagctgcacaacgag

SEQ ID NO: 48957 - DNA, 447 bp, Zea mays
  Clone ID: LIB3067-049-Q1-K1-H5
cgcaagcgaggtctctcccgctggctcccttctctagctccggcgcccggccggatctcgcggcgtcgcgcccagctctgctgcctttcccatggcggactcccttaccctccagctccctcctgcaaccgagcggctccctggcgcacgcttgcttactgcgcgtgctcgacggacggagctctctagcgcgctcgcccatgccgcgcgcagccaagctagacctgcacgtacatctgactgctctagctatgacgccacgctagctcgccctggctgagatacggcgcttggcgcctgattctctgactctgtacctgctgccaaaggtttttcagtccgggccctgcttgatggaactcgacccgggccccttatgcatgcacggcttaacactgtgcccggtactaagcagtgcttcgtgaagcgctgaacttaactcggtct

SEQ ID NO: 48958 - DNA, 464 bp, Zea mays
  Clone ID: LIB3067-049-Q1-K1-H6
cgtaaatggaaaagtactcacatattcagcgcaggatggtatatataaggtctttgacttgaagaactactacttcctatattcaataccagatgaaaatgtgcaggagataaagatcagtccaggaatcatgctcttgatatacgacagaacaccaagttatgtcccattgaagatattatctattgaagatgggaaacaactgaaattttttaagcacttgttacatcgcaacaagaaaattgatttcattgagcagttcaatgagaagctccttgtcaagcaagaggacgaaaacttccagatacttgatgtgcggagttctgagctaattgaagtcaatgtctccaagtttatgaccccttcagcattcatttttctttatgagaacaatctcttcttgacattccgaaacagaacagtcgctgtatggaacttccgaggagatcttgtgacttcatttg

SEQ ID NO: 48959 - DNA, 283 bp, Zea mays
  Clone ID: LIB3067-049-Q1-K1-H7
gtcacatgaattacgaaccttggtggccagtttgtccggaaacacggttttggtggagaggcggccattatcttacaccacatgccatatagagttaagtatataatagtctatgggtgagaaagtgcacatatggaacgctgtatatagagggggctcaagaatctacagagcaactcatactctgtgatctaccaaaaaaaaaaaaaaaaaaaataataaaaaaaaaaaaataataaatataacgatttatttttaatttaattatatgaacaaacttttt

SEQ ID NO: 48960 - DNA, 319 bp, Zea mays
  Clone ID: LIB3067-049-Q1-K1-H8
cggacgcgtgggaaaaaaaaaaaaaaatattttaaaaaaaaaaaaaaaaaaaaaaaaagagaagaaaataaaaaaaaaaaaaaaaaaaaggacaaccaagtggtcggcctccctgctggctcccactttcctcccgcgtgcttgcttcttctatcgctcctctctaagtccaacctaatttcaattcatttgtccgcttttttacatggtaaaacctgggaaaacccctgcttaccccacttgaatccccttccactttttccccctttcgccatttcgcttagtcccgaacaggtcgcccttgatagcctttcccaac

SEQ ID NO: 48961 - DNA, 452 bp, Zea mays
  Clone ID: LIB3067-049-Q1-K1-H9
atggaaccaggtatggtgctagcttgcgtattcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttctctagtggaaatgtggaatcactgtactggctgttttgccgagacaatgctccttatatttggtttatgctctaggatctcaaagttgtggtgttaagatttgccctcggttaccgttctgaatctgacaagtgatatttgatcctat

SEQ ID NO: 48962 - DNA, 303 bp, Zea mays
  Clone ID: LIB3067-050-Q1-K1-A10
acgtcttgttccccccacccagcttaggcatgatatccaagcaaggctccacaccggctaagacagtcggacagaaaacaaaaaaaccacagcaccaggcaaaacaaaaggaagaaaaggtgtgtgtgtgtgcagttgttgcaattacccgcagttaagattttaagttaacattttcttttttttcattcttacgttgtagatgtgtcattgaaattatgtggttagaaggtggagtacataactgtgtgtgtatttataatagaggtttacttcattgaatcaagctagtgtgaattctac

SEQ ID NO: 48963 - DNA, 361 bp, Zea mays
  unsure at all n locations
  Clone ID: LIB3067-050-Q1-K1-A11
gagtaaagaagtcattgaagcatcagacgccagtgatgacatggttgaagctgaacccgaggaggaaaatgagcccaccctaaacaccaagcctgattaccctcctctccctgaagaacctacaggaagcagggaccttctctgcagggttgcgattcggctaccgaacaaccggaggatccaaagaaacttccttcacacagatcctatcaagctcttgtggtcattctgcgctcctcaggtcgaggacggngagaggagggctttccacttcgtccaggcaattcctggggcatcccagaaactggagttgggaagcgacctaacattcaaggaagccgggctggccaactcgatgatc

SEQ ID NO: 48964 - DNA, 356 bp, Zea mays
  Clone ID: LIB3067-050-Q1-K1-A12
caagatgctgttgacaatttgagagctggaaagacctgggtactgatagcaacggaagtcgtggcccggggaatggacttcaaaggtgtcgcctgtgtgataaactacgattttccagagtcggctgctgcctatattcacaggatagggcgatccggaagagccggtaggtccggggaggctatcacgttcttcacagaggaggacaagccattcttgaggaatatcgccaacgtgttggtatcttcaggctgtgaagtgccttcctggataatggcactgccaaagctcaagcgaaagaagcacagagtggatagggacccaatctcctacctacctgacgaagtttgagagcg

SEQ ID NO: 48965 - DNA, 190 bp, Zea mays
  Clone ID: LIB3067-050-Q1-K1-A2
cagagctccttcagatttatcatacctcatttgaaatttcgaaatagcgtgattgttcttgggggtgctctaagacttactcatcatatctccaatctcatcttgtatttcaaactacactctacaaacaatacagtctgtagtgtaaaaacattattttgggtgaccatatgggtaacctgctgtacac

SEQ ID NO: 48966 - DNA, 420 bp, Zea mays
  Clone ID: LIB3067-050-Q1-K1-A3
agcatgaatctggaacgagaacagttgatcagaatgtttggggggagatccgcaacttcaggaagtgtctgctgaagatgtttgcacagcaggacaaggatgtgttgtttatggagactgtcataagcctggccagacaacggagacactgcatgattgagtgcattcctgtcccttgtgaagtgtcaagcaatgccccaatgtacttcaaaaaggctattgatgaagctgaagaagaatggacccaacatgagatgaagaaggttatcccgacaagtgcaagccgcaacttgaggcaagtcatcccggagaactttgcctacttccatgtggagttcgggctggaccgtggctttgttcatgtaatagatgacgagagcaagttcagtgctggaatttgattgaatgtcattagaggga

SEQ ID NO: 48967 - DNA, 290 bp, Zea mays
  Clone ID: LIB3067-050-Q1-K1-A4
gcgcacaaggtcttagaacctaatattgaagatgtgcgcaccatcgtctgctaggctacttgaaggtggtagttacataaattgcgtggctttaccagatggccatgctaagaaaactactattggaaagggattcgtacggattttggattctatctctgctcaccaagcttttgcaggagatttccctgcttaccaccgcaaatccttggctcgtatttctgaaccgcgccccaatacactacatgtttatgctgaagtgattcatataacaagcctagctgttcctt

SEQ ID NO: 48968 - DNA, 346 bp, Zea mays
  Clone ID: LIB3067-050-Q1-K1-A5
cggacgcgtgggcggacgcgtgggctagattaatatgagaaggggctacagttacaggccgtcaccaccaaggggctacaggagaagggcgcgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggacgcaacacaagcctaaaagattattgttgaagagaaggaagaaatagagaaattcaattaagtgatctgcaacttaaaagagtactc

SEQ ID NO: 48969 - DNA, 439 bp, Zea mays
  Clone ID: LIB3067-050-Q1-K1-A6
agaaccgccgccacgccacacaaaaagcagtgactcagtgagaaaggacagcaagcaagccctccctccatctccgccccgtcgccatggtccttctcttcgtggagaagctcctggtcggcctcttggcgtccgtcatggtcgccatcgcggtgtccaagatccgtggccgcaagctccggctgcctcccggccccgtccccgtgcccgtcttcgggaactggctgcaggtcggcgacgacctcaaccaccgcaacctcgccgcgctgtcccgcaagttcggcgacgtcttcctcctccggatggggcagcgcaacctggtggtggtctcgtcgccgccgctggcgcgggaggtgctccacacgcagggcgtggagttcggctcccgcacccgcaacgtggtcttcgacatcttcacggacaaagtgcaagacatggt

SEQ ID NO: 48970 - DNA, 449 bp, Zea mays
  Clone ID: LIB3067-049-Q1-K1-H11
cccacgcgtccgaagaatcccagcttctttttgaggtttactttgttttaggccttcctagggtgttatatctactcttgggaccatatcaaattcacaaagtctcgacacaatcggatggtttgcacgagatccatgtattcttcatcgtgttggtgaagttcttttaccagccgctgtaggtggacttaagcaaacaaggcaatttgtttttgccgatgactgctttcagctgctaaaggtctctaatcagaaaactgtgcatgccataaaaaatgctgtccaggcattacgtggatccacctaaacacatcaatattggccaatatatttattccaatgtacctagcctgaaggagttttgcgaaccagctacaaagttagaagaaggaacatcagccctgaaagcaatctccacagtgatgttgttattacagagatatgagttt

SEQ ID NO: 48971 - DNA, 306 bp, Zea mays
  Clone ID: LIB3067-049-Q1-K1-F6
aaaaaaaaaaaaaaaaatataaaaaaaatttttacaaataaaaaaaaaaaaaaaacaacaaagataaatttataaaaaatacatatcacaatcatccataacaaatatattcaatattgtacctccacattcaaactacttctacctattccttcaatttttcctctatctatcaatctccttaaccattcctgatcacctgtacatccatcctgcattctatgattctctttctattcatgacacacacaacaacttctattccgaatctttcttcaatcccatcttcaatattcatgcgatcta

SEQ ID NO: 48972 - DNA, 441 bp, Zea mays
  Clone ID: LIB3067-049-Q1-K1-F7
cggacgcgtgggcggacgcgtgggcggacgcgtgggcttgaccctatggacttctgacatgtgggaggaccctgcggaagagatcagggaggcgcccaagcacgactcgagcgaggggcagtaaagccggctttacatgcctagaagctagtacctagtgtttgctgctgtctaatgacattatgcaatgtgatctggaccctggtttcttgggtgcgacgcttgtagcagccgtcttatgattatttgtcgggaaaatttgggggctccccatatgagatgctgccgggcaagacctcgccatcccccacctcgtttcaagcgggggacgctggagcctggtccggttgggttgggaagccccttaaactgttgtcgcttgcattttaaccttttcatcggcgttcagtggtcctaaatctatggctcgtctcagtggtc

SEQ ID NO: 48973 - DNA, 449 bp, Zea mays
  Clone ID: LIB3067-049-Q1-K1-F8
cccacgcgtccgcacagggcacacgcacggcacgcagatacatatagagagaggttagctagagcttgcacatctatttaactaactaactaactggctagctagctcgatcggcagagcaaagcgaaagcagcaagaagcaaagcaatggagaaccctgcgagtgtgctagttctaccagcgcagttcaccaaactcaccttccgaaacctgtacatccgccgggccgggccgggcagcagggagataaccgaggagggcaggtgcgacctggacaagagatacgtgagtgacttccccgtctacgacggccgcggccccgacgccagccttgtggcccgcgtgcaggggatcaccagcgaaatcgggaacgcgcacaaactgttcgtcgttgttttcgacaccgacaggctcaagggctccacgctcgtcaccaatggcgtgataac

SEQ ID NO: 48974 - DNA, 453 bp, Zea mays
  Clone ID: LIB3067-049-Q1-K1-F9
cccacgcgtccgcaacaggtgaggcaactgtttctggagaaccagctgaaacagatacttgggctgataagggcgctaaaatggaatcagatgcaggtgatggtaattgggagaagtccagcactcttgaggcatcaaagaaaaatgacccatcagaaaatacatgggacaaaagaaaaggagatggaggtgatggtgcgtgggggaacaggtctgatgatggccatggcaattgggagcatcccagcaattggaatgggcagagtttggatgtagatcaggacacatggggaaacgccaggggaaaaaagaaggcagatggtaactactgtcaatgggaggagcagccaagcaattacaaacagaagaagacaaatgctgatcatgattcctcctataacaatgtgatgccgtcatcagaaattgcttggaatgctggagagggaactggaa

SEQ ID NO: 48975 - DNA, 399 bp, Zea mays
  Clone ID: LIB3067-049-Q1-K1-G1
agcttacagaagccatggtactcagttctaggaaatcatgattacaggggcaatgcgctcgcgcagcttatcccagtcttgaggaagatcgacgaccgattcatttgcatgagatcgttcatcgttaacgcagaacttgtggacttcttctttgtcgacaccactccgttccaactggagtattggactcacccgggcaagcatcgttatgactggagaggggtggcgcctcgaggcaagtacattgccaatttgctgaaggatctggatgtggctatgaaggaaatcaacttgcaggtggaagattgtggttgggcaatacaccatgaggagtgttaatgagcacggggaccccgaggagcttttggaattactactttcaagtcttaagggacaatg

SEQ ID NO: 48976 - DNA, 385 bp, Zea mays
  Clone ID: LIB3067-049-Q1-K1-G11
aggaatctcaagaaatccatttctttgttgttaagacctacaagggtggcaatgactgtgggatatttgaatctgaaagaacagttggtcatacagttaccagccccagtgacacagctcagcaatgcagatctctctttttgtcgaagtgatctccagcttatttccaacacatatttattaagtcatctttgactgaatgccttttggtatttttttcaagacaatacatgccaccattttttctttgaataattggatctataccattaaaagattgcaactttagatatatactattggctccacatatcattgactcatgtgaaccatacatgtaagtgagataacaatgatatatatttaaagttgtaatcctttaacg

SEQ ID NO: 48977 - DNA, 435 bp, Zea mays
  Clone ID: LIB3067-049-Q1-K1-G12
ccttctcaaccctccgggccgtcaacctcttcagcaacctcatcgttcatatctcccctggatcgctgcccaagggcctccactctcttgatctgtccaggaacaagattgccagcgtcgagggcctccgggagctcacaaagctacgcgtgctcaacctcagctacaacaggatttcgcggattgggcatggtctgtcgaactgcacggccatccgggagctgtacctggcgggcaacaagatcagcgacgtggagggtctgcaccggctgctgaagctggcggtgctggacctgagcttcaacaagattacgacggccaaggcgctggggcagctggtggccaactaccactccctcctggcgctcaacctcgtaggcaacccggtgcaggccaacatcggcgacgacgccctgcgccgggcggtcacgggcc

SEQ ID NO: 48978 - DNA, 450 bp, Zea mays
  Clone ID: LIB3067-049-Q1-K1-G2
gccacgccgtcggaaaaaggtccggaccgccgttcagatggcaccgggtgcgtgagacgtgtgagcgaagcaatctgtacgcgccgcagtaattggcatcgaccgtgaattttatcgagcagctgacattcctgtgacgtggtgccgatctcgtggttatgttatattgttatgtttcttcctcttggtgtgacgcagggaaccgcgcctccggccggacgccgctggactgggagacgcggtcggcggtcgcgctggcggcggctcgcggcgtggcgcacatccactccacggggcccacggcgtcgcacggcaacatcaagtcctccaacgtccttctcaccaagaactacgaagcgcgcgtgtcggaccacggcctccccacgctcgtcggcccctccttctcgcccaccagggtgtccggctaccgcgcaccggaggtcaccgaca

SEQ ID NO: 48979 - DNA, 431 bp, Zea mays
  Clone ID: LIB3067-049-Q1-K1-G3
atcacgccgccactgatctgctctgttgctgtgtgactaggagcagtagcgagagggattctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctctggtatcgctaaaagtcttagctgtgaaactagttctcacttctgtgtgactgtgatcaaaggacttgtgtatgatcaaaggagatccatcagttggtaccgaaagtgattttatgtcttggtggttacctggaatttaattaaaa

SEQ ID NO: 48980 - DNA, 346 bp, Zea mays
  Clone ID: LIB3067-049-Q1-K1-G4
ggagcccttccatatttaccggtgaggagtctttcgcacaaacaatcgccacagttgaagagcgccgcggacctcatcgacaagcttgttgctggcaaagcgtagttctgtacctcctctatcgttgtcctaccactctaggtctatcccttgatctaggtttctatggtcttaagatttgtgattttctccgcactgttgttgctatccccgtgtcgtaataatacgagatgttttaagcggttgaacattacggtggtgtaatcagagtaatctgttgctgttaaggtgcattgttgtatgaattgtctctacccgagtagaagaatcagaccattcgggattc

SEQ ID NO: 48981 - DNA, 305 bp, Zea mays
  Clone ID: LIB3067-049-Q1-K1-G5
gagcacctcgcctcattccatcccacgtcaagctagatctgccggctctaggcttagaacacatccggataatggtggatgcatcgttctttctgttcgtcgtaagcagttctttgtatcaagtgagatggcagtgacgactcggtaaaattcaagctcaacagaccaaatcacaggtctctctctacatgagatcgatctgtatgccgattttcccgctgaactgagccatctaatttttctctgcttatttgctattcggaatattttctctctacatgaaattcccggttgcttttttttcc

SEQ ID NO: 48982 - DNA, 441 bp, Zea mays
  Clone ID: LIB3067-049-Q1-K1-G6
cccacgcgtccggagctctactccatcctctcgatctcgaagcgcagcagcagcagtgggggggccatggacgccagcgcagccggagccggcgggaaggcgaagaagggcgcggccgggcgcaaggccggcgggccgaggaagaagtcggtgacgaggtccgtcaaggccgggctgcagttccccgtcggccgcatcgggcggtacctgaagaagggccggtacgcgcagcgcgtcggcacgggcgcccccgtctacctggccgccgtcctcgagtacctggccgccgaggtgctggagctggccggcaacgcggccaaggacaacaagaagacccgcatcatcccgcgccacgtgctcctggccatccgcaacgacgaggagctcggcaagctgctgtccggcgtcaccatcggccacggcggcgtccttcccaacatc

SEQ ID NO: 48983 - DNA, 451 bp, Zea mays
  Clone ID: LIB3067-049-Q1-K1-G7
ctagcaaattgatcgtgggagctgatttccattgcttcaagaacaagatcgagccaaaatgggaagaccctatttgtgcgaatggtggtaaatggaccatcagctgtggaagaggaaaatctgatacattttggctgcacactctgctggctatgattggtgaacaattcgactatggtgatgaaatttgtggcgcagttgtcagtgtgcgtgggaagcaggaaagaattgctatttggacaaaaaatgctgccaatgaagccgctcaggtaagcatcgggaagcagtggaaggaacttctggactacaaggactccattggattcattgttcatgacgatgcaaagaagatggacaaaggcctgaagaaccgttacacggtttgatcctgatgctggaatcccagagagttgtagcagtagctggcccaaatgcatgctgggtggtttta

SEQ ID NO: 48984 - DNA, 393 bp, Zea mays
  Clone ID: LIB3067-049-Q1-K1-G8
gccttgtcggggcagcacacttgggacgcgagggggaggagttggtgagcgaactcgggagcagtgggtgaccgcagagttcttgcttcttcctcttggaggaggagggctgcagcctgcaggggccggagagagcaggaggaggcggagacatgggtagcttcgctaagctggcgaggagggcggtggagacggacgctccggtcatggtgaagatacaagaactgctccgaggggccaaggatgtgatgtcgcttgcgcagggagttgtttactggcaacctcccgagtcagctatggataagatcgaaaagatcatcagggaaccaatagtcagtaaatatggttctgatgatgggcttcctgagcttcgagaagcacttctcgaaaagc

SEQ ID NO: 48985 - DNA, 167 bp, Zea mays
  Clone ID: LIB3067-049-Q1-K1-G9
cgcgtccggtttgctgtgtgctgtctgtctgtgaactttgtggttcttgtttcctaataagtcctaacggttgatgtgtgtgtattctgtattctgtatcccggattcccgatgcttggtctgtgatgtaataaatcctggaattcaacagttgttacttctgatct

SEQ ID NO: 48986 - DNA, 451 bp, Zea mays
  unsure at all n locations
  Clone ID: LIB3067-049-Q1-K1-H10
cggacgcgtggggtctcctaataactagtttctatcttgctccccaaaccagcgcaaaccgtgccctgacaccggcagcgacacgtccaccggcggcgccatggtgctcgaggcaacgatgatctgcatagacaattcggaatggatgcggaacggcgactacgctccgtcgcggttccaggcgcaggccgatgccgtcaacctcatctgcggcgccaagacccagtcaaacccggagaacacggtaggcgtgatgacaatggccgggaagggtgttcgcgtgcttgtcactcccaccagcgacctcgggaagattctcgcctgtatgcacgaagttggcgctgaggcaaacttggctgcggcaatccaggttgcccagcttgctctaaagcatcgccagaacaagaggcagcagcagaggattatagctntcattggaagtcctgtgaag

SEQ ID NO: 48987 - DNA, 225 bp, Zea mays
  Clone ID: LIB3067-049-Q1-K1-F4
gacgcgtgggcctccatccatgacgtctgggaagaactgacgcacgtggctcaattcttggcatgagagattctaggggacctgtaatatatattcaagctagggataatcctggatctgtcttcgtgcgatgggttgacatgttcattcagttctcaaagttcttgtagtgtactgattgtctgttgatctattctgaatgtgatgatagtacttcgctgcctc

SEQ ID NO: 48988 - DNA, 438 bp, Zea mays
  Clone ID: LIB3067-049-Q1-K1-E10
cccggtcatgatccacatctttccgagcgatttattggctggccttttcctcttctgaccggggggaaggctctaggggcacctcgccactctcactaatcaagtactaatgcatgatctacacattcagatcccaactgccttcgaccccttcgctgacgccaatgctggagacaatggtgcacgatcagactccaaggactacatctacgtgcgcatccagcactgtaatggccataagagcctgaccaccgctcatggatagcagaatgatttcagctacaacttgatcctcaaagatatcatgatagagcactgctgtaatggcacactgctccatgacccagaactagtacaggtcattcagctccactgtgatcagaggaacgaactctccaatctactagcacaggccgtcattgtgcagaacgatcacat

SEQ ID NO: 48989 - DNA, 444 bp, Zea mays
  Clone ID: LIB3067-049-Q1-K1-E11
gggcccgctcgaggtcggctccgacggcactttctagttcgaggagaaggacggcatcgaggacgcctacgtcaccgtgcagctcccggtgggcgagcgcgtgccgttcctcttcaccgtcaagcagctcgtcgccaccggcaagcccgagagcttcggcgggcccttcctcgtgcccagctaccgtggctcctccttcctcgaccccaagggccgcggcggctccaccggctacgacaacgccgtcgcgctccccgccgggggcagaggtgacgaggaggagctccagaaggagaacatcaagaacgccgtcttctccaccggcaacatcacgttgagcgtcaccaagagcaacccggagaccggcgaggtcatcggcgtcttcgagagcgtgcagccgtccgacaccgacctcggggccaaggcgcccaaggatgtcaagat

SEQ ID NO: 48990 - DNA, 447 bp, Zea mays
  Clone ID: LIB3067-049-Q1-K1-E12
ggagtggtgaagggcttccagcagggactttacatgggcaacggtggtggcgccaatgttggcggacctggctacaccaagggtgatggccttggcgctgagattgttggcaccttcatcctagtctacaccgtcttctcggccaccgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcacgcctggaacgaccattggatcttctgggtcggccccttcattggcgctgccctggctgccatctaccaccaggtgatcatcagagccatcccgttcaagagcaggtcttaagctgccgtggccgtgccgagacatgcc

SEQ ID NO: 48991 - DNA, 281 bp, Zea mays
  Clone ID: LIB3067-049-Q1-K1-E2
gtggcccaaggaccctccacagccagaacacttcttcgtggctctggagagcaacgcgcctgtgcaacctacataccatactatggacatgaaccagcagccagagccagcgccgggcggctgctaccctcctgcgtggatggcttagccagcgctttggttccattgccttgagaagtgccgtgtccttcagagatcgctacgagtgctgttgcctgcccactttgctgcctgccatgcttaccgaactgttcaaataagaaataaccacatggtcctat

SEQ ID NO: 48992 - DNA, 283 bp, Zea mays
  Clone ID: LIB3067-049-Q1-K1-E3
tgtgtagagcatgttgtaaatgcttcatgtgctgttcgtttctagaaaaaataaaaaaaaaaaaaaagaacaaaaaaaaaaaaaaaaaaaaaaaaaaaaaaaaaaaaaaaaaaaatccaccaaaaaaaaaaaaaccaacacaaaaatcaccaaaatacaacaaaaatacaacaataatcaaaccaaaaaaaataaaaaaaaaacgtaaaaattaaacaaacttaacaagaagaaaacccctgaataaaccccaaaatataccccatgcaacataaaataaaaa

SEQ ID NO: 48993 - DNA, 249 bp, Zea mays
  Clone ID: LIB3067-049-Q1-K1-E4
gcggcgcctggaacgcctcccgatttcgactttttcacgagagagcgatggcgctgactaagcggatcgtgacggtcgccgtggttctcccggcagtagcttctcttcaccaccgacatgctcatgctctgggccctgttgcgcaccaacgcgcgccagttccggcactggctcgaggacgacacggcctacgccgcatacaagtctgcacaagaagcatctgcaaagaaactcgactcgacgtgcccc

SEQ ID NO: 48994 - DNA, 310 bp, Zea mays
  Clone ID: LIB3067-049-Q1-K1-E5
cccacgcgtccggaacacttgagctggaacaggctgcccgatcctgctacccaaactacggagctgtccttacctgagagaagagaactcgaagtgacatacactgaccatgtcatgatccccactctacgatctcggaaaggctacctcctgccaatacacaggccacacacactgacgcacgaaactacttggctctcgcaatctcgatcactactgccgacaccatctggatcacgtcctcggcaccaatgtcgtcccaccttatacgtatcgctgctgctcacatgagccggctattctgaccgat

SEQ ID NO: 48995 - DNA, 454 bp, Zea mays
  unsure at all n locations
  Clone ID: LIB3067-049-Q1-K1-E6
cggacgcgtccgcccacgcgtccggtttctatagccctctctgccactcgtgatcccacgggtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaaaggcaagctcgtgaaggtcaaggcttcgtacaagctctcggacgccgncaagaaggcatcccccaagaccaaggctaagccggcaaaggccgncgctgccaagaccaccgncccc

SEQ ID NO: 48996 - DNA, 212 bp, Zea mays
  Clone ID: LIB3067-049-Q1-K1-E7
taaaaaaaaaaaaaaaaaaaaaaaaaaaaaattaaaaaaaaaaaaaaaaaaaaaaaaaacaatgaaaatttttcactaacttaaaaacacaaacatacaaaaaacaaaaatctaaaataatttaacctaatttaaatctacttccctcatctttacaacttcctatactgttaaaacccatccttatcccaactaaatcaccattcatcata

SEQ ID NO: 48997 - DNA, 299 bp, Zea mays
  Clone ID: LIB3067-049-Q1-K1-E8
acccacgcgtccacagacgcgtccgtattaaacttcataaattttatattatattatatcttaactaaaagacgtaaaattatactagtacgaagagaaactcaacaaaaaaaaaaaactaaaaaaaaaaaaaaaatggacgcacaatctaaagaatccaaacttaccaacacatacatgatacaacatatctcttctataaaatcacctaaattcaatacactatccatcacaagacaacaacttgactagtaaaaccctagcattaccaaacttaatcaacttacaaaacatccccc

SEQ ID NO: 48998 - DNA, 450 bp, Zea mays
  Clone ID: LIB3067-049-Q1-K1-E9
ccccactctctctgatcccgtcgcacttccctcctcgctgcagcccctctattattgcgaggacggtttcctcactgccctttcctttttcggtcggcagcaatcaccggggcaagcgaaccctcgatttgcgtccccgctctctgctagcgcccctaaaagaggagcgaagcgatgtctatgccggagacgggtcaggccgcggagagggatgagcagcagcagtcccgagggatagcactgatgcagggcatctgcgccgtggtgtaccgcaaggccgataacacgccctgccccatcaagcagggtctctacttgggatctgttggagcagcattcaataaggacgctctcaagagcttgaacatcacccatatcttgatcgttgcaaagtcactggatccagtatttccagctgaatttaattacaagaagatcgaagtacttgat

SEQ ID NO: 48999 - DNA, 447 bp, Zea mays
  Clone ID: LIB3067-049-Q1-K1-F1
cccacgcgtccgtgctgagtatatcctcagatggcttcctagaggcacacatgagtggtccggactggttaccccggaggagcttgtcctaatgctgcaaaaggcttccgtctccgtcgaagagatggcagggttcgtttacaatccgttgagtggagaatggtccctgtcagatgatatcagtgtgaactacattgcttttggcgtcaagaagggtgaagcatcatcgacaaatggcagagatgcaagtttatcatagctgaagaaaaacacgtgaccttgaattgtcgggcatcattttcagaggaccaattcatgtcactgaaatcttactgctaaagatgcaaccaagtagcagaagagaattctcttgccctttgttagtcttggaaactggagcttgtggagtgatgcttcctggaagcgccattgagaagtcaagttgac

SEQ ID NO: 49000 - DNA, 441 bp, Zea mays
  Clone ID: LIB3067-049-Q1-K1-F10
tcggcacgccctcgcaagctcgctgtcggtacaacctagccgctgctccaccgcgcgtgtagctgctcgacgatatgcacaaccggctgcgtgtggtcatgctggtgttctgcgcagcgcttgcgcgacgccaccgatctgcgcagcgccttcgagtcgtcgtcgaaacccgcagtgagctccctgctgccccgtgctttttgtgttaaattaaaaggccgcaccaatgaatcacataataaattgtgtaatgattgtgtatatcgtttaatcgcagcccttgtcaacgtcacgccttgcgcatcgctcgtcggcaaagagcccaaactaatggcatgcatgcgcggcacgagtcggccaggttgttcgccttgaatgattcgtgattgttttatttacgtattttggtcgatgatgtgcgtgtgtgaatatgtgcgtgaa

SEQ ID NO: 49001 - DNA, 424 bp, Zea mays
  Clone ID: LIB3067-049-Q1-K1-F11
gctctcaattgatgtcatttcaggaggaacattcaccatctccaaggagggtgtctatggaagcctcctcagcacacctatcatcaaccctccacagtcgtctattctggggatgcattccattgtgcaacgccctgtggttgtgaatggtgacatccttgcgaggccaatgatgtaccttgcgctgacttacgaccacaggttgatcgatggcagagaggctgtcttcttcctgcggcgcatcaaggatgttgtcgaggaccccaggaggttgctgcttgacatataaattcatgcaccagcgctgcgctgccctgccggactgttttgtgcaattgtgcttatctggaaataatgccatggaaatttttgactgatgaaaaagaattactttctcagaaagacgaaatctgagctgaggata

SEQ ID NO: 49002 - DNA, 254 bp, Zea mays
  Clone ID: LIB3067-049-Q1-K1-F12
cggacgcgtgggcggacgcgtgggttgaggttgcctctctaataacattcatctgttcctgggggggggtttctaagtcacgtagtaatacgtgtactcgcgaccagctgatgcggtcaacgctagctagtgattttgatttgtacaagccagatatattgtgcactagaatcatggcaaccgaggtcctatggagctcggatggcacatgtggaatgctaatcggctggaagatataggggatatgcaccgaa

SEQ ID NO: 49003 - DNA, 455 bp, Zea mays
  Clone ID: LIB3067-049-Q1-K1-F2
cttccgaaaggaccatatacctatttacataacaaattctatggtaggtcgcaaattgggggaattcgtgcctactcggcatttcacgagttatgaaagtacaagaaaggatactaaatctcgtcgttaattgaattcagaatagaaagattcagaataaacaaaatttataggattcaaataatcaaataaagtaaaggtaggcgggtaataaccttatttatgacaagtttcaaattggtaaagtatacccctaggataaagaagaagaaggggctgagaaaactcgcaagaaaagttccaaccgatcgtctacttaaattcgaacgggttttcaaagcacaaaaacgcatacatatgtctgttttcaaagcacaaagagttctagatgagattcgctggcgttactacgaggaaaccgttatgatactgaatctcatgccttatcgagcatc

SEQ ID NO: 49004 - DNA, 357 bp, Zea mays
  Clone ID: LIB3067-049-Q1-K1-F3
cgccaacgcgtccgggcagcgacagctggctcctatgggcgggcgatcgctggaagcttcgaggggcgcgtcctctacggcaagggcgtctcgacgaggagggccgtgcacgcacttgcgtacgacaagaacctggaggaccacatgcgcccggcgttcgtgcctgacgatgtgatcggcagtgccaggagcccggacaagtactggagcccccaccccatgaccggcctgatctgccccgccgttgtggaccccaagctgctcgatggtggcacaccagacgccagcacatatgctgcatgacgcacggagctggaccataacgtgtggttccagccggtcgaggacgtccagaag

SEQ ID NO: 49005 - DNA, 455 bp, Zea mays
  Clone ID: LIB3067-049-Q1-K1-D9
cggacgcgtgggcggacgcgtgggcggacgcgtgggccgcacatggggccccactctctggagagggacctatcctcgctggctatacgtctcccctccgcgcacaaaaaccctagcacgcaggcgcagccaggcctgcacccaaagcttccggagaattcctcccttgccccgccgtcgcatcctcttcgaagttcgaatcgaatcgcgccgcgatcacccacctcatggcggacaaggagcctgtcgtggagcggccagaggcgggtgaggaggaggaggacgcctcagccgccgccgccgcgggggaggaggaggacacgggcgcccaggtggctcccatcgtgcggcttgaggaggtagccgtcaccaccggcgaggaggacgaggacgtcctgctcgacatgaaggcgaagctgtaccgattcgacaaagacggttaccaatggaaggaa

SEQ ID NO: 49006 - DNA, 452 bp, Zea mays
  Clone ID: LIB3067-049-Q1-K1-C11
cccacgcgtccgggacctttacggatttggggctgaaggaggcaaaggagctagtggagagggggccagtcattctgaagcaatcgctcacaaaggacgaagcagaagcaatcatagggaagataaaggcagctggcggtgttgctgtcatggagtgaacgaagggatgaccatctcgacacaacacacttttatttcctatttttgttgccatgatcaagcatttgaattgcacattgcagtgcctttatgctgatggagaaaatagtttacatctacgttggtaaccaaggcgagagggaaactagagatttagttgctatgatgatattcatgacttgttctagaataagcagttctttgggctctacacaacttatttggtggagtgaatggatgttgccatcagggccaataccatgaatctgatgttcttgttgtatcctctatga

SEQ ID NO: 49007 - DNA, 448 bp, Zea mays
  unsure at all n locations
  Clone ID: LIB3067-049-Q1-K1-C12
ccttgatgtgctaaacgcgtgcatgcaggcgtgatctgcgggccggcgagcctggtgaacgcgaggatggacctgcaggagggggcgctgatgctgctgggccccacgatgaacgccaaggtggcgttcgagctgtcggagcggctgccgcacctgccgctgcggatgcaggagcactcgcgccgcgcgctggcgttcgccgagcggatgcaggggctgggcctgcgcgtgctgtacccgggccttccgggccacccgcaccacgcgcgcctggccgccatgggcaacccgggctacggctgcggcggcatgctgtgcctcgacatgggcaccgaggagcgcgccaaccgtctcatgcaccacctncagaacaccacccagttcggcctcatggccgtcagcctcggctactacgagacgctcatgtcctcctccggcagcagcacca

SEQ ID NO: 49008 - DNA, 433 bp, Zea mays
  Clone ID: LIB3067-049-Q1-K1-C3
gtcatgccttcgtccacgcgttcgctgacgttttgagatgtacacactcgaaaccaaacggggggatgtggaaagacgtgtaaactgcctggtctgtcttctgtgacgaacggctcgtctttagaacaatggccatgtctatgacgagttgccaatagtacgcttactggctatgaacttgcacctacggcaacattttacacattttgagtgagaatcatgggaagatccatggatcgtctattatgatgtacgttgcctgcttaataatgggaccaatttcttctgctgagtttgctaaaggagcacaagaattttctgaatgcccatcatggtagaaaggttgagatcttggttggttcccgcgtggcaagatggctggtcctttccaggaagttgctttcaacacacctgacggaactgttagcgcacc

SEQ ID NO: 49009 - DNA, 457 bp, Zea mays
  Clone ID: LIB3067-049-Q1-K1-C5
cccacgcgtccgcccacgcgtccggcttgattatattgttccttcatcacacaactgtgacgattccgcatgtgaaccgtactgagtatcagctgattgatatttctgaggatggatttgtgaggcttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcatt

SEQ ID NO: 49010 - DNA, 452 bp, Zea mays
  Clone ID: LIB3067-049-Q1-K1-C8
cccgtctgccacctcgctgcttagtgcttatatcaccattcaccagctagcttctcaccagggccaccgccaccgccaccgcccgctggctggcttagcgcgtaggctgtgactgactgactgactgcgagaccacagcaccggaggacgcccgcgcgcgcgaaccgcagcgcagaggcaggggaaccttgtccgcggctcggccggcatgaagctcccgctgctgcgtccgctgtggccgggcctggggcctgcggcggcggggccgctcgacgcggcgccggagccggccaagccctcgctgccggccacgtggctgctgctgcacgcgctcttctgcgccacatccatggccgtcggcttccgcttctcccgcctcatcgtcttcctcctcttcctgcccaccccgcccatcaaccccgccgcgcacctcgtctcgctcgtgtcctcgc

SEQ ID NO: 49011 - DNA, 456 bp, Zea mays
  Clone ID: LIB3067-049-Q1-K1-C9
cgcgtccgggtgaacgtgtgcgtgtgtatatacatacacacggtcgccgccgccgcaggcctcgctccgaccgccaccggactcccctttcgcgtccgcttctcttgttgttgctgtgctctcctgttaccgggacccggaggaaggcaggaaggaaggaaggaaggaaggcggtgatggcggaggagacggtgcgggagctgcgcgcgagcttcgcggcggggcagacgcgcccggccgagtggcgggcggcgcagctcaaggggctcatccggatgatcgacgagaaggaagccgagatcagcgccgcgctccacgaggacctcgccaagccgcatatggagtccttcctccacgagatatcacttacaaagtcgtcgtgcaagtttgcgctcaaggggctcaagaactggatgaagcccgagaaggtacctgcggccataactacattcccgt

SEQ ID NO: 49012 - DNA, 287 bp, Zea mays
  Clone ID: LIB3067-049-Q1-K1-D1
gaccacgctccgcgacgcgtgggcaagtcaagtagcaattgtctgaaccttttggctctcatgaagaattgacgatgtatcttttggttctcatgtttttactcaatggtgaacttgtaatgaacttgtaacagatgtgcttttgggagcagtttgcacatctgttgatgtgcacctatgttgtaagcacattgtatgtgttaatttggaactttggatgtttaatgtggtgaaaaaaaaaaaaaaaaaaaaaaaaaaaaaaaaataaataaaaaatatattaatat

SEQ ID NO: 49013 - DNA, 468 bp, Zea mays
  unsure at all n locations
  Clone ID: LIB3067-049-Q1-K1-D10
gggccgaccacgcgtccggcaaaagcatgcagaggattgcctgcagaactggcagcgaagcttgtcgttaagcaagctgggaaaacaagcgggctaaaggatgacaccacctgtgtcgtagttgacattatcccgtccgatcatctgacatcgccacaattgtctccaaagaaaaatcagaacaagttgaagtcactttttcgtagaaggtcgcatagttcagttagaaagcttggaggcaagtctgcctccattggttccgtggaggagttatttgaagaagggtctgcaatgctagaagaaagcttattttcagcttcttcacaaatttaagcagaagttctgccaaacagccagcttctacagcagcttattagttcagctgcttctcagaatacactaaaagcagccaacaagcagaagctgcctttcaccagcttctcagataagctgctttntcaacaagca

SEQ ID NO: 49014 - DNA, 448 bp, Zea mays
  unsure at all n locations
  Clone ID: LIB3067-049-Q1-K1-D12
cggacgcgtggggacggacacccttccctccgcagctgcgctgccggacgctttctgtcgtgttccactcttcgctgcagaaagctttttttttttcttggcggagattgttctctgctcccttttttcgcgaggaaacctaactcgtttctctctctacgacatctgcaggctacggggcatgcgtgtacaccgggggaggccaataatgcacggcgcacggcggtgccaaccccgtggcacatgattagttttgcgagtaccacgcacgcacgatggtctggattgccgagtgaaaaaggttgtgcgtgcctacaggctacagcaagggaagggctctgggcggaccgaataattgcggttgttgccgtggttggcgtgttgtagcgtagtgcagtgcagtgcagtgcagtgcagatcctctngtttggttcgtcgtaccggaaga

SEQ ID NO: 49015 - DNA, 454 bp, Zea mays
  unsure at all n locations
  Clone ID: LIB3067-049-Q1-K1-D2
cactcatcttttctcgtttagaacctctaaaatttcccccactcgccagtcgcagcagcacgtgtagcagccatggacgccagcggagccggtagcaaggggaagaaaggggcggccgggcgcaaggcaagcggccccaggaagaaatcggtgacgcggtccgtcaaagccgggctgcagttccccgtcggccggatcgggcgctaccttaagaagggccggtacgcgcagcgcgtgggcactggcgcccccgtctacctcgccgncgttctggagtacctcgccgccgaagttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcc

SEQ ID NO: 49016 - DNA, 456 bp, Zea mays
  unsure at all n locations
  Clone ID: LIB3067-049-Q1-K1-D3
agccttcggccaagccgtccgggggacctaaacccccttttttttgaaccatgaatggggttacgtgctggcgtcgctttcctgggcagctgaattctgacctccggaagcttgcagtgaacctgatccccttcccacgtctgcacttcttcatggttggatttgctccactgaccttgcggggctcccagcagtaccgcgctctcaccgtgccagagctgacccagcagatgtgggactccaagaacatgatgtgtgctgctgaccctcgtcatggccggtacctcacggcatctgctatgttccgcgggaaagattaacaccaaggaagtggatgaacagatgcttgacgtgcagaacaagaactcttcctacttcgtagagtggatccccaacaacgtgaagtcgagtgtgtgtgacattccaccaattggcctgaagatgtcctncacattc

SEQ ID NO: 49017 - DNA, 178 bp, Zea mays
  Clone ID: LIB3067-049-Q1-K1-D4
catgccccctgttccatctgtgtgcatggcctgatgctgtactgcacactcggcccacacagcgcaacacaacacagtctgactgctagtgctagatgagccccctgttccatctgtgtgcgactttgtttgtgctgtgtcatctatctatctaactaatccatctatgctatcctct

SEQ ID NO: 49018 - DNA, 451 bp, Zea mays
  Clone ID: LIB3067-049-Q1-K1-D5
ggacccttcaaagggcacagccagcatcagcacggttgctggctcatttggttacattggtgcagagtatgcctacacgatgcaggtgacggtgcccggcaatgtgtacagctacggcgtggtcctgctggagatcctgacatccaagctacccgtggacgacgtgttcggcgagggcgtggacctcgtcaagtgggtgcacaccgcaccagcaaggggtgagacgccagagcagatcatggacccccggctgagcaccgtgtcgttcgcgtggcgcaggcagatgctcgccgtgctcaaggtcgcgatgctgtgcacggagcgcgccccggccaagcgacccaggatgaggaaggtggtggagatgctgcaagaggccaagaacagctgagttgatgtgtttctctgctgaatcctgaatgctgcggttgcctgcttggaagtcgagccg

SEQ ID NO: 49019 - DNA, 449 bp, Zea mays
  unsure at all n locations
  Clone ID: LIB3067-049-Q1-K1-D6
cacaatgatatatgtttattccatcgactggcaaaatattagagagcagaaacttcaatgggccgtcattttgaacggtaccttgttctctcgagcattttaccatctggagacatttgaactagccttatattctacacaatcatacagaatgggtgctacaaaatggtaggcagctgataacactgaaaaggaacaaaatctcaaacgaaagtaatctacagcaataaacactgctactggcagttgctccgtttctgtgaaactcaagcaaagattctcgcaggtcgaacactgacccaatcaaattgggcagtctgattatgtggcaaagctttctgtcgccagcattccccagtcctggaactaataaaactttctcatttacttctggatcaatcattcctgtgtacacgtggagcccaaggaactntgtattgaacttttgc

SEQ ID NO: 49020 - DNA, 452 bp, Zea mays
  Clone ID: LIB3067-049-Q1-K1-D8
catcgatccaccgaggtttcttgtgcgtgccgccatggccatggcagtagctcaccttctgcctcagctctccgccgaaggcaatggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccagctcgccgccgctcgcgcggtcgggcttctacctggcgccgtccgccacgtccagcatggacgcgccgtcgtcggggacatggtccggcacgttgtgggcgcgcacgggctgcgtggccgaccccgccaccgggcgcttctcctgcgccacggccgactgcggcacgggcgacgtcgcgtgccagggccgcgggccggcgccttcggtctcgctcgtcgaggtca

SEQ ID NO: 49021 - DNA, 448 bp, Zea mays
  Clone ID: LIB3067-049-Q1-K1-C10
attacaaagatatcaaggagctcccacctcatcgcttggctgaaatcaggcgcttcttcgaggaggacaataagaatgagaacaaggaggttgctgtgaatgactttctaccagcgagcgccgcttatgaagccatacagcactctatggacctgtatgctacatacatcgttgagggcctgaggaggtaggattctgatggctaggaaaggtggtgaggatgttgacgaaaaactgggagaccatttaccgcatggaacgagtaccgttattattttatttgtgtcgcgtatactgctagtagtgaaccctcaatcaaagaccgaaatcccctgaggagtcggagtcggtagtaggtgaagctagtaacaaggttggcgaaatattattttctggcctgactgcctatatatgttgtacgtgattggtatcgtaatattcattcgct

SEQ ID NO: 49022 - DNA, 370 bp, Zea mays
  Clone ID: LIB3067-049-Q1-K1-A6
gcggttacaaaggtgttgtcgctgtagatactagatcaaatcataagctttctttgagaaggggcatgtcaaagttccagtcagaaaatatcactcttgatgtccttgcatacagcaagtaccaaccatgcttcctgaatcggcagttgattactcttctctcaacacttggggttagcgataatgtctttgagctaaagcagaaggaagccttaaggcagttgaacagaatggtaactgaaccacaggctgctcgtgaagcagttgaacttatgcccatgggagaagtaaccaatgtagttaaagaattgttgtcatgtggctaccagcctgatcatgagccatatctttccatgctgctacaaacttt

SEQ ID NO: 49023 - DNA, 429 bp, Zea mays
  Clone ID: LIB3067-049-Q1-K1-A7
acggacgggccaatttaaagacaaagaaacttgtattagtcaaggtggtgcaacaagttagcgaggatggaaacagaaatgaaggtgttcctgatagtgataaccgttctagcctcagtgttactacagatgaaatcagttattcaacctgctgcgatgcaaatttggcagtggatgaacatttacaatgcaccacgttttccagtgaagaagcgacagcctttctttctcaaagatggaaagaagcaatagccgccgatcacgtgaaacttgttgtgtcctgaaaactaaaggaatggcagaataaagaaattctgttgagggcaacagcatggaagctccggccgacttgtcgccggatcccacagccctacaacataggtggttcttatctagcctgcagggtgctatgaaagtttggatgtcaag

SEQ ID NO: 49024 - DNA, 426 bp, Zea mays
  Clone ID: LIB3067-049-Q1-K1-A9
cccacgcgtccgatagccggccggtgggtcttttaatttcctcctcgtcacatttattcgggagacgacggccagaattagttacctaggcgtgcgtctctgtgctctgctccctgatgctgctgcgtctatctggaaggcgaaggttgatgggtaacatcatcgtgtctctctctcccctctggtgttggaatgtacactagcgtcgttatcatgagatgcaattgtaatctgaggttgatattttctttctttctttctttttccttttcgctttcttcttttcttcaccctttttgtgtaaagattcagcgaatgttactttgtcaaagcatgtataatcaatcatactactaactatggagacatgttcatatgagaaatggcagcagcacatctttgcttatatattcaccatctgttcct

SEQ ID NO: 49025 - DNA, 333 bp, Zea mays
  Clone ID: LIB3067-049-Q1-K1-B1
ccagtacctcccaatttaaagacaaagaaacatgcatcagtcaaggtggtgcaacaagttagccatgatggaaacagaaatgaaggtgttcctgatagtgataaccgttctagcctcagtgttactacagatgaaatcagttattcaacctgctgcgatgcagatttggcagtggatgaacatttacaatgcaccacgttttccagtgaagaagcgacagcctttctttctcaaagatggaaagaagcaatagccgccgatcacgtgaaacttgttgtgtcctgaaaactaaaggaatggcagaataaagaaattctggtgaaggcaacagca

SEQ ID NO: 49026 - DNA, 434 bp, Zea mays
  Clone ID: LIB3067-049-Q1-K1-B10
gtcacgccgccgcagtcccagttcgcttcgtttcacccagagctcgtcggcctccgtccgcgctggaagcgagagcatggacacccaagtgaagcttgctgttgtggtaaaggtgatgggcaggaccggctccaggggtcaggtgacccaggtcagagtgaagttcttggatgaccagaaccgtctcatcatgaggaacgtcaagggccctgttcgtgagggtgacatcctgaccctgctcgagtctgagagggaggccaggaggctgcgctgaagcccttgttgtcttggatgtaattctgttaattttgttcaatgtttgtcgaacttgccgtgtgacccatactatatctgctttgggatttagtaagcctggattgcaagttttttttatgatcctggtggaaattgcaattgtttgtcggcatgttctc

SEQ ID NO: 49027 - DNA, 452 bp, Zea mays
  Clone ID: LIB3067-049-Q1-K1-B2
cgccgtacgaggagcagcggcggaggcaggttgaggcgaacaaacggaagctggaggagctgcggctccaccacctctctgctgccatcagagaggccgccgccgccgccaagccctcgctggtcaagaagcggaaggcgcgggtgcctctcgacgtcgccgacgccgtgatggagccagtacggcggtccggccggctcgccaacctcccggataagcccgtgtaccgcgagaaggttcccgattttgggatgaagattaggaggacgtacggatcggtgagaagagatctgaccaaccgggtgtacgcgaccgacgatgcgaggagctacgccatctctaaagcggaagatctggagcaagaactggacttcagcttccccatcttcatcaagcccatgacccagtcccatgtcaccgggggcttctggctgggccttccgattcatttc

SEQ ID NO: 49028 - DNA, 254 bp, Zea mays
  Clone ID: LIB3067-049-Q1-K1-B3
gagcctgctgccgtcttcttccgccgccgtcttcgtccgtagagcagagcagatcagagagcggggaggaagaaaaaccgatcgatggcgtccaactacgtggacacaacgggcgaggagggacggttccacggccctcacagccacagcaccagcacgaccccgacgggcggcgcggcggcggcggcatcgccgcgcaacttccggcgcagcttctcctccgcgtcctccgcgggccacagccacggcggcgg

SEQ ID NO: 49029 - DNA, 456 bp, Zea mays
  Clone ID: LIB3067-049-Q1-K1-B4
cccacgcgtccgcccacgcgtccgcccacgcgttcgcttgattggtttccttcatgtcaagaggtgcagcaaatgacgcaacaattgggaccaagagagacgctcgcagctactacgagatctggcagacggtcggggtggaccggccgtctcagatactgttcctgacggacgtgtgccaggaagccacggcagcacaggctgcaggccttgaggtgctaatatctatcagacctggaaacgcgccactccctgctgaaacccatgggtttgggacagtcgagtcatttgctgaaatcttgacatgaaaggaggatgcatcctcaacatgcatgcatgcatgctgtgctatttagagatggaaacggattgaactagtttcaaaaggcagatggaatggtttcatggccttgatttgcatcttcatactagctttatttacattgcccatgttca

SEQ ID NO: 49030 - DNA, 454 bp, Zea mays
  Clone ID: LIB3067-049-Q1-K1-B5
gattggtctgattggaacaagtggatcagctttcgtggtgggattggtgtgtcaccagacgggagctgggaatcttggtgggaagtggagcaggatcatctaaaatattcaggaacaataggacgctttgttgagataatcttggctatacgttttttcatataccagtatggccttgtttaccacttacatgtcacacataacaaaagcatctcggtatatttaatttcttggctcgtaattgtggcggttctgctcgttatgaagactgtgtcggtgggaaggcggacattcagtgcagatttccagctattcttccgtctgatcaagtttttgatatttgttgctttcattgctattttgattgtcttgatagtattacttcatatgacctttcgcgatatatttgtgtgctttctagcattcttgcccacaggatgggggatacttctga

SEQ ID NO: 49031 - DNA, 345 bp, Zea mays
  Clone ID: LIB3067-049-Q1-K1-B6
gactgaggacactttcattgctgatctggcttttggtttgtccacgggtcagattaagacgggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagccataatatccaacatgtaacatgttacggacatgtacccaaacgtgatccagttttagtt

SEQ ID NO: 49032 - DNA, 456 bp, Zea mays
  Clone ID: LIB3067-049-Q1-K1-B7
cgctcccgctgatcctactcgggaagtccattaacgcgatgctgtcgactttcctctggggggaccagatcgtgtgggcggggaggacaggaatatacaagaacaaggagcgggcggagttcctcgggaggatagcgttctactgcttcctcggctccaacaccttcacggccatcatcgagctagccgagctgcaacggctgtccacgtcgatgaagaagctggagaaggagctgaagcaccaagagctgtacaagaacgagcagtaccgcatgaagctgcacaaatcgaacgagcggctgctggcgctcgtcaagtcgagcctggacatcgtggtggccgtggggctcctgcagctggccccgaagaaggtgaccccccgcgtcacgggcgcgtttggcttcgccagctccctcatcgcttgctaccagctgcttccaagcccaccagcaaagc

SEQ ID NO: 49033 - DNA, 455 bp, Zea mays
  Clone ID: LIB3067-049-Q1-K1-B8
gaggaagtgggattggcatatgttgcaggttggctagggattgccgccccagctggctggggatatattaggctgtcgccgccaaagaaaggcctgcttcttcacctcgctccagcttcatatatgttttgagcgtgtacagtgcatgtggtttcagaaatggggacgctggcgtgcccatggagatctggccacctctttgctttcatcaccttcgccgtgctgttcttctcgacttcatttgccgggagacagtacagtttcttgatggatcaagatgccctacgtcaacaagaaggagaaggagcacgaactgagcagaaggaagcgctagtgccactggtgcaagctcggcggctcagcgtcaagacgaacgattacagcagctatgacccttccccgtccatggacaagccacactccaagctcataccgaactgatcaatcatgtacgc

SEQ ID NO: 49034 - DNA, 454 bp, Zea mays
  Clone ID: LIB3067-049-Q1-K1-B9
gcaatccaaccgtgttgtgagcatcaccgaccgccacaccgaggaggccagccccgtgcgcaaagtggttgccgagatcattggtgtgcttgggtcaaaacacatgagaactgtcacgccgcttcctgacaccggtcaatggctgcttctatcattgatcgagaagctccctcaaagcgtggttgatctactgagagctcatgttatcaatctccatcattatctgatgttgtttagcttgctgggattttcagttctgttcgactgtatcaaagcacctgactcgaatgctatctgtagaggcataacacaggatatgacatatgctgctgttcaagcttacacagatgcatataagcctgattgggaacgtatcaacttcattgtagacattttgagatcgactcctggagaagggccttcgtggtaccatcttttgaagaaagttagtggc

SEQ ID NO: 49035 - DNA, 455 bp, Zea mays
  Clone ID: LIB3067-049-Q1-K1-C1
acgtgttcgaggcagccatcgagacctcatatctggtgctggagtccgccatggccgagcgcaggaaccacaggcccgtcatgaagaagctgcaagcggaggtacgggcgtacggagcggagaagaagctggacatgatcagggaggacgacctgagcagcctgccgtacctaaaggcgtccatgaaggaggcgctgcggctgcacccaccggggcccctgctgctgccgcactactccaccgccgactgccagatcgacgggtaccacatccccgccaacacgcgcgttctcgtgaacggctgggccatcggcagagacccggcggtctgggagaagcccgaggagttcatgccggagaggttcatgcgcgacggctgggacaagtccaacagctacagcggccaggacttcaggtacctgccgttcgggtctgggcgccggatctgccccggg

SEQ ID NO: 49036 - DNA, 445 bp, Zea mays
  Clone ID: LIB3067-048-Q1-K1-G6
aatggggatgctcagactgttctgattgttaaagatacagaaggatcaatttatggtgggtatgcttcacagccttgggaaaggcacagtgatttttatggtgacatgaagacattccttttcaaatgctatcctcaagcatccattttccgccctactggagcaaacaagaatttgcaatggtgtgctgtaaacttcagctctgagaacataccaaatggtattggatttggagggcagccacatcatttcggactctttttatcagcaaattttgaccaagggcactcatttacgtgtagcacatttaccagccctcccctttccaagacaaataggttcaggccagaagttattgaatgttggggtatacaaatgagaggagcacaagatgaaaaactggagttagtcaaggggacagtcctcgagagattcaaggaggacc

SEQ ID NO: 49037 - DNA, 443 bp, Zea mays
  Clone ID: LIB3067-048-Q1-K1-G7
cctgaaccgcgccatcggcgccgacgtcttcgtcaccgccaacacctaccgcatgaacggcgactacctcgcaaacccgcaggacttcgggttcacgaacgtgcaggtggcgtgctgcggccagggcccgtacaacgggatcgggcagtgcacggcggcgtcgaacgtgtgcgacaaccgcgacgtgttcgcgttctgggacgcgttccaccccacggagagggcaaaccgcatcatcgtcgcccagttcatgcacggcgacaccgactacatgcaccccatgaacctcagcaccatcctcgccatggaccaggagggcctctagactatagctcgatcagccggacacgattatacgtacatgcgtgatgtgtctcacgtgcctagcacgttagtcatgtgttggatgatggcagcccaatttgccaataatattcgtgcct

SEQ ID NO: 49038 - DNA, 446 bp, Zea mays
  unsure at all n locations
  Clone ID: LIB3067-048-Q1-K1-G8
gagcacgatggccctcgcgctcgccacgaccccactcgcgcatctcgcccttgccccgggctcgatcttcggctcccaatcctcgctgctgctgctcccgcgccgcgcgtcgcccgcccccgtctccctctctcaccgccgcatcatcgcggccgtcgcgaccaaggaacccgagctcggcggcggcggatcgggggccggcgacggtgccggagggagcggcggcggcagcgacccgaggggaggagggcaggaaggagactgggaggaagagaagatggggcagggcctgtccatgtcgcagaaactcaccctcgcctacgccgcgctcgtcggagctggtggtgtaatgggatatatgaagagtggaagccagaaatccttggctgcaggaggcatatcagccctggtcctgtacgtcgtccacactcaactnccagtgagac

SEQ ID NO: 49039 - DNA, 325 bp, Zea mays
  Clone ID: LIB3067-048-Q1-K1-H1
atttatgcccacacattctcaatctcatcttacattttctctccttatagctacaggaaagtcaggtcataaagcttatcctattccaacaactttcattaactatctgcattaacaaagcatgactccttacatcaacctttaccactatgatcaccctcttgcgctagataagaaatatgcacggattgtaacaccataaatcgctgacttgttaacagactatcctgacttctaaactaacacctaccaacaacgctttaagaactcgattacatgaactgagccaacgatagtatctctactcccttattacacatgtcta

SEQ ID NO: 49040 - DNA, 168 bp, Zea mays
  Clone ID: LIB3067-048-Q1-K1-H11
ctcacggcagtgattcgcggcggtgtagctcaaactaccctcggaggtccgaccgtcgtcgtgaccatggtagtggtggttcgtcaagaccctcgtcaagagggcagccccagaggggagtttgtaaatactacgagaatggccactgctggaagggctccaaatgcc

SEQ ID NO: 49041 - DNA, 452 bp, Zea mays
  Clone ID: LIB3067-048-Q1-K1-H12
actagttctagatcgccctcgttgtcggcagctcggccgccgtactcccgctaccgagctaggaggcatcaccttcgccggtccaacatgggtaagacacgtggtatgggagctgggcgcaagctcaagacccacagaaggaaccagaggtgggctgacaaagcctacaagaagagccatctcggcaacgagtggaagaaaccatttgctgggtcatctcacgcaaagggaatcgtccttgagaagatcggcattgaggctaagcagcctaactctgctatccgtaagtgcgctcgtgtccagctggtgaagaacgggaagaagattgctgcctttgtgccaaacgatggttgcttgaactacatcgaggagaacgatgaagtgctgattgctggattcggtcgtaagggccatgctgtgggagatattcccggcgtccgtttcaaggtcgt

SEQ ID NO: 49042 - DNA, 171 bp, Zea mays
  Clone ID: LIB3067-048-Q1-K1-H2
actatgcaagggcttacgatcccacacctatgaaagtgtgaagacagggtcggaataatggcacccgaggagtttgccgagatcgcctgccacaccaacgactagttctactcccgcatggccaaagccaatgaacaaggcaagctggcagtcatcgacttcaaggccccc

SEQ ID NO: 49043 - DNA, 108 bp, Zea mays
  Clone ID: LIB3067-048-Q1-K1-H3
accacgcgtccgcccagaaatgccttggattgactttcgaggaccgctccgatcgaatgctctgggtgtaatctaaccaagagttgtgtaacatgatcaaaactatct

SEQ ID NO: 49044 - DNA, 175 bp, Zea mays
  Clone ID: LIB3067-048-Q1-K1-H4
gcacctcggctacattcttttcgcctataccggcactcttgggtgcgtgtgcttcatactcacccgggccagagcaggtcacgccccaacacgacgcaccaccggcggtgccaaacctctaggactgcatcgccacaccacgcacgcccagtctggcgcccgacacccgcatgct

SEQ ID NO: 49045 - DNA, 387 bp, Zea mays
  Clone ID: LIB3067-048-Q1-K1-H6
gagctctgacaccatcgacaacgtgaaggctaagatccaggacaaggaggggattccccgagaccagcagcgtctgatcttcgccggcaagcagctggaggatggtcgcacccttgcagactacaatatccagaaggagagcaccctccacctggtgctccgtcttcgcggtggttattaagccatcagtcgttgaagctgctgctgtatctgggttatctagtgtctctgccattgcccatggatggtgctgtctttcaaagtatttgtatggtttgtgtcgtgagtcgtgactgagctggtttcatggaccagttgtgttctcgttacccaaaactatcgtgcgaccgcatatggcttaatcatgaaataatgttgtttgaattt

SEQ ID NO: 49046 - DNA, 263 bp, Zea mays
  Clone ID: LIB3067-048-Q1-K1-H7
aagacacgtccacatgtccgccattcatttttatcatcagatgactgagagaaagatacgtgaacattaaaattcaatttgctaactctctctgcatatacaccctcagactctgtactcatgtacatctctctacatgctcgttcatcaatacaacttcattatctactaccataattacattgatatactataatcatatatcatacaatatatatctactaaaacatgaattactattattaaaatacacaataacatat

SEQ ID NO: 49047 - DNA, 95 bp, Zea mays
  Clone ID: LIB3067-048-Q1-K1-H8
cccacgcgtccggcttccctgatactcctgtttaaagatttgtggattgggtgagacaagggtgattgagataactaagttctggggtcttgatc

SEQ ID NO: 49048 - DNA, 452 bp, Zea mays
  Clone ID: LIB3067-048-Q1-K1-H9
gtcagtcacagctcacagcaaacaccgcgaagccgcccccgctcccaaacccgaccgagcaaagcgcaaagccccccaaccgcggatcaatccgcagcatcgatggcgcccaaggcggagaaaaagccggcggcgaagaagcccgcggaggaggagcccgcgaccgagaaggcggagaaggctccggcagggaagaagccgaaggcggagaaacgcctccccgcgggcaagtccggtgccggcgagggcaagaagggcaagaagaaagccaagaagagcgtggagacctacaagatctacatcttcaaggtgctcaagcaggtgcaccccgacatcggcatctcgtccaaggccatgtccatcatgaattccttcatcaacgacatcttcgagaagctcgccgcggaggccgccaagctcgcccgctacaacaagaagcccaccatcacctc

SEQ ID NO: 49049 - DNA, 443 bp, Zea mays
  Clone ID: LIB3067-049-Q1-K1-A10
gagctatggcgatggctcgtcgcggctctggtaggggccattgttggtcctcatgtactcggtcgtgatgctggttgattcaatgatgagtgcggttttctacttcacttgccggtcatcaaacttggacttcttggacgagcagggtggctcggttgaggagcttgagatgatgagggctggcagtttagatgcatttaggtgatgaagaagattggtttatttctcacgtgtgtatctgttcatagcatcataggagaataagtgagatggccatttgtcaagagccgcacagattgacaagtccttattggtggttacaagccatggtggcttatgtgtatgcatgggttgattagctgaagttggtgttgaaaggaacattttttgcagccatttggtatatccatgcttagtcaatagcggatttggatgggaaggct

SEQ ID NO: 49050 - DNA, 442 bp, Zea mays
  unsure at all n locations
  Clone ID: LIB3067-048-Q1-K1-G5
cccacgcgtccgagcccacggcgggggcgccttctccggcaaggaccccaccaaggtgggccgcagcggggcctacgtcgccaggcaggccgccaagagcatcgtggccagcggcctcgcccgccgctgcctcgtgcaggtgtcctacgccatcggcgtgccggagcccctgtccgtgttcgtcgactcctacggcaccgggaccatccccgacaaggagatcctaaagatcgtcaaggagaacttcgacttcaggccagggatggtcaccatcaacctcgacctcaagaagggcggcaacaggttcatcaagaccgccgcatacggccactttggccgtgacgacgccgacttcacctgggaggtggtcaagcccctaaagaaggcatccgcttaagaatgtattgggaagttcactggacatgangttcatcttcgtctg

SEQ ID NO: 49051 - DNA, 455 bp, Zea mays
  Clone ID: LIB3067-049-Q1-K1-A2
cccacgcgtccgcggacgcgtgggcggacgcttgtgcggcaccttcgtgctcgtctacaccggctgcttcgtcaccgaccccaagcgcaacgcccgcgactcccacgtcccggttctggctcccctccccatcggcttcgccgtgttcatggtgcacctggccaccatccccgtcaccggcaccggcatcaacccggccaggagccctgggcgccgccgtcatctacaacaaggacaagccctgggacgaccactggatcttctgggtgggccccctcgtgggccctggcatcggggccttctaccaccaggtcatcctccgggctggcgccatcaaagccctcggctccttcaagagcaacgcgtgatgagcggggcttggctgtggagcaatggcgggcgacctacgggcggggggccgtgagcgaagagaatgccatcattcatcgatcgac

SEQ ID NO: 49052 - DNA, 397 bp, Zea mays
  unsure at all n locations
  Clone ID: LIB3067-049-Q1-K1-A4
cacgcgtncgattaaccctcgtgcctgtcgcgcagccacgacctccacttcacatctcccccggcggcggcgcggtcagttgaacaatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaagtgaaagacccaaacaccatttttggcttcaaggtccggaaccactttggaagaaggaaggccactggtttcgggcttatctaccacaaccttgaagctggcaagaagttcgagccgaaataccggcttatcaagaatggtcttgctac

SEQ ID NO: 49053 - DNA, 408 bp, Zea mays
  unsure at all n locations
  Clone ID: LIB3067-048-Q1-K1-E9
ccagtcaccaccactgccgcgaccgagagagtcagagagagcaggcggcggcagtggctggcgctggggacgagtactactacggcgggccgggccagcgcggcgcgccccacggcctgctgctggcggtggtggtgggcctcgtggtggcgggcccgctgttcctgggcggcggcggcgaggcgctgacggaagccgtggcggagctgctgagcccggtggggctcctcctcctccccgtgtgcctgctgttcctcatccgcctcctctcgtccgaccgcggcgccgcggcgctcgccgacgccttcgccttcggcgggtcccccgacgccgtccaccgcgtgggagggtccccggtcggcgtcgcgttcttgctcctnctcatcctcgcgctgctctactaccgat

SEQ ID NO: 49054 - DNA, 384 bp, Zea mays
  Clone ID: LIB3067-048-Q1-K1-F1
aaaaaacatactaacacttcaacaaacacatttaaactttaaaaaacaaaaaatctacaaagtgagaggcgtcaataaactaaaccaaaaacaccagctatcaaatacactatcaatctcccagattgtccatactctctccttcattttcaactaagaaaacctgcttattccatataaattttctgctcgtattgtatcccagtctatccgttacctgagtcctgacattctggatttttacacttgcacagtgcattattgattttagaccatgttgacttgaacttttgttaatagggtatatttacacccttatgcaactgaactttgtgctcaagatactgcctctcatctgctccttttcttcatctacaacgcact

SEQ ID NO: 49055 - DNA, 443 bp, Zea mays
  Clone ID: LIB3067-048-Q1-K1-F11
cggacgcgtgggtgacaatccccaagggaaccttgttccccatgtgcggcatgaaccttgccttcgacagggatctcattggccctgccatgtacttcggtctcatgggtgatggccagcccattggtcgctacgacgacatgtgggccggatggtgtgtgaaggtgtgtggtctcgctgttcttgcttccacagctagttacttcttacccaaaacataatgtccactggactgatgatgattttacaactgaaacaaaataacttaggtcatctgcgaccacttgagcctgggagtcaagactggcttgccatacatctggcacagcaaggctagcaaccccttcgttaacttgaagaaggaattcaagggcatcttctggcaggaggacatcatccccttcttccagaacgtgaccattcccaaggattgcgacaccgtc

SEQ ID NO: 49056 - DNA, 62 bp, Zea mays
  Clone ID: LIB3067-048-Q1-K1-F12
cccacgcgtccgcccacgcgtcctcccactcgtccgcccacgcgtccggttctagatcggga

SEQ ID NO: 49057 - DNA, 433 bp, Zea mays
  Clone ID: LIB3067-048-Q1-K1-F4
cgacgcgcctgcatccacctccaagtccaacccacacagagatgccgcgagttctgtcggtcgtagcaggctgattcaagcaccggccgatccagccggccagtttccttccataccgagctccatggagtaccacgagagcagcagccaaggtccgccgcagccggagctgttcagcatgcccggcgtggagagctcgggcctgcgttgtgcggtgctggggcaggcgctgtacggtgtctgtgttccgaaggacgtagaagacggctgggacctcgcgccgccttccgcgtcgtcggatgcgttgtggggtgctgctgctgctgccgcgccgcctcgccgtggtagcttccgtccgatgagatgtgtacggcgctcgagattgtgatattgtgcgtgcgttttagtttaaaaattaaggtgagcaacaaat

SEQ ID NO: 49058 - DNA, 412 bp, Zea mays
  Clone ID: LIB3067-048-Q1-K1-F5
gacaaagatggttaccactggctgactggaagagtagatgatgtcatcaatgtcagtgggcaccgaatcggcacagcagaggttgagtcagctttagtgtcacatccacagtgtgcagaggctgctgttgttggtgttgagcatgaggtcaaaggtcaaggaatttatgcttttgtaactttggtggatggtgttccgtatagtgaggaactacgaaaaagcctcataatgacagtgcgcaaccagattggggcatttgcagctcctgacaagatccactgggcaccgggacttcctaaaacccggagtggcaagatcatgcgaaggattttgcgcaagattgctgcacggcaactggatgaacttggggacataagcaccctcgctgaacctgctgtagttgaccagctta

SEQ ID NO: 49059 - DNA, 445 bp, Zea mays
  Clone ID: LIB3067-048-Q1-K1-F6
attttgtgcagctgaggcatgtgaagaattcagtggaaccttggttaccctaagaatgggtcttgatgatctgtgtggcctgactggcgaaaatgtgggtcccttacctggttatattgaagatgctgttaaagctgcatataatcgctacatgacatatctggagtcctttggccctgaggaaaattatctaagaaagaaggtggagactgagttgggcacaaaaatgatacacctcaaaatgagatgcagtggcataggttccgagtggggaaagatctccctgattggcacctcggggatctcaggctcctatgttgagctaagggcatgatgtgaagcctgcagatcagaaccatggaaattatcgatgagctgaggaagtctgtagatcagaatatgccgttctacattttcctttcccctttgtagctaccatggcaat

SEQ ID NO: 49060 - DNA, 277 bp, Zea mays
  Clone ID: LIB3067-048-Q1-K1-F7
tcccacgcgtccgaaaaaaaaaaaataaaatttataaaaaaaaaaaaaaaaaaaaaaaaaaaagaaaaaattataaaaaatataaaaaatatataaaaaataaaaatctgtcgtactctcttcttgttccatttttactttccttttcttgcacctaattactttttatttactgtcacttaaattcatttcattgtccatatttttacaacttttcaaacttgaaaaacttttcgctttttccatctttttcaatttgctgtacttcccttttttt

SEQ ID NO: 49061 - DNA, 421 bp, Zea mays
  Clone ID: LIB3067-048-Q1-K1-F9
cacgcctgctccgacgcgtgggcggacagcgtctttcaacttcggcaagtgcaactgccgctccagctgcgcctgcttcagctcatgcaactgcatgtcccctgacgtggagaccgccgtcgccagcagcatcaagaccatggtcctcgctgcgccgaccaccaatgccagcgccagcggcttcgaggcggccaccgagggcggcggctgcgactgcaacacctgcaactgctgcaccagctgcggctgctcctgctgcagctgcaactgagccggtccgtccggcccggcgattgcgcacgagagtcgagaggacgaccacgactaagcgtataaatataattaatagccacgtctaaattagatcccggcaactgcaccccccattatcgatccatggtccctcctggggttcatgttc

SEQ ID NO: 49062 - DNA, 390 bp, Zea mays
  Clone ID: LIB3067-048-Q1-K1-G1
attttgttcactaacatttccgccggcaactgaactctgttctccttagatatgcttgtttggtggctgaagaagctgaggcagccgaccagctgtcaaaggcactaacatttcccagattgtccaagttctataattcattaggaagaaagaaaacctgcatcttccagctgtatttgctgctcgtattgcagcacaatcaaaccgtaatctgagacgtgtgatactgttttttcagacttgcaaagtgcaacagtaatctgagacgatgaggacttgaacttgggtggtttgggtatattcacacccttaaccaactgaactaggagcacaagatacgccttggatcaaaagctatttttcatctagaaggcactgcttccaggtcgg

SEQ ID NO: 49063 - DNA, 450 bp, Zea mays
  Clone ID: LIB3067-048-Q1-K1-G10
agcccaacgagaagagcggcggttcgggctgacaaggagcaggcggaggaggagctgtggcaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacatacccttgtgaagagtgccattgtgcaagttgatgctgccccattcaagcagtggtacctcactcactatggagttgacattggtaggaagaagaaa

SEQ ID NO: 49064 - DNA, 446 bp, Zea mays
  Clone ID: LIB3067-048-Q1-K1-G12
gctgtatcagctgcgggaggtgttggacatgaagcccgagacctttgccagcgttgtcgctgcgctcctctacgagaagagattcgggccatatttttgccagccagtcattgctggacttggagatgacaacgtaccatttatttgtactatggactgcttaggtgcaaaggagctggccaaggattttgttgtatctgggacagcatcagaatctttgtatggtgcttgtgagtccatgtacaagccgaacatggaacctgatgaactcttcgaaactgtatcccaagctctgaattcatcaatagaccgtgactgccttagtgggtggggtggctatgttctgattgtgacaccgactgaagtgagggagcatgtgattaagagcaggatggactaaatcatggccactatcactataattcttagctggtttccaatgctta

SEQ ID NO: 49065 - DNA, 323 bp, Zea mays
  Clone ID: LIB3067-048-Q1-K1-G2
taaaaaaaaaaaaaaaaacaaacacaaacattaaaaatttaaaaacaaaaaaaaacaaaaaataaaaagtaaaaatttcaaaacttaataaaaccacaccccaaccccattaacacatcaaaacatctcttcccaaatactatcctcaaacatccattaaaacccctactctaccaatcaatcatcttcacttttaaactcttaactatacctctaacaacataccaaattacattatatatataattcaaacacatcatttctcactctttatatcatcacattatcaccaactacactcatttacctataacacaattacc

SEQ ID NO: 49066 - DNA, 462 bp, Zea mays
  Clone ID: LIB3067-048-Q1-K1-G3
gacccacgcgtcacgcggggctccgcgccttcgagcccacggcattggcttcttctccggcaaggaccccaccagggtggggccgattgagccctacgtcgccaggcacgccgacaagagcatcgtggccagcggcctcgcccgccgctgcctcgagcaggagtcctacgccatctgcgtgccggagcccctgtccgtgttcgtcgactcctacggcaccgggaccatccccgacaaggagatcctaaagatcgtcaaggagaacttcgacttcaggccagggatggtcaccatcaacctcgacctcaagaagggcggcaacaggttcatcaagaccgccgcatacggccactttggccgtgacgacgccgacttcacctgtgaggtggtcaagcccctaaagaaagcatccgcttaagaatgtattgagaagttcactggacatgaggatcatcttcctct

SEQ ID NO: 49067 - DNA, 295 bp, Zea mays
  Clone ID: LIB3067-048-Q1-K1-C5
caaagacttacgctgtcagtactttggatttcaatccttgcaagtactctacgggatgtgttaactaatatctcttttcacgcacagattccacatatcattacaaacttcatactactaagaaggttaatgcatttcacaccgactatatggttactccattacatcggtacatcaatgatccaaatgcacatgcaatcattaataatcaagctaccttacacattactgcgataacgaacaactcatattttgacccatcacattatgcactacattgtcactataaacatcc

SEQ ID NO: 49068 - DNA, 286 bp, Zea mays
  Clone ID: LIB3067-048-Q1-K1-C7
attacctcggagacatcggtcgagctcaagattctatctgataaatggcggctgctcctggctggcctcattttccagtacatacatggtttggccgctcatggggttcattatctgcaccggccgggccctacccttcaagatcttggcttcatgattcttccggagcttgggaaagaaaggggttacatcagtgagacattgtttacattcgtcttcctcaccttcgtttagtctgaaggatgaaaggatgaaatgtccacaaaacactagttctagatcgcga

SEQ ID NO: 49069 - DNA, 395 bp, Zea mays
  Clone ID: LIB3067-048-Q1-K1-C8
ggtgggttggcttctcctccccctccggttcgggttcgggttcgtgaggttctgcggggggcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggc

SEQ ID NO: 49070 - DNA, 434 bp, Zea mays
  Clone ID: LIB3067-048-Q1-K1-C9
gcacaagcgcactctagcaatggcttctgaggttgtccgccctagcgacgccgagctacgaaaggcacaagccgacatatggcggctcagcctctcctacctcacgcccctgtcactgaggtgcgccgtggagcttggcatccctacggcgatctaccgccatggcggggctgcctcagccgctgagctggtcacggcgctgtctctcccctccactaagctgccgttcctccgccgcctgctgcggctcctcgccgcgtcaggcgtgttcaccgtcgacaagcagagctcggaggaggagcggtaccgcatcagccccgtgtcctacctcctggtggacggcatccctcacgaggaccacatgaaccacaccgctctggtgctcacctgcacctcgacgcgctacattcgaggcgggatagggcttgcggaat

SEQ ID NO: 49071 - DNA, 387 bp, Zea mays
  Clone ID: LIB3067-048-Q1-K1-D1
cccacgcgtccgcccacgcgtccgctctcttcttctcttgcgaagtcgccaaggccagtggccaatccccatccagccagaccgccggcgatgacggaccaccgcgacgtgatgttgcccttgtccctccaatacatagccacccgtgccctcctcctgctcgtcatcgcgtccgccgtttcctgctcttccttgccgccggaggacggcatccgggtcgtctctgcagagaaaagaatcgacctcacgggtcccatcgtcaaagtcttcctaacattgaaggttgagaatgctcccacggcctctgaagcatcacgagttctcctcgccttcacgcccacagagtttcaacatctctctattgtcaaggccacaagagcggaaggg

SEQ ID NO: 49072 - DNA, 271 bp, Zea mays
  Clone ID: LIB3067-048-Q1-K1-D10
cattccttccccaactctgcaggctgctcgtcgccctccctccacgccggacgcgcccgggtccagatccaggggcgtaacatggcatcaaaacgtatcctcaaggaattaaaggacctgcaaaaggaccctccaacgtcatgcagtgctggtcctgctggtgaggatatgttccactggcaggcaaccatcatgggtcctcctgatagtccatatgctggaggtgtcttcttagtgaacattcatttccacccggactaccctttcaaag

SEQ ID NO: 49073 - DNA, 446 bp, Zea mays
  Clone ID: LIB3067-048-Q1-K1-D11
ggagtgcctctgaaaagaaagctaagggaatttcctgtcactgaggatgcgctggttcgtgttggcacaagcatcacagttcgtcactttgttcctggacaatttgttgatgtcactggaatcacgaaggggaaaggttttgcaggtgtaatgaaaagatatggtttcggtgggatgcctgcatcacatggaacatctttggcgcatcgcagtggtggctctactggtcaaagagatgctcctggaagggttttcaaaaacagaaaaatgcctggacgcatgggtggtgtgcaacgcacagtgaagaatgtatgggtctatcaaatagacccagccaggaacttactgtatctgaagggccaggttcctggtcctcaaggtagctttgttttcgttaaggattctatatataagaaacctgacacggctatgctcccatttcctac

SEQ ID NO: 49074 - DNA, 447 bp, Zea mays
  Clone ID: LIB3067-048-Q1-K1-D12
gattatcagcacaagtcacattgccaatcataatggaagctagattatcagcactggctggatggtttgatgttcattttcgaggtagtgctcaaaaccctggggtggaggaagttgaattaactacagcgccagatgagcatggtggaactcattggggtcagcaggtattcttgctgactccacctctgagtgtgactaaaggagacaacgttaacgtttccttctcgatggttcgctcgaaggaaaaccatcggcttatggatatggagttcacatatgaattgcacgagttatctggcaagaagcacccagcagtcaaaaccaagatgtacttagagtagaacaagatggaaagacggaacctcacgacgccgttgctgaaacctttgctcagaagctgagcatgtagtgtgcttgttacacccatgatgggtacattgagac

SEQ ID NO: 49075 - DNA, 412 bp, Zea mays
  unsure at all n locations
  Clone ID: LIB3067-048-Q1-K1-D3
cccacgcgtccgagcaaaccaaaaaagaaagagagggggagagacacagaggcctcactccacacgctgtcttgtctctcagtcccagagctttcttggatcgcgaggaatccactggaaattttgcaattgtagtagagaactgtatcgtccgacgaaggtgcatggtgttggccatgggtcacggcagggaacagagacgagcaggtcggcgctctccccccagctcattgatcctgtcctcgctataaggtagtcctgcggtggcctccgaatttcactcgatcgaacacgacatgaagcggccacgcggcgccagcccccctctggctgcgatgaccaatccgaacgatgatggttacggcgtggtcgggatggaagcngacgcggacgcggacgcggacgatgagat

SEQ ID NO: 49076 - DNA, 160 bp, Zea mays
  Clone ID: LIB3067-048-Q1-K1-D7
gaattacccgggctcgactccacgtcgtctcgaaagaaacaaaaaacaaaaataaaaaaataaaatataaaaacaaaaaaaaaaagaaaaaaagaggaaaaaggtaaaaataataaaaaaaaataaaaaaatcaaaaataaaagtggcgcgccgttttaa

SEQ ID NO: 49077 - DNA, 395 bp, Zea mays
  Clone ID: LIB3067-048-Q1-K1-E1
cccacgcgttcgcccacgcgtccgcatcacatcaattgttctaccgtgattcgcagctgggtcttggtcatgtgcggtgggtttcttttccggacgttcatattcaggccgcttgtttcgtgccgacgccgggtccagctccggcaccgtccggctcctccgcgacgaacacgaacgactcctccgctgctcctcggccagccaagcccagcgcattcccacccccaatgtacggtggtgtcacccccggcagtctccagccacacgagtgcggcggccggtgcgcggggcggtgctcggcgacggcgtaccagaagccgtgcctcttcttctgccgcaagtgctgcgcggcgtgcctgtgcgtgccggcgggcacctacggcaacaagaacacc

SEQ ID NO: 49078 - DNA, 389 bp, Zea mays
  unsure at all n locations
  Clone ID: LIB3067-048-Q1-K1-E10
atccaggtccggaggcgttggcaccttgttgagctccaacgccatgggtggtgagggccggcaggcccattcagctggctgtggctccggctgtggtggtggctgcggcagcggcatgctcatcgaaggctccaaggccaacaacgccatgtccggtggctgtggctctggttgcggtggtggatgcggcagcgagcttcttgacgcccaccgcatcctcgccgccgtccagaacgcgcagcgcagcgccaagcgccgcggcgcggggcccgcgaggcccgtcattgccgtcaccccgaccaccaccttcgcgctccaggtgccatccctgacgtctctggcgcacacncttcgnctcgtcgacgcccagctcgtgtggatcgtcgtcg

SEQ ID NO: 49079 - DNA, 110 bp, Zea mays
  Clone ID: LIB3067-048-Q1-K1-E11
cccacgcgtgcgcccacgcgtccgaccacacgtcctgccacttgtccgctgcttcaaaaaaaaaaggctgtagtcaacttcaactaatacaactacaataaacccctaac

SEQ ID NO: 49080 - DNA, 380 bp, Zea mays
  Clone ID: LIB3067-048-Q1-K1-E12
atttggatttacgtctcgctagataccaatggcttctattggaccctgtagcggattgccgtaatgtctgaggctaatgaagataaaacatctggagacttcaaagaaatgggtagcatgttggccgacgaggtaattgccttcctgaagaagaaaatggataagctttctagatatggaggctgcaaagagctgaagttaagcatcgtcatccattccattgtgaacatcatcattagaagtgccctggcagaacctgcatcgcagctcatacttgaagaacctgtacacttacatgtcaatatcagggcctaacttgagttactgctacaggccatagttgatgggcaattctggacttctggtgctgaaatagctca

SEQ ID NO: 49081 - DNA, 161 bp, Zea mays
  Clone ID: LIB3067-048-Q1-K1-E3
atcaaattatgcccacctcctctttgtatgttgaggctccatgtgcgagcacgctgtctgtcgtgacacctggttcgtcagatgttttgtcaaacttgcttggcttgattggttgtacttgtacctgtaagagctgatagttatatgaatggcttggactg

SEQ ID NO: 49082 - DNA, 440 bp, Zea mays
  unsure at all n locations
  Clone ID: LIB3067-048-Q1-K1-E4
aaatgtatcaaaattaaatctggaccttataaaggatatcgtggccgtgttaaagaggtgactggtgcacttgtacgtgtagagcttgattcattgatgaagattgtcacagttaaaagagacgatatcgctgacacacctactgttgcaacaccattccgtgaacctcgttattcattgggtggtgaaactccaatgcacccgtctcgaacaccacatcatgcttatcagactccaatgcgggaccctggagcaacaccaatacatgaagggatgcggactcccatgcgaagtcgagcctgggctcctatgagccctccgagggataattgggaagatggaaatcctgctacttggggtagcagtccagcttaccagccaggaaccccacaagctcggncatacgaagcccccacaacctgatcanggtgggcaaacac

SEQ ID NO: 49083 - DNA, 132 bp, Zea mays
  Clone ID: LIB3067-048-Q1-K1-E5
tccggatactccctaagcaccagctgcggcgtgcggtttatccatggctgtccgtaaagcaacaatgaggatgggtccaatgtgaaacgaatggtggctaagaataaagacccgtcgactcctgttctctaa

SEQ ID NO: 49084 - DNA, 443 bp, Zea mays
  Clone ID: LIB3067-048-Q1-K1-C4
ctcaccattgccgacgcaagctgcgactgaacctccgtggcgacggaggagacggccatggtggcggcgatggagctcgagatcctaggcatgaatttcgggtgcgtcctcgcggctctgtccgacgccaagatccccgacaagggctgcctgctcccgctcatctctaagctgctcggctacgccatcgtcgccgcatccaccaccgtgaagcttccccagatactgaaaattttgaagcatggaagtgttagaggactaagtgtggcatcctttgaacttgaggttgtcggctacacaattgctttggcatattgtattcataaaggacttcccttttcagcttatggggagctagcttttctgttaatccaagcaattattttggttgcaatcatttactattactcaccaccaatgggaaccaaaacatggatgaaagc

SEQ ID NO: 49085 - DNA, 243 bp, Zea mays
  Clone ID: LIB3067-048-Q1-K1-E6
cccacgcgtacgcccacgcgtccgcccactcgtccgatggcttactaaaaaaagaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaagagagaataacatactaacatactcaaaaaaaaaacaaatatactaataaaaaaataat

SEQ ID NO: 49086 - DNA, 463 bp, Zea mays
  Clone ID: LIB3067-052-Q1-K1-A9
gaaaatgggactcacgctactcctgttcagccaaggcagccaagctatatggctgcaacggagtccgcaaaggcgaaattgcgagcccagaattcacccagtctggattctgattcagcggcagaaaagaatggtttcacccgacgccactctcttccttccagtacaaagagtagagcacttaaagctgaatggaagcgctgaagaggcaacccatcgtccacttgaattgaattgtgcactgctctgaaacttcgctggatgaactcgaccggtcttgtcccatgttcttgctgtattgaacaaccccttgtgaagttgcgattctggttcagtttgtcgtaggttcatgtgcaaccactagtgccttgtgtcgtatattgcatggttcttgtcgaaggaacaatgcctgcgaaagctgatgttaggactgcattaactgaataacatcacccagttgccc

SEQ ID NO: 49087 - DNA, 230 bp, Zea mays
  Clone ID: LIB3067-052-Q1-K1-B1
taccggttcggactgacccacgcgtccgcaagcccctgtacgacaccatggcgggtctggaggaaggggagaagagcgttgtcaagtgacacatgttggacctcagatcagatgaaacggtcttttctagtctctcgtgttcactacgaatgtgcaatagtgcaacatgtcgcgaggtgatgaattccacaaagacgaggtgacggagcagggcattcaaaagcccgcag

SEQ ID NO: 49088 - DNA, 436 bp, Zea mays
  Clone ID: LIB3067-052-Q1-K1-B10
gttctgcgacggcaagtgcgcggtgaggtgctccaaggcgagccggcacgacgactgcctcaagtactgcgggatctgctgcgccacctgcaactgcgtgccgtccgggaccgcgggcaacaaggacgagtgcccatgctaccgcgacatgaccaccggacacggcaaccgcaccaggcccaagtgcccctgatgatattcattccttcgctccctccggggagccagctgtcttgcatgcgtatatgtaatgtatgtataggctgtgcaatgcatgcatacatgatacatgccgtgactctggatcggcggatgcctatgcatgcttttcactagctattattactactactactactcttcctgtcttcctactgtgtgcaccagagtgagagggacgacatgcatggcgatgacatgtcgtgttatgtgcact

SEQ ID NO: 49089 - DNA, 614 bp, Zea mays
  Clone ID: LIB3067-052-Q1-K1-B11
cccacgcgtccgatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgct

SEQ ID NO: 49090 - DNA, 602 bp, Zea mays
  Clone ID: LIB3067-052-Q1-K1-B12
gcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgcccgccgttctgttgtactccgtctgtggttaggttagtagttttcttgatctcgcccccacgcggtacctgttttactactctctgtttggtggtttctgaggcaagttgcccgtgtacttgtatcgtaaaaaccgagtgggacatctgcatcgtttcatctgccaccactcccccgaggtgtgctgtttcacggcttaaagaaagatgtcgtatcggc

SEQ ID NO: 49091 - DNA, 345 bp, Zea mays
  Clone ID: LIB3067-052-Q1-K1-B2
gtgttgatgtgtgcgatatggagtaaaatccctggagaattaggtggaggagaaggttgggttcaacgctccttaggtgttctatgaagtgcttgaactgaagttcgttgtcgttctgttcaccgcggttcgttaattgatcacgtgatgcggacgacaagagccgagttgatcccaaaatgatgctggtgaacgaacctgaagcttggatgatctggtcaagtaccaggatgagagatgctccccaagcggacatcatctaacaacactgacttagtgttatctcagacaagccccggtgcatttgccaccttcttctgttttaaaaacttttattacttacct

SEQ ID NO: 49092 - DNA, 347 bp, Zea mays
  Clone ID: LIB3067-052-Q1-K1-B3
cggacgcgtgggcaaaaaatgtgattatttgttataatggtctctgttcttaaggcgtggcctaggcgtcgcctaggcgacgcctaggcgtccgggcggtggtctaacgcctaggcgccttgcccgcctacctcgcctaggcgtccaggcggtggtccaacgccttggaccgccttaccgctttaaaaaccatgataatggtaaacgtaagttttgtgctatgagcctatagcttctcccctatcgtgggcagtcgtgtcaggatacttggtttctgtgaaacattcaggctgtcattatgtctggtctgtagaatgtgctagtgtgaatgttctgctatttcaata

SEQ ID NO: 49093 - DNA, 296 bp, Zea mays
  Clone ID: LIB3067-052-Q1-K1-B4
cccacgcgtccgcccacgcgtccggagatggactcccccaagatctctgaaaatgaaggtgttgggcatctgatcacaccccaggaagcctgcaaccgcatagcagaggtagtccaagaggccgtgagaaagatggagctcgtggctgaagaaaagatgcgactttacaagaaggctcgcctcgccgtggaggcctgcgaccgagagctggaggagaaggttagggaagcccaggagctgaaggcagagcgtcagcgcaagaagcagcaagtggaggagctggagagcatcgtgcg

SEQ ID NO: 49094 - DNA, 299 bp, Zea mays
  Clone ID: LIB3067-052-Q1-K1-B5
cggacgcgtgggcggacgcgtgggttctcctccccctcttaccaagtcctgctcaggtggagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtgttgcggcttcggcttcgttaccttctcctccgagaactccatgctcgacgctttcgagaacatgaac

SEQ ID NO: 49095 - DNA, 320 bp, Zea mays
  unsure at all n locations
  Clone ID: LIB3067-052-Q1-K1-B6
cggacgcgtgggcggacgcgtgggcggacgcgtgggcggacgcgtgggcggacgcgtggggccttcgtgaaagctaaagacggaggcttggaagtcattcagacctaagtcttttgtaatggacatgagcctacgcctggaaattactatttcgaggagaggtacgatttagtcaggttcataaagacggtccagaaggccggcctgtttgtacatctctgcatcggtcctacatttgtggcgagtggaacttcgggtatggggtatttctccatttcctgaaatcacctncgttaaaaatggagcattatcgtgtcttc

SEQ ID NO: 49096 - DNA, 350 bp, Zea mays
  Clone ID: LIB3067-052-Q1-K1-B7
cccgttagactaggttaggctaggctagggtgtcgaccagctcgcggtaatggtggcggtcaggttccatcagtaccaggtggtggggcgcgcgctgccgacgcccggcgacgagcaccccaagatctaccgcatgaagctctgggccaccaacgaagtccgcgccaagagcaagttctggtacttcctgaggaagttgaagaaggttaagaagagcaacggtcaggtcctggccatcaacgagatcttcgagcgtaacccgacgacgatcaagaactatggcatctggctgcgctaccagagcaaaaccggctaccacaacatgtacaaagaggtccgggacacaaccc

SEQ ID NO: 49097 - DNA, 336 bp, Zea mays
  Clone ID: LIB3067-052-Q1-K1-B8
gttgcaagaaggggaattccgctgcgagatccgtgaacggttcagagatggcacagacggtgttcaccccctctttggaagcgatgaagcatgtcaaggcagagaacggagtcattctcaccaagcccttccttgatgtctgcaagcaaatattgcctgtcctcgataaatttggagctgctatggcaattgtaaagagtgatatcggcggcaatatcacaagactggaaaacaagtatacttcagaaccatcaaagtatgaacacttgtacagcatgattcaagaagaagttcaaaacaagaccgcaaaaagttccttaagctgcacaaatgggc

SEQ ID NO: 49098 - DNA, 513 bp, Zea mays
  Clone ID: LIB3067-052-Q1-K1-B9
cccacgcgtccgacggagtcgaaccggacaggatggccgccgctcgcgcacgggtgctgcgcgagctgccggcaaggtgctggacgaaatgcctccgccgcgcttcccctttcccctccacctcgcccgccgcctcctcgctctccagcctcagccgtgcttccacgtctccctttccgctcgcctctcgctcccggcgccttctacactcgctgccctcggcggcggtgcgcgtgcgcgtgcgcgcgcagctgcagacgcgcttcttggcgagcgaagccgcgcggggcggtgtcggcgggcgcgggccagcagcggacagcgaggaggaggcgcaggagtgggcggtggagtgggaggacagcgaggacgacggctacgagcccgagatcggcgacggcggtgacggcggccgggtcgcgctgcggggcgtcggttggggcgagcgtgccctcgtggcggccgaggaggttctcgccggccattttggggatgacatcgcaatgttcgcct

SEQ ID NO: 49099 - DNA, 392 bp, Zea mays
  Clone ID: LIB3067-052-Q1-K1-C1
gggtaagggtacttctgctgtgctcatgctgcttagggaccatgtgacaaatggaagtgctgttgctgccatgaattctgcgtcggttgcagagtgggcaacctctctgtcattgctatttgatcccaaatgtccaggattggagtcacttgtggagaaggtgaaggagattgttgagagcaatgaagtgaggagattgcctaaaattccaaagggtacacgcgactttggtaaagagcaaatggcgataagggagcgagcattttcaattataactagtgtattcaagatgcatggtgctactgcgcttgatacacccgtatttgagctgagagaaacccttatgggaaaatatggtgaagactcaaagttgatatatgacttaactgatc

SEQ ID NO: 49100 - DNA, 503 bp, Zea mays
  Clone ID: LIB3067-052-Q1-K1-C10
cggacgcgtgggcgagcatgggaaagaacatgcgagtatgcatgcaggctgcgcagccaggtggcctcatttgaaccatactgccagatgcacatccaccagcagcagcgccaatgccgatattgacggacgctgacgtcgcagaaccagccctctctgcgagaagcaacagcaccacagctgcatggacttggtatgccgcactcagaatgcgaacccatgtcttgagcatatccacattgctgatgctatgggcttgcctcctcatctgaagatagtcctggtcaacatcatacgcggcgtggcgcattagatctgacgattttcacattgagctgttaatagcaattactttccagcagctatatgtaacgtataatgacattgatctgtgcggtgttatggaggatggatggatgttgagcttgatacctcaaaggtggcacttgatcgtgctgccagatgtctctaggtacatatgggtacatacgtgtggatataca

SEQ ID NO: 49101 - DNA, 343 bp, Zea mays
  unsure at all n locations
  Clone ID: LIB3067-052-Q1-K1-A7
gtgcagtgcagtgcagcagtgtgctaccctcctcagtcctctcactccatgacaaacggtagtcttcctctaaagctcggagcgagtctcagaagcgatggcgtcaaagaggctgctgctggcggcgctgtgcgtggtggcggcggcgctgctcgccgtgcggtcggagtcccacggcctggaggacttcgcaagcagcgacgcgacgccggagatgcagaccttcttcaagcccgaggccgcggcgctcccggaggccctggacgcgtcctccatgcccgccgncaccatggccgcgaagccggaggccacgtcgatcccgaccaccaacaccggcaccacg

SEQ ID NO: 49102 - DNA, 290 bp, Zea mays
  Clone ID: LIB3067-051-Q1-K1-H10
gaatttcatgttggtagtttcttgctcgtgccaatagttttatataagggtttttgttgctgtgttttctgaaacgcataagcgtgtcagtagcatgttttcataaccggattgtagtgcttcattatctatagttttctgtacgtgtaaaatagaccagcgtaacagcgtagtttgcttcattctccgaagtattgtatggctgtacacccaggcatctgggcatcatgaacccaactgattggctaaatgaaataaatctcctccatccaacagcaaatttacaaact

SEQ ID NO: 49103 - DNA, 511 bp, Zea mays
  unsure at all n locations
  Clone ID: LIB3067-051-Q1-K1-H11
ctcacccgcgcagtgtcgctgccgctgcccccctcctcctgctgctcgccgccgccgccggggccgcagcggggctcgtgtccgccgcgtcgccggcagccagcgacttcgtccgcaagtcgtgccgcacgacgcagtacccgtcggtgtgcgagcagagcctggcgtcgtacggcgggtcgccgccgccgcggagcccgcgggagctggcgcgcgccgcgctgtcggtgagcgcggaccgcgcgcgcgccgcgtcggcgtacgtgggccgcctgtgcggcgccagcaacggcaaaggcgcgaagaaggggtcgggatcggcgtcggcgtcggcgtcggcaggtcccgtgcgcgactgcctggacaatctggcggacagcgtgggccaccttcgcgacgcggcgcatgagatgggcggcgccgggatgggccgcgcggtgacgccggcgttcaggtggcacctcagcaacgtgcagacctggtgcagcgccgngctcaccgacgaggacac

SEQ ID NO: 49104 - DNA, 210 bp, Zea mays
  Clone ID: LIB3067-051-Q1-K1-H12
gcataagaacgtaaaaccatttgtgtcgcaatggttacctctaatgttcacctcttaaaaagaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaccaaacaaaaaaccaacaaatcaccaccaaacacaaaacccaaaaa

SEQ ID NO: 49105 - DNA, 253 bp, Zea mays
  Clone ID: LIB3067-051-Q1-K1-H2
cccacgcgttcgcccacccgtccgccaatccttccgggattccggaaaaattggccaaggggaggaacacacacggccacaaccagttttacaaggcccacaagaccggtataaagaagccaaagcgccaccggcagaccttcaccaagggtatggaccccaagtttctgaggaacctgatgtattcaaggaagggcaacaaaaagagttgtgggtctgaagaattaaaaagaaaacatggttgtttttttta

SEQ ID NO: 49106 - DNA, 109 bp, Zea mays
  Clone ID: LIB3067-051-Q1-K1-H3
tcccactcttcctcccactcgtccacccactcttcctgtactgacaattaatttttaggcagactttattttaaaatacatataccactccctcttatattaaactttt

SEQ ID NO: 49107 - DNA, 231 bp, Zea mays
  Clone ID: LIB3067-051-Q1-K1-H5
cttactcttggtctgactcgttggaaaaattaaaaaataaaaaaaaaaaaaaaaaaaaaaaagaaggatttaattaatttatatataaaatccattaaaattcccttcctttcttataatatccttctttattttcctcctctttcctttcttttttcttctttttttttttttccctctaataaaacttaacattcccctcttttttccactcttttatatttcttaaaa

SEQ ID NO: 49108 - DNA, 89 bp, Zea mays
  Clone ID: LIB3067-051-Q1-K1-H6
ggtcgcccactcctacgttttaagaacaatctacagtaagtggcgttctgccgcaacaggacttccacactgaactagtttaagctgga

SEQ ID NO: 49109 - DNA, 322 bp, Zea mays
  Clone ID: LIB3067-051-Q1-K1-H7
ctacttctagatccctaccattgccttctgtgatactgactcttccattccgtacctcgatgtcggcattccagctaacaacaaagggaggaacacctttgggtgtcttgttttgccttctgcccaggatggttctgcaattgaggggctctattcttcctgcgcacaagtggaaactcatggtcaatcttcttttctacagacccccagaaaactcaaaggcccgggaggagaattttcccgtcccccctgattttcccgcattcactgattaccaacgaactgatcagtggggtggtgatcagtggacctcttattgggg

SEQ ID NO: 49110 - DNA, 328 bp, Zea mays
  Clone ID: LIB3067-051-Q1-K1-H8
cgaccttgctacttcatgctgggaaagcggtagaagcaatcacatggttccgtaagcaggtcagaagctatgcacgggttcttggaacaccagaagttgcttttcttcactgggaatggtttagccggcagttcctcgtctttggtgagttgatagaaacaacatctacaactattccagatacattatctcctagatttggcactgcagactatggattgactgagtgggaatttcaaccagcatactactatcagttagcggcaacttacttgaaagagaagaggtatgccatcgaatgttcatcatcaatggctaatcttacaac

SEQ ID NO: 49111 - DNA, 185 bp, Zea mays
  Clone ID: LIB3067-051-Q1-K1-H9
ctcttatcttgcataagcataagaagagagatccacatgtacaatgtagctgaatcatactgctacatctctatcgaagctatagccatagggctaagcccatgccaattcggcagccataaagatctcgggcccctgctgctgctgctggtactcaatctctcaaccctgaacgaaatacccat

SEQ ID NO: 49112 - DNA, 381 bp, Zea mays
  Clone ID: LIB3067-052-Q1-K1-A1
tcgcccacgcgtccggccagtcttgcatcccgtccccgtccgcgccggccgacgccgccttggcgtccccgcgtcagcgtcgcggctccactgagcgtgcgtgtcaccggcgggaggcaagggcaggcggtggtggcgatggcgtccgctgacgcgcgcttggcggggatcgcctcctccatccgcgtcatccccgactttcccaagccagggatcatgttccaggacatcacgacgttgctggttgattccaaggcgttccgtgacaccatcgacctctttgtcgagcggtacaaggaccaagggatcaccgtggttgctggtgttgaagctagagggttcatttttggtccttctatcgctttagccattggcgcaaaa

SEQ ID NO: 49113 - DNA, 587 bp, Zea mays
  Clone ID: LIB3067-052-Q1-K1-A10
cctcctctccttcgggctcagcgtgctcatcctcctctccgtgtacgagacccggttcaggacgatgaggagcgtcagtgcgtggtccagtgacggtggggattatccattgccaatgctccggaaccttgtcatggtggctgggcattcgatctatacgagctcaagatgcggggagaccgagagtgagaattcctggttcttggagccgtaccagaagcacgctggacaggcggccaccttcctggctcacatcaaggagggggtggggatcgcggcgagggatgagggggcactcctgttgttcagcggcggggagacgaggagagatgctggcccgaggagtgaggcacagagctactgggctattgccgagtcgaaaggatggttcggaaatgatgagggtgtaaggagccgagcactcaccgaggagcatgcacgagatagttttgaaaacctcctatttagtgtgtgccgtttcagagagctaactggaagatacccacagaacataactgttgttagctacgatttcaaggaggaacgttttgcacaactgcacagaaccgcactcggattcccggaag

SEQ ID NO: 49114 - DNA, 252 bp, Zea mays
  Clone ID: LIB3067-052-Q1-K1-A11
gcatcctaatgttgttgcctatagttattgggggttattgttattcttggttggttaagaggtgagctttatgaattatggaacttcggaaaaagtccagcagaaaattttgtcaatgaaccatgacaacaaaatccagggaagatgtattcttcagcgtagtagatagcttgaggatgtttattaggaggcaccgtgtattgcaagatgttatgtttagcattatttcaaagaaggatgctattgtgtttg

SEQ ID NO: 49115 - DNA, 421 bp, Zea mays
  Clone ID: LIB3067-052-Q1-K1-A12
cccacgcgtccgcctgaagtctgggacggtggcgtcgggttcgtgtcgaaggaaatgatccagactcattgcccagcgcctgccgccgacattcaggtattgcgatgtggacctcctcccatgaacaaagccatggccgcgcacctggacggccttggctacacgaaggagatgcagttccagttctaagcgttacattctctctaccagtaccagaataaacggcggtggaacaaagtcacagtcacagagcgtcgtacttactctacctggatgaaagcagcagtacagtacccacctaatttgtatcggtgtcgggacattgtaccgtgccgttcttttgtatcggtttgtcactcactcactcactccgcgagccagcagcccagcacacgatccatcgtgtcgttttggcaacgtc

SEQ ID NO: 49116 - DNA, 329 bp, Zea mays
  Clone ID: LIB3067-052-Q1-K1-A2
ggctcggcagtcggcagtattagggtgtttagtttggtgatctctgagaacccagggagtcgtatgtgctgtaaaggtgaagctagaactagaacgccgctacatcagtcagtgccattaggcttagtacattcttcatgctacagctgtttcgtcaataaggaaactacgtgtatgatctgcggacggcaggcgaaaatagcacgtagtacaattccattcctacatatccggtctgttcttgctctgcatatttctttctctagaggggatgttatgtaacgcaatgcaacacccctacctggcgtgggtgtgggtgtttggagggg

SEQ ID NO: 49117 - DNA, 242 bp, Zea mays
  Clone ID: LIB3067-052-Q1-K1-A3
acccacacatacagacacatttgcactctatttgtgacagttaaaataaacaaagacaaatatgggaaaatagaaaaatttaaaaaggtctggaagccttaacgtcatacaagtttagctagcacaaccatgatacgtaatggaacatgctatatggaccgcaaaataaagtccagtgtactacattcttaaacactatgaccgtaaaaaccatggtgatcccaaacttaatctcgttgcga

SEQ ID NO: 49118 - DNA, 324 bp, Zea mays
  Clone ID: LIB3067-052-Q1-K1-A4
cccacgcgtccgcttcctggaaggcggctagggctttgacaccgacatcaccggcaccggcgcgctgcgcatgatgcccttcggcgccggccgccgcatctgccccgccgccacgctcggcgtgctccacatccagctcatgctcgccaacatggtgcgcgagttccgctggctgccgcccgccggtgagggcccgccggaccccaccgagaccttcgcattcaccgtcgtcattgagaacccgctccgggcagccttcgtcgagcgggccacgactgagacggcgacaaccgcgtgacgagtgacgaccgaaaggtataaaaa

SEQ ID NO: 49119 - DNA, 337 bp, Zea mays
  Clone ID: LIB3067-052-Q1-K1-A5
gccacgtttgcgctctatggtgacggtgcggctaaccagggacagctctgggaggctcgcaacatttcggccctctggaagctgcccgccatattggtttgcgagaacaaccattatggtatgggaacagcggaatggagggcagcgaagagtcctgcttactacaagcgtggcgactatgtgcctggattgaaggttgatggaatggatgttcttgctgtgaagcaagcgtgcaaatttgcaaaagatcatgctgttgcaaatggcccaattgtccttgagatggatacctacaggtaccatggccactctatgtcagatccaggaagcacttacc

SEQ ID NO: 49120 - DNA, 428 bp, Zea mays
  Clone ID: LIB3067-051-Q1-K1-H1
cggacgcgtgggcggacgcgtggggcctcgccgagctccgcgtgctcagcctcaagggcggcgcgctccacgggcccgtcccggacctctccccgctcgccaacctcaaggcgctcttcctcgcggggaaccgcttctcggggcccttcccgccctcgctcgcctccctgcgccgcctccgctccatcgacctctccggtaacaggctctccggcgcgctcccgcccggcatcgaggccgccttcccgcacctcaccctcctccgcctcgacgccaaccacttcagcggcaccctcccgccctggaaccagtcgtcgctcaagtgctcaacgtctcctacaacaactttttcggggccagtgcccgtcacgcccgtcatctcgcatgtcggcgccgccgcgttcgctggcaaccccgagctctgcggc

SEQ ID NO: 49121 - DNA, 277 bp, Zea mays
  Clone ID: LIB3067-052-Q1-K1-A6
gccacgctgacgatcacacgttcgatggagcaaaagatggacaaatgacagtacacggggtgcctgaccatggtgcacatggccttctgctcgtccctcgccgtggcgctcgtacgcgtcctacgagtcgtggacctcccgtcctcgcccgacatgacgtcgcagctctacctctcctacgtggtgcccatcggcgccctctactcgctctcgctctggttctccaactgcgggtacatctacctatccgtatccttcatccaaatgctcaacatgc

SEQ ID NO: 49122 - DNA, 317 bp, Zea mays
  Clone ID: LIB3067-051-Q1-K1-F3
gacccacgcgtccggccacccgtgcagtgacagccttaccaagagcatgtccaagatgagttccaacctcaagggcgcggctaacacttctgcttacaactcatcataacaatgataagttctcaaagactatttcaagacctattataatacccctaatctgcaccttatgctgcccatgattcgacccatcatactaacactcataattaaacttatcaattattgatgcacatttgactggacatgttactattttttgagtaccatatggaggaccagaggtttgatatcttgaacgttcctgtgaacatcaa

SEQ ID NO: 49123 - DNA, 203 bp, Zea mays
  Clone ID: LIB3067-051-Q1-K1-F4
gacacaaaaaaaaaaaaaaaaaaaaaaaataaaataactaaaaaaaatacaaaaaaaaaaggcaggtacttactcttttacataaaaactctacaatataataaatcattctttatatactatttcattacctcttatattcccccttttatgtacatatttcttcacattttatgatttcttcatactaaccattttaatta

SEQ ID NO: 49124 - DNA, 437 bp, Zea mays
  Clone ID: LIB3067-051-Q1-K1-F5
caagttccctggccgccaaaagattattgagagcagaaagtggggcttcaccaagttcaggcgtgccgactacctgaagtacaagagtgagggtagaattgttcctgatggtgtcaacgcaaagctgctcggtaaccatggaagacttgagaagcgtgctcctgggaaggctttcctcgaggccgttgcttaagtccaatctacagttggaatgcgaatccagacgttttggtttagcctatcttattttgctttgtgcaacatgaattttaagtgtatggggtattacagtgccttgtgtgaacctgcttatctcgtgctgaacatcggtatgcatggaagtacttatcttttgttctgctaaaaattaaagtgttcttgcgactaaatatatcttctcaatctgggcttgtctctttaaaaaacaaaaaaagaaa

SEQ ID NO: 49125 - DNA, 134 bp, Zea mays
  Clone ID: LIB3067-051-Q1-K1-F7
gacacgcgtgcagtgacagccttaccaagaggatgtccaagatgagtgccaacctctatgcggcggctgacgcttctgcttacaactgatcataactatgatcagtgcttaaagactatttcaaggcatattat

SEQ ID NO: 49126 - DNA, 434 bp, Zea mays
  Clone ID: LIB3067-051-Q1-K1-F8
cttacattagacaccgtgtaagtgatggatctaattactctgggtgctagcaaaatgcttcttttgctaccacccacggaggctgttgtttttttcactcaatctgtgatgtcttcttgcatacatgtcctactacatattgaacattgataagctacaacctaatggttacaagtcacctatactgcgtttggatgctggtattgaggcccagattttggaattggaattggtaaagccgaatttcagcgtttggatgctcacggaattcggaactggaaatccatcccaattcccctggtattcaactacacctgcaccccctccccttcaataccaagccccccacctcggtattgctcagaattcaattacacccgcatccaaacaacaacattggtattgcagatcaattccatttccctcagatttgg

SEQ ID NO: 49127 - DNA, 392 bp, Zea mays
  Clone ID: LIB3067-051-Q1-K1-F9
tcgggttttctcgccgccggcgccgtcgtttcctcgtttccggcgcatcgatgcctcgccagggactttcggatcaagaggaagctggcgaagaagatgcgccagaaccgacccatcccctactggatccgcatgcgcaccgacaacaccatcaggtacaacgcctagcgcaagcactggcgccggaccaagctcagcttctgagcgctcagatcggtcggctactgcatcagaattctaaggtctctacctttgctttggttctatcaaagtctcttgaggttatgaaagctagcgatactcctcagaaagcttttgttaagattttgattacactaagaagattgatgcttctatgccgtgctcaagattccatgctgcattgggatact

SEQ ID NO: 49128 - DNA, 209 bp, Zea mays
  Clone ID: LIB3067-051-Q1-K1-G10
cggcacgaagccggagttcgggctggccccgcagggggtcgagcaggcgctcgtggccggggaaaagttccggaaggagcttgacgagattgggttgccgttggtttcgccaagaattggtacttcgcggtttacagggcccggaacagtctagagtgctcccctgtgtgctgggtatcccctttgaagctcctagttgcgaagttggc

SEQ ID NO: 49129 - DNA, 631 bp, Zea mays
  unsure at all n locations
  Clone ID: LIB3067-051-Q1-K1-G11
tcaaatctatcagcaaggtgctggttaaagtcagcttcatcgaagtcataatcatcttcgtcgtagccatcaaagtcatcatcacaatcatgctgcatatagtaatcctcttcttcttggatttgttggagttctggttctgatatttgcagagaactacttgagctggaaccagcttgatcgctggaagaaccctgtcaaacagtcggctagccagtaattataccaatcaaagcattaaaagaatgcacgaaaaggacaggcaaagtccttctgtttcgccatccactatgtttagtcagtcgtgtggacgatggactgattgccagttagtagtaccataaaaatatgaatagaacaaatgcatctttatcataaaggccaaaacaactgccgcaatgcttatcgcaatcctttgcaggataaaataaaatcacagggaagccatctcctgacagtgttcaccgatccgctagattaatcgaagaaacgaaatcaggtcaattatgaccggcattgcatcaatcaacccaagaaagacccccgatcgtaccatattcgctaccaactcatccncagcgaacacctcggcagtcggcactcgaattgacgcgtcaaaatcccaaaccct

SEQ ID NO: 49130 - DNA, 385 bp, Zea mays
  Clone ID: LIB3067-051-Q1-K1-G12
attcttcaattcgtcacttagcttcactcggcaaagaaaagaggcaacgacgatggctgcggcggcggcgatgatggtctccggaggacgggcggcgctggtggtggcgggcgtgctctgcgcggtggcggccatggcggcggcgcagcaggcgtcgaacgtgcgggcgacgtaccacctgtacaacccggcgcagaacgggtgggacctgaaccgcgtgagcgcgtactgcgccacgtgggacgccgacaagccgctgtcgtggcggcagaagcacggctggacggccttctgcgggcccgccgggcagaagggccaggccgcctgcggcaagtgcataagggtgaagaaccgtgcgacgggcgcgtccatcgtggcgaggatc

SEQ ID NO: 49131 - DNA, 438 bp, Zea mays
  Clone ID: LIB3067-051-Q1-K1-G2
agttattcgataagatcgtcaattctggaaggctaggagaggatgaagctaggatatacgttcatcaacttataaatgcggttgattattgtcatagccgaggagtgtaccatagagatctgaagccagagaatctacttctggactcacatggaacccttaaagtttcagactttggcctaagtgcatttgcaccacaaacaaaagaggatgggcttctgcatactgcctgtggaactccaaactatgtagcacctgaggtgctcgctgataaaagctatgatggtatggctgcagatgtatggtcctgtggcataatcttgtttgttcttatggccggatacttaccctttgatgatgtcaatctgatgagactgtacaaactgatctgccatgcaactttttcttgcccaccatggttttcttctggagcaagga

SEQ ID NO: 49132 - DNA, 439 bp, Zea mays
  Clone ID: LIB3067-051-Q1-K1-G3
gggaagcggttggcatcgcttgagatggagctggctgcagcaaagcatgaaggtttggtgggcaaatatactcccgagacaaatggaactcattctgggaaaaagccactggttgttattggaataatgactagctttgggaggaaaaactaccgtgatgctgtcaggaaatcatggcttccgacaggttcaatgttgaagaaactagaagaagaaaaaggcattgtagtacgttttgttgttggaagaagtgcaaatcgaggagatacttttgatagggagatcgatgacgaaaataggagcaccaaggatttcttgatattggatgatcatatagagtcagatgaagagctttctaagaagacaaaaagtttctttgctaatgcaacaaatacattcgatgctgcattttatgctaaggtcaatgatgatttataca

SEQ ID NO: 49133 - DNA, 150 bp, Zea mays
  Clone ID: LIB3067-051-Q1-K1-G4
gaccgcacgcgtccgagcactcctattctaacgcctattctgtctacgtttactaaacttctatctaccataccagtaggtctactattctatgcagataaacatacacatcaccatggtgccttccttataaatcccaatcctcaacat

SEQ ID NO: 49134 - DNA, 440 bp, Zea mays
  Clone ID: LIB3067-051-Q1-K1-G6
gtgaagcggttgccatcgcttgagatggatctggctgcagcaaaccatgaatgtcgggggtgcaattatactcgcgagacaaatttaactcattctgggaaaaagccactggttgttattgcaataatgactacctttgggatgaaaaactaccctgatactgtcaggaaatcatcgcttcccacatgttcaatgttcaaaaaactataagaagaaaaatgcattctagtacatttcctactttgaagaacctcaaatccttgacatactattgatagggagatcgattacaaaaatatgagcaccaaggattacttgattttggatgatcatctagagccaaatcaatagctttctaaaaaacaaaaaattgttttactaattcatcaaatacattctattctgcactccattgctatgtcaatgatcaaatatacata

SEQ ID NO: 49135 - DNA, 418 bp, Zea mays
  Clone ID: LIB3067-051-Q1-K1-G7
cggacgcgtgggcggacgcgtgggcggacgcgtgggctagactcctagtagccagaccaggagtgccgcgaccctgtcgagagaaacagacagagcaacatggcgcctgcattgtcattcccgatcatcgacatggggctgctcgccggggaggagaggccggcggcgatggagctgctgcaagatgcgtgcgagaactggggcttcttcgagattctgaaccacggcatctcgacggagctgatggacgaggtagagaagctgaccaaggagcactacaagcgggtgcgcgagcagaggttcctcgagttcgccagcaagacgctcggggacggccgcgacattgcgcagggcgtgaaggcggacaacctggactgggagagcaccttcttcgtccgccaccttccggagcccaaca

SEQ ID NO: 49136 - DNA, 157 bp, Zea mays
  Clone ID: LIB3067-051-Q1-K1-G8
caagaccatatccgacatcgagatgcgcctggctgcggctagagccgcccagcgggggggccaggccttttaaccggccaactcgacttcgaaggccaacaaggaacccggccgcgtaagaagttttttgtcattggccttttcaccacttttgctt

SEQ ID NO: 49137 - DNA, 342 bp, Zea mays
  Clone ID: LIB3067-051-Q1-K1-G9
acctgatccttactttccgtatttctcacacactaccctgagccttgctgccacgagagtgagccgcagagggtacgtggcgaggctgctcagatacgtctgaggcctgtgcagctgcgcccgatcgatatcaagatcaaccgccaggtgaccttctgcaaacgcctgaacgggctgctgaataaggcccaccagatctccctgctctgcgacgcagaggtcgcgctcatcgtcttcttcactaaggggaagctatacgagtactctagccattccaacatggaaggcattcttgagcgttaccagcgttactcatttgaagaaagggcaactcttaaccca

SEQ ID NO: 49138 - DNA, 434 bp, Zea mays
  Clone ID: LIB3067-051-Q1-K1-F2
cggacgcgtgggcgccaacgccttcgacaacaagatcgatgccaagcgcacgctccgcgagatcaagctgctccgccacatggaccacgagaatattgttgcaataagggatatcatacctcctgcgcagagggctgcattcaatgatgtgtatattgcatatgaattgatggatactgatctgcatcaaattattcgttcaaatcaagctttgtcagaggagcactgtcagtattttctttatcaaattcttcgtggcttgaagtatatacattcagcaaatgttcttcaccgtgacttgaagcctagcaatcttcttttgaatgcaaactgtgacctcaagatatgtgattttgggcttgctcgcaccacctcagaaactgattttatgactgaatatgttgtcacaagatggtatagagcaccagagcttt

SEQ ID NO: 49139 - DNA, 421 bp, Zea mays
  Clone ID: LIB3067-051-Q1-K1-D8
gaaaccgaggcccacgtcacctggcccgaaggacacaccaatcgagctggcgcaggagaggacctacgatgaaaaggctgggatcggtatgcccgatctatagctgcggagagttcactgtaatgtgaccaggacctgacgccctgtgctgtgctgtgctgtgcttcccgcgtaataacggtgtactagttaccttctttgcagaaaatgctttctaggaatgagagcggaaatatttctaccatttatttaaggtcctgtttggaaacaacccaacagtttttaagacaccagtttttatcttttagctttgagagaccaacttcttgtttttatgaaagtgggaatcaaatttctataaactgagccataaactggtggtttctttagaaccacctcattttttataaaccggtttgtt

SEQ ID NO: 49140 - DNA, 446 bp, Zea mays
  Clone ID: LIB3067-051-Q1-K1-D9
ttaagcaatcagacattaactcgaccgtgacaacaaacgcacacaaacagcaccacatgtccaaaggccacatgacctatacatcagcatcctttgcctacaggctgtcgcacatatcaccgaaccctgactcatctgaccatgatcttctcactgctcgaacggaggtagacaaggctgctcgcgcctcaccatacatatactctggtggccgaaggcttgtgtgcctcggtgaacacttagcctacctgcacatcaaggcaatctggacacacctactgaggaactttgagctcgagctggtatatccatttcaagagaacgactgtcacgacatggttgatggcatcaaggccgacgtgatggttcactacaagaggcggaagcttgacgtggacaactaagattgtggccacaatctctacatgcttgcttcttggcgattc

SEQ ID NO: 49141 - DNA, 385 bp, Zea mays
  unsure at all n locations
  Clone ID: LIB3067-051-Q1-K1-E1
cggacgcgtgggggaagctgtaaatgtatcaaagtcagtgctccattggtgacaaattatgctcgcagtcgtctctttgatgtaatactgcattcttctgttggagacgtgtcaccagaacttgtggagcaatttangaccagacaaaggaactttgacaccgaatctcgcgcaggtgcagcagctaaagtgaagcaaaatcaacatatgactgccatacctggtctgaggatttcacgcagagttaaagtttacaaaccattactattagaagctatgtatgcaaatggattcataggcgcaaagatgattcgagcaaagttatttcataaatttctgtgggcttatgtcaattctttgccaaattggtgcaatgcatttggtt

SEQ ID NO: 49142 - DNA, 352 bp, Zea mays
  Clone ID: LIB3067-051-Q1-K1-E10
ccctcctgcacctatgggaatgccccctaggattcctccaccacctattggggctgttcaggctccgccacctccagcacgagtggcaaatggtctgcggccaatgattccaccgccacctaacttcactcccggagcacccccaccgcgccctccaatgcaaggctttcctgggcaacagcagtagttgactgcttagcaggcaatgttccagtaattggcagtcagtaaaagtttcaagcttgtgttgactattgtttttcggcttaaaactttgtatgttgtctgggactatactcaaacggcagcttgttggatttttttgtatccacatttattcaagtgcttgttt

SEQ ID NO: 49143 - DNA, 226 bp, Zea mays
  Clone ID: LIB3067-051-Q1-K1-E11
gaccatgtcattttttcaacaacgtccagaggttcatgaccatatgcataaacttgatgctgcatgtactacgattcatatcactcttacagatctgtctatatcaacattctgacctttcaaatgaaggaacaatcatcatattggattaatacattaacttaggctctgaagactctaacgaaatcaacgaatagaaatacacttggaaatcatatctcccggt

SEQ ID NO: 49144 - DNA, 419 bp, Zea mays
  Clone ID: LIB3067-051-Q1-K1-E12
gtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgactatcacacgcccatcgatcgatcgatctggaggctaaataatttctccaagctgctagtatacgtacgtacgttgatatatatgatgtagtattatatatatgtccatgcatctcgtcgtctatcgcatgttgttgttgttgttgttgtttttcgatgatcctgtctctgttataaatatcattattatt

SEQ ID NO: 49145 - DNA, 326 bp, Zea mays
  Clone ID: LIB3067-051-Q1-K1-E3
cacacaaaaggtggggtatggataagattatagatggatggtgacacagcacagcagggcacatggctagcctgctagcgtgcggcacccacacaacacaacacactgctcgccagaagcgccccaggaggccaggggaggacacgacgccgccatcagccatcatcatcatctcagactcagagcatgccatggcacgcaactgactgactgactcgaaacacacacagcgacgccgctatactttattaagctttataattagctagctttctccggccggcctgcagggtggagcacctagctcacttgccgcagttgcaggg

SEQ ID NO: 49146 - DNA, 312 bp, Zea mays
  Clone ID: LIB3067-051-Q1-K1-E4
ctcccccaccggttcgtgttcaggttctggttcgtgggcgagagggaagagatggcggcggcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgc

SEQ ID NO: 49147 - DNA, 460 bp, Zea mays
  unsure at all n locations
  Clone ID: LIB3067-051-Q1-K1-E5
cgcccacgccgtccggatttgtatttctatcacagctgacgcattttgaacccgtttcctttagatcgacgctgctgctatcttgggtcacatgctacatcaatntgggcaagnccgacctgagtattgtttcatttgaagtnaaaaaatcggaacgccaggtggtctgtattttggtcttaggttttcggtattgtacccgtcaacattgtaatctcttcttgaacttgcagntttcgctgtccctgaagccgagttttattatacacataatagacccgggatcgttgaccgtttttaaaataaaaaataatggtattcttaataaggtttatataagtgcaatagataatatcttacaaaagttttttttattaaatattaaaaaaggcgcggcccccctttttttttcaatatttttaattttttttatttttttccaaaaaaatggtcgttttat

SEQ ID NO: 49148 - DNA, 424 bp, Zea mays
  Clone ID: LIB3067-051-Q1-K1-E6
ctctggacaagtgaaggagaagctgggcacgattgacccctactttgtcaagctcggtgaggccatggtcacctggatcgaggcctgggatgagctgaacccgtcgacccctgccgccgcaaatggcaaggccaagtagatgtgccatcacttcggcactggagtgaaaaagaaagtatgattgggtcctgcctaggccccatagatatagctcttttttgagaaggaagagagattaattcagcagcagcttttataaattctttgttgtcatgaagcaggtggttcttttgtagttgatgaaagggatttgtcgtcgctatcgtttacataattcagacaataattttatattgtgtaattctgagaatcaaagcactgtttgtgttatagcatatctaagaatgagcatttgctgttgttt

SEQ ID NO: 49149 - DNA, 282 bp, Zea mays
  unsure at all n locations
  Clone ID: LIB3067-051-Q1-K1-E7
tacgtatttttcacacaaaacgtggggtttggataagattatagatggatggtaacacagcacgccggggcacatggctagcctcctcccntactgcacccacacaacacaacacactgctcgccagaagcgccccatgaggccagtggaggacactacgccgccatcagccatcatcattatctcatactcatagcatgccatggcacgcaacttactgactgactcgaaacacacacattgactccgctatactttattaagctttataattagctaaat

SEQ ID NO: 49150 - DNA, 422 bp, Zea mays
  Clone ID: LIB3067-051-Q1-K1-E8
cccacgcgtccgcccacgcgtccggggagcagctaaaatcctgaagatgagagtgagagggccttttgatcatgttctagcttagcttgttgcaagtgtgatttgaagcctagtgcgctggggtttcttttatggccatttctctctcattcctctacattcatgcgtgggtcatggataggcatgagaaaagattgtacgtacgtatcttgtgttcctgttcccaatgaatggatggaaccaaacgtgtgtccctttccaaaatacaatcaaaaaaattatctttaccgttacttgaaaactaacaaatttttttttgaattcaaactgtgaactcaagaaattttgtttttttggcttggtggggccccctttataaaattctttttttacctactatttttttcccaagatagtttttt

SEQ ID NO: 49151 - DNA, 410 bp, Zea mays
  Clone ID: LIB3067-051-Q1-K1-E9
ctgtggcgtgatcgacccacgcgttcggagacctatatgccacaaagtttcgtgccctaaaatactctgctcgatgctgcttgcacgagactgcttgttgaccagatcattattgcaaagccggcacgaggtccaagaagagatgcccaatctggtggcgggatggacgaggattagttcgattatagttgttatctttgtatcacgtatgtgaagcttcagagcagatatcatactttatcttggctcttggttctagtaaaagtttggttgcctggagttcactacatgaacgtctgcaccgttgcgcatatatgacataggcaatccgtatgctacctgctggtgtattgcagttcggctgtattacatgattcattacaggggccgctccttcagttcatcacacc

SEQ ID NO: 49152 - DNA, 429 bp, Zea mays
  Clone ID: LIB3067-051-Q1-K1-F1
gacccacgcgtccgcggacgcgtgggcggacgcgtgggcggacgcgtgggtagagactggggaggccgtagcgttcaaagaatacctgcaggagtacgagaacaccatatgcggacgccaccccatcagcgtcttccttcacatgttgaaacattgctcgacaaaaattaagataggctttgtccgctacgagcagtccagccagtgcaagaacatgagggatagcagcgtgagctatgcatccgcagcagcgaaggttgctggtgcatccggggaagaagataaacaagactgagcgagctacagctctggttgatatactatatataaaccgccaaaccttggtgcggaatgtgtgactggtttcccataagaaaaagaacatgtgatttggtaaaacattttcttcttcagtaaaaataataaata

SEQ ID NO: 49153 - DNA, 206 bp, Zea mays
  Clone ID: LIB3067-051-Q1-K1-F10
tctttggaaaaaaaaaaaaaaaaaaacaaaaaagaaaaatttaaaaaaagagagagaaaaaaaaaaaaaaaaaaaaaaaaaaaaaaaaaaaaaaaaaaaaaaaaaaaaataaaaaaaaataaaaaaaaaacgtacaaacctttaaatcacaaaataaaaccacataaaaatataacccaaaaaattaaaaaaattatctacacatt

SEQ ID NO: 49154 - DNA, 439 bp, Zea mays
  Clone ID: LIB3067-051-Q1-K1-F11
accatgcatccgaccactcgttcaggttatcgcgccgccgccgccgccgcttcatagactgcgacgcagcgatgccgtatcacagaaccttccacatcaagagagaactggcgaataagatgcgccagaaccgccccatccgctactggatccgcatgcgcacggacaacaccatcaggtacaacgccaagctcaggcactggcgccgcaccaagctcggcttctgagcgcgcggatcggccggctcctgcgtcagaattctacggtctctacctttactttggttttatcgatgtctcttgcgtttctgtaagctagcaaacaattccagaaaagctttgttaagattttgatgacgctaaaaagattgatgctactatgctgtactcaagattccatgctgcattgcgatgcttaattaaaaaacctttgttacctt

SEQ ID NO: 49155 - DNA, 448 bp, Zea mays
  Clone ID: LIB3067-051-Q1-K1-F12
tcgggcagtcgcaagtagcaacccgcatcacgagttcacccacgctccccgcacaggcactgttgactagcgaccagggaggtcaaacaagaggcaacgagaacgaacgccaccaccgcgctccggtcgctttgcttggttcgggccactgcaccgccattgttgatctgttctccttctccttggaggagaaagaaaaggggagaggaatgatggggcgcacgagcgtgccggcggccgtggcggccctgctggtgctggcggcgtgcgcggctctgccggcgaggacggcggcgaacaagatcagcatcaactggaagcccaacgtgaactacaccgactggctgaagcagcacagccccttctacaaggacgactggctggtgttctactacacggctgggcaggctgacgtggtgcatgtggacgaggtgggctacaacaagtg

SEQ ID NO: 49156 - DNA, 321 bp, Zea mays
  Clone ID: LIB3067-051-Q1-K1-D7
gctccgctgaatccttacagtaattgtcatgctttcttttgctccatgtgtttgttagcgtgggcttcgacgcgcgtgtactccggtggttttattttagaaatcagcagtgaagcaaaataattgtcttcggatatgttaaactggctgagccattcaaaatccacgaagcgcgagtgaggtgcatctgaatgtggttgtggttggcgaatggggacgatgaaaacgcttacggccgtgctgtagcaagttttggcatatattccttgtttctaccgagagaaaaattaaataattattaacacatagacaattataatg

SEQ ID NO: 49157 - DNA, 234 bp, Zea mays
  Clone ID: LIB3067-051-Q1-K1-C11
gccaaccatctgaaggtccacatcaagaacacaacgtacatactctttaccctacagaaggtcactgtcaccatggtttaccaatacctgaacgacgtcatcggctactacgcgaaacttaccctccagcaattctaggatctcaacgagcaaccaggtgttatccaagttgtgccaatccaaacttaccagctacatggccctcaaatctgcactcaccatggcacgacacac

SEQ ID NO: 49158 - DNA, 587 bp, Zea mays
  Clone ID: LIB3067-051-Q1-K1-C12
catttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttggtgtgactgtccagtctgcgatgggggaggagcagatctgcgcgttgaaggatgttggccccaagtaaccttcttggctttggagacggaaccctactgtatctcaacttaaat

SEQ ID NO: 49159 - DNA, 440 bp, Zea mays
  unsure at all n locations
  Clone ID: LIB3067-051-Q1-K1-C2
cccacgcgtccgccgcttccaagatgtcgaagcgaggacgtggaggttctgctggtaacaagttgcggatgtcactgggtctaccagtggcagccactgtgaactgtgctgataacactggagccaagaacctttacatcatttctgtgaagggaatcaaggggcgccttaacaggcttccttctgcctgtgttggtgacatggttatggcaactgtgaagaagggaaagcctgaccttaggaagaaggtgatgccagctgtcattgtgaggcagcgcaagccatggcgccgaaaggatggtgtctacatgtactttgaagacaatgctggagtgattgtgaacccaaagggagagatgaaaggctctgccatcactggacccatcggaaaggagtgtgctgatctgtggcctangattgccagcgcggcaaatgcgatt

SEQ ID NO: 49160 - DNA, 422 bp, Zea mays
  Clone ID: LIB3067-051-Q1-K1-C4
cagacgcgtgaacaggctcatccacatcaaccacggcatatgctggtgctgctgatgcggaggcgtgattctagggtctgaatgaatttacaaacattgtactacgctctttgcagcactcaactgagacataattgccatactttgactcttatgtgactttcgtcgagaatggactgctggattatctttttctgtgttgacgtaacgaggtcgataagaaactgttttgaaacctgagtggcaaactcaagtgttgcatagacaaggacataaagtaatgccacccgaactatgcaccttgcgtccttgcccggcttctaacaattgatgcccccccttgcatttttgtttgactgcctatttttcctgccccccgtttggttggggcaatgaggcgtagtggtcgataataaaaccca

SEQ ID NO: 49161 - DNA, 328 bp, Zea mays
  Clone ID: LIB3067-051-Q1-K1-C5
gcagcagcccattgcctgcctttcggcttaccctctctctctctctctcacacacacacagaaccactcacactgccggttggtttcccttccgttgtggttggtgcgtacttagtggcggccggccatggcgcggaggaggggcttcttggcggtggtgccgtcggcgtggctgccggcggtgctcctgtgcctggcaggcgcagcgtcgggcgagccgctgccgcaatactacaatgccatcttcagctttggcgactcctttttcgacacgggcaacttcgtcattatcaactcgggcaagctgcccaacatgcccaagttcccg

SEQ ID NO: 49162 - DNA, 440 bp, Zea mays
  Clone ID: LIB3067-051-Q1-K1-C6
gggagggagagaaaaacccaggccccccgatctcctcctcccactccgatcgcccgagcgatcgccgagcttccccgttccctccccgccccccgcgacgccgcgacgccatggagccgccgcacgccgagcaggccgtcgccgctgtagcagcaggaggagagggcggcactgcaagcccgggcaccggcctcgaagggccggtgcttaggcgggggctggacggcggtggggaaggggaggacggggagctgggggcggggcaggaggcggacgcacggctaccggagcggactggcgaggcggactgtggctactaccttcgcacgggcgcctgcggcttcggggagcgttgccgctacaaccatccccgcgatcgtggtggcactgagtttggtggaggtaccaagaatggtgcagcacaagacttttcaaaacga

SEQ ID NO: 49163 - DNA, 316 bp, Zea mays
  Clone ID: LIB3067-051-Q1-K1-C7
cccacgcgtccgtctgccgacgccatcagccggcgggacgcacagacgaggtcgaccttcgaaccctattccttggccgagccgccttgcgggatcgtccccgccgcgcggcagctctgcctcgacccttttagtctccgtccgacaccgcttggatcagagatggaatcaccacccctcacagctgaagcaattgcttttaccgagaaaaagatggacatgactttggaggatataatcaagatgtcaaagaaaaaaaatcctggaagcaagaacccccctaggcaggcgatcaaaaagcgtccattccagaatg

SEQ ID NO: 49164 - DNA, 438 bp, Zea mays
  Clone ID: LIB3067-051-Q1-K1-C8
cccacgcgtccgactagttctagatcgcgagccgccctttttttttttttttgcaccacgggttacgttagattcttatagagtagtagagatcgaataaatattatatgagccaaacttgtatacgcacatagacacggcacggccatgacaactatatataatatgggcacaagagctttatttatttaatttacacacgacgatgatgagcgaattgaaataaaggataatggaggatggagcaggtacgtagctagcagtagctcccctgctattattcgaattaaatctgacgcaagtaaacaccgatagcatcgacgagcctggttcccgcccgcgcatagaatcccacgatgctgctgccgatgggcgccgtgacggagaaacgcgtcccgttctcgacaccccaggggccccaggttctgctgctggtga

SEQ ID NO: 49165 - DNA, 436 bp, Zea mays
  Clone ID: LIB3067-051-Q1-K1-C9
acgtccacgcgcgtcgtgacgcgtgctcgaacgctaccctcgctccttcactctcatgccggcggcttgctttactgatcgacattgtcaagcgccgaccgaagcccgacatggctaccaagctttctaacgccactgccagcgatccgacggtcgcacttcaagaacgaatcggacacagcactctggctctatcaaccgtctgcgaccaaagctcacggacgccttcacgattctatctccgatcatgcggcaattcccttccggacatactgggggggtgttggtcgcaccgcgcaagctaaagctcgccactgcaatgggcatggcccgcggccggttaaatgagccgggtgcatcgtggatttgctgaagaatgctgagagtaacactgatgtgaaaggcttggatgtggacaacctctataattcacaca

SEQ ID NO: 49166 - DNA, 413 bp, Zea mays
  Clone ID: LIB3067-051-Q1-K1-D1
cccacgcgtccgatgaaaagttacctcactggcaatccggaaatccgtcttgctctcaatgaggatttgagcatcggaagaactggatcttcttcatacgattacagaagttcttctggaggaggaacagtcattcttgatgattgcaatttccatgagtcagtacatctggacagttttgatattgacagaactttgactttaataccgcccgatggagaatttcctgtaatgaactaccgtatgacccaagaatttaagccaccattccgtgtaaccgcactaattgaagaagctggaccagcgagggctgaagttctactgaaaataagagctgacttctccgcgagtgccactgctaacacaatcgtagtacaaatgccagtgcctgcatacacaatgagagcgagttt

SEQ ID NO: 49167 - DNA, 378 bp, Zea mays
  Clone ID: LIB3067-051-Q1-K1-D11
acgcccacgcgttcgctgacacgtgggtaccccttctccacatcccccctcccatgaaccggcggtgtacttctccagcggcgatgactacgcgcttcaagaagaaccgcaagaagcgcggccacgtgttcgccgggcactgccgcatcggcaagcaccggaagcatcccggatgtcgcggtaacgccggtggcatgcaccaccaccgtatcctcttcgacaagtaccatcccggctacttcggtaaggtcggcatgcgctactttcacaagctcctgaacaagttctactgtcccgcggtcaacatcgagcgcctctggtcgatggtgcccgccgacaaggcggcctaagccggcagcgacaaagccccgcagatcg

SEQ ID NO: 49168 - DNA, 402 bp, Zea mays
  unsure at all n locations
  Clone ID: LIB3067-051-Q1-K1-D2
cgcaagaccacctccgcgcccacctcgcatcctccgaatccgcggccgtcgctcaggtttggaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagngtgaaggctatagccgaaatatttgctgacgctgggttttcagatgttacaaagaatttcttggctgtcctggcggacaatggcaggctgaaatatattgaacgcattgcgg

SEQ ID NO: 49169 - DNA, 424 bp, Zea mays
  Clone ID: LIB3067-051-Q1-K1-D3
cggacgcgtgggcggacgcgtgggtttcgtcacccctgacgctcgacgcctcttctcctgtcgtgccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtgg

SEQ ID NO: 49170 - DNA, 229 bp, Zea mays
  Clone ID: LIB3067-051-Q1-K1-D4
cggacgcgtgggctggtgggcctggacccgtgccgtcacctttcggctgaaggtcgagtgtggtggtttcgtcctccatcggtcctgatattgtatctatagtgttcagcttgcgttcattacattcgattcgctgcagcttgtattgtatgtagcctttttgacgtgtagcacgcttggtgttgagagcaatgtacacctgtactgttgggtcgggtgtgattataca

SEQ ID NO: 49171 - DNA, 416 bp, Zea mays
  Clone ID: LIB3067-051-Q1-K1-D5
ggttgaaaaacctccaagaaaatggaaataataggaaggggggattcttcttatcagaggggaaaagcctccaagaaaatggaggtggaactagcgaatggaggtggaactagcagaaaattcatattacagaaagcactgccgacggatgatgtgaacagggcacaagcagataatatttaggacacttttagaaggcttcaatcaaaccatcttacttagaaaggagaagctgaggtgttgtccaaggatgggtatcgatctttcatggggttcaaccggccgctgctggacccttcatctaatatggacagtgaaagtcatctagtgcaacggaggaggcaataaggaaccgaagaagacatcaaggtttctcagaactcgttcaaatgacaactcgttagccatgcttgatt

SEQ ID NO: 49172 - DNA, 205 bp, Zea mays
  Clone ID: LIB3067-051-Q1-K1-D6
cggacccgtggccggacccttggcccgaccggagtctaaattcaaaaccaccttggactggcggattttttttccacccacaccttgtctgcgccgtcgtttgctgcaacgatagccttccccgacctgctcttcaatctgcggaacctcttctacctgggcgcctaccaagcagtcatcaacaacagcgacgttccgggccttt

SEQ ID NO: 49173 - DNA, 270 bp, Zea mays
  Clone ID: LIB3067-051-Q1-K1-B9
atcgttcaacggcggagttaattcggcgcgcgtcgcggcgcgggctcgtcggtgtccgtcgctgccgtcaggctaatggcgccttttgggtttaacgagcgacgccgacgggcgccgtccgccgcgcgacgtggccggtgtgctttggtgcggggctccgggcgatccgccgtccgcgtgtggccatgatccgctcagggaacgcttggcctatcgacggtaggcgatcggagcgcacgggcgccggcgcgcgtcgttctccgttcatgc

SEQ ID NO: 49174 - DNA, 321 bp, Zea mays
  Clone ID: LIB3067-051-Q1-K1-A2
gttggcttctcctccccctccggttcgggttcgggttcgtgaggttctccggggttcgggggcgggggtgagcggatcgagatggcgccctcccatgttgagtaccgctgcttcgtcggcggcctcgcctgggccacggacgaccactcccttcacaacgccttcagcacctacagcgaggtcctcgagtccaagattatcctcgatcgggagacgcaaaggtcccgcggcttcggcttcgtcaccttctccacggaggaagcgatgcggaacgccatcgagggcatgaacggcaaggagctggacggccgcaacatcacc

SEQ ID NO: 49175 - DNA, 355 bp, Zea mays
  Clone ID: LIB3067-051-Q1-K1-A3
gttatgtggaggaggatctggtttctaccgacttccttggtgacagcaggtcgagcatcgtcgacgccaaggccgggatcgctctgaacgaccacttcgtcaagcttgtctcgtggtacgacaacgagtggggctacagcaaccgcgtcgtcgacctgatccgccacatgttcaagacccagtagagggttttccccctgcttctcatggatggttgctgcttgtgtatgccgagaataaatgtggatgtcgccaggttcatgctgagtctggacatgttttgcacttttgtttccatttctgccatcatctgtggcagatccgctcgctaatatgggacctgagattagctttt

SEQ ID NO: 49176 - DNA, 440 bp, Zea mays
  Clone ID: LIB3067-051-Q1-K1-A4
gttctagatcgcgagcggccgctcggacatggtaattgtaccagctacaactggtcagatgggcgttttgccaggccatgttgccacgattgcagagctcaagcctggtgttctctcagtacatgaggggaacgatgtgaccaagtactttgtgagcagtggatttgctttcgtccatgcaaactccattgctgatattgtggctgttgaggctgtccctgtggatcagatcgacccagcttttgttcagaagggtctcgctgaattcactgccaagcttggttcggcctctactgacctggagaaggctgaggctcagatcggtgtcgatgttcacagtgcgctcaatgctgcattgaccggttaattggtgtcatcttaaattgtctgtcttttagattgagtttaactttgcaaatcctaaataaattatagtccat

SEQ ID NO: 49177 - DNA, 360 bp, Zea mays
  Clone ID: LIB3067-051-Q1-K1-A5
cggacgcgtgggcggacgcgtgggcactgacaggttccctggatgattttggatttgaagattatcttaacatgcctcatgattctgacagtttccgtcaacctgacatgcaccatggaatggaggttcgccttggtttgtccaagggacctatctgtcctagcttcaattgaggcagtaatgtaattctgctgcaagttcacctctcagtccagtacttcagtcaatagaccatattaagatggtgaaatatgaaaactggtagcttgcatctgttcaatgttatgttttaatcaacgctgaatttaatatttgtcaagtttgaacttaaaaaatttaaaaaatattttttttataaat

SEQ ID NO: 49178 - DNA, 431 bp, Zea mays
  Clone ID: LIB3067-051-Q1-K1-A6
agagcaccgtccatgacgttgtacttgttggtggctccactaggatccccagggtgcaggggctgctccaggacttcttcaacggcaaggagctgtgcaagaacatcaaccccgatgaggctgtcgcctatggtgctgctgtccaggctgccatcctgagcggtgagggcaatgagaaggtgcaggacctgcttctgctggacgtcacccctctgtccctgggtctggagactgctggaggagttatgacagtgctgatcccgaggaacaccaccatccccaccaagaaggagcaggtattctccacctactcggacaaccagcccggtgtcctgatccaggtctacgagggtgagaggacccggacacgcgacaacaacctgctgggcaagttcgagctctccggcatcccccctgcaccccgtggtgtg

SEQ ID NO: 49179 - DNA, 389 bp, Zea mays
  Clone ID: LIB3067-051-Q1-K1-A8
cccacgcgtccgacggcgattcccccttgcacggcggcatcgggacctcgtcaccgacgacatttgtccccatggacccccacagcttcggcacctgcgactactggaggtcgcacccgatggagatctggtcggcggtcggcggccggttcccgagcacgtcatcgtcgatgggccacttcttcggcgcggcggcgggcaacgtgggcggggcggacgtgatgagcatccaggacgcggtgggcaacacgcgggcggacggcacgggcgcgctgctgcgcgagggcgccgccgcgctgctcaactccatgacccgcgccgggttcccctacaccacggagcaggtccgcgacgcgttcgcggaggcggcggcggccgggtccgacggc

SEQ ID NO: 49180 - DNA, 493 bp, Zea mays
  Clone ID: LIB3067-051-Q1-K1-A9
ggttggcttctcctccccctccggttcgggttcgggttcgtgaggttctccggggttcggggtcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggctgcggctacggcggtggccgcggcggctacggtggccgcggtggctaccgtggtggtggtggcggc

SEQ ID NO: 49181 - DNA, 425 bp, Zea mays
  unsure at all n locations
  Clone ID: LIB3067-051-Q1-K1-B1
cagtgcgccaagagtgtgcgtgatggaggcaaagctgttatgatcgggcttgctgcaacggacgtaatgggagaggttgatataacccgtcttgtccgacgacaggtgaaaatcattggctcatatggcgcaagggccaggcaagaccttcctcagatagtgaagctcgcggagagtggtgccttcaatctccagaacaccatatcaaggaaatgcaaattcgaggaggcgaatggcgcctatgaggatctcaatcagggcaagatcgtaagacgagctgtggttgagatcatgtagtgatgacggacaaggtaatcaatcctgtggttccaagtctgggtcacacaacaaataaagtttgcgtgctctttcacagcatngtcaaaatctgtagatgaccaaactgcattgtgtgtgtgtgtgac

SEQ ID NO: 49182 - DNA, 327 bp, Zea mays
  Clone ID: LIB3067-051-Q1-K1-B10
gggttgcccctggatcacatgcaactgaagctgctgtgaataagcaactgaacgacaaaggacgtgttgcggctgcattggagaacccaaacctactggacatggtcgaagagtgcttatcaccaacatttgattgaggcctgaatatcaatatatcggtgtgacatggtgttgatgttcaggagccacacatgctcattgccaatggagttcactcctgtctttcgagaaccaaaatgccttgggtgttaagtgacgtgttgcatgatttttttcctccgccccgttcagttattatatatgctactatggcgctaccctttttgg

SEQ ID NO: 49183 - DNA, 516 bp, Zea mays
  Clone ID: LIB3067-051-Q1-K1-B12
cccacgcgttcgcccacgcgtccggccaataaatcacttgttaccctggaccaactgtatggaggtctcttttaacctgagaagcaaaaggaaaattgaccggctatgctgggcccgcaagaagaagagaacatccctcgtgccatcttcaacaagcatgccagcatcgccgagtgaagttcctgccgcggatttctaactgcccttcgttgaagagcaagcctgccctgtataataatttcatggtacattctttacatgcattggttggaaacgattctttcacattgctcatcaatggtgttgtaacctgcaacattctttatttggtttcatagggcattcagtcagtttacgggtggtagtttgtcggaacatgtacccaatttttctgatgaaacaaatgtttgagcttcaaaaaaaaaaaaaataaaaaaaaaaaaaaaattaaaataaataaaaaaataattaaaaaaaaaataaaaaaaaattaaaaaaaaaaaaaaaaaggggggg

SEQ ID NO: 49184 - DNA, 300 bp, Zea mays
  Clone ID: LIB3067-051-Q1-K1-B3
gttgaaacgtgtttttgtcatctgttactcaatcattgtttatggcgacaaaattagcacacaaactggaattggcacgtccattgccatagctggtgttgctatgtactcttacattaaggctaagattgaagaagagaaaaagaaaaagagcgcatgactgctgtgaataatattatcgggaccttactgggacacaacatcgtagacaattacgacctacttctataccttgtttagatctcatcttgagtcattcggaccattgtttagatcccagactggtgattaaaagtctgc

SEQ ID NO: 49185 - DNA, 430 bp, Zea mays
  Clone ID: LIB3067-051-Q1-K1-B4
gaaggcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctacaacaagaagcccaccatcacctcccgcgagatccagacctcggtgcgcctcgtcctccccggcgagctcgccaagcacgccgtctccgagggcactaaggccgttacgaagttcacctcgtcttaggatccttgtaatggtcatgtgggcgtcggcggtaggcgtggctcagtttatgtgatactgctagcgatggatgatgatgatctgcgtgtaattgaattaaagaattgtgctgatctttctacaacactgttccacatc

SEQ ID NO: 49186 - DNA, 432 bp, Zea mays
  unsure at all n locations
  Clone ID: LIB3067-051-Q1-K1-B5
cccacgcgtccgcattcatcttgcaatgctaaatgccgtcctgtcgtgaagaaatgtttgatttggtggaacttcacatagtantgttggaatggaatcgtcttccagttgaattcgttgggatttcttgactcttgaaatgtgttatatattactgaatataaaggtgtaagagggacgcggaatggaagacctgtgtcgctgccacagactgcagctggaagcagatcgcggagccggtgatgtgcctgtacagggagacgacggacggctcaaccatcgaggacagggagacggtgctcgtgtggaactactaggacgcggaccccgactttgggtcgtgccaggccaaggagctcgtcgaccaccttgagagcgtgctcgcgaacgagcctttgtctgtgaaaaccacgcctcactcatttgaagtga

SEQ ID NO: 49187 - DNA, 301 bp, Zea mays
  Clone ID: LIB3067-051-Q1-K1-B6
gcgaagacgaagtcattactagcggcttacaaaagggaaacagtttcacatggaatacccgtgaggaagaagaaggtcaagccacttcagttcgtcatcggactcgagagggcgcccaacattctaatggcaacatacatgaatgttatggcctcgacctgttggttgatggaatacccttgtagagcagggctgcgactatgactgagtaccttcaagcttatgaactttattaggattactagtatactgtatggacttgttggcatgaatttgtaactcctttaaatattaattgttt

SEQ ID NO: 49188 - DNA, 443 bp, Zea mays
  Clone ID: LIB3067-051-Q1-K1-B8
cccacgcgtccgcccacgcgtccgctttggttctgccctcgcacgctatgcccgcgagtcggctccccgcgcccgcagcccccgccgccatcccgattcctccgcccgcttcccctccccgcacacgcagccccgccgccatcccgattcctccgtccgcttcccctccccggtccccgcgcccgcagcccccgccgccatcccgattcctccgcccgcttcccctccccgcgcccgcggccccgccgccatcccgattcctccgccagcggcggtgcccaaggggaagaagcgggaggcggaggacgagatcgagatggccgtgagcgcgaagaagcaaaaggcggcgccaccggcgaaggccgtgccgacgtccaagaaggacgccaaggaggacgccaagtccaagaagcagccgccccccaagaaggctgagaacagca

SEQ ID NO: 49189 - DNA, 399 bp, Zea mays
  Clone ID: LIB3067-051-Q1-K1-A12
cccacgcgtccggactagttctagatcggcttaaggttgggagtgtcactgtggacatgaggactaccttcctctggctctgctgttacctgcaagcattgctgctgctggatgtgtgtgtttgatcagtgactggctgctgctccatagaagatgaacggagagaaggatgatgaagggctttggcaatcgccgctgcaactgcaacccatgccatgccggcttagtgattgggtataatttggcttggcagcagccagcattattatgtgctgatctgttatcttttactagtttggtcgtccgatatctttctttctttttccccccttttcgactctgtactgaaactgctgagagattcgcagtattgttgtatcgtattcatatgctactgtt

SEQ ID NO: 49190 - DNA, 391 bp, Zea mays
  Clone ID: LIB3067-050-Q1-K1-G5
gaggaaggaaatgagcttcttagtgctttcatggtcgcaaacttttccagtggcgaggatgatgcaacattctggagtaggctaatacagccagatcctgcagatattattcaggaaactttggcgcctcgtgctgcacgtaataaaaagagttatgttgaagatccccagtttgacaaaaataataacaggaaaagacgtgcagttgaagcacaagaaaagccaaggaggcgttctggcagaacagtggaaacagttaattcagtaccattggttgatggagcagtagctcaagtacgagagtggtcttttggtaatattccaaagaaggatgcttctcgttttgtacgagcggttaaaaaattttgggaatgcaacccaaattgactta

SEQ ID NO: 49191 - DNA, 432 bp, Zea mays
  Clone ID: LIB3067-050-Q1-K1-G6
ctcagagcagccgcatccacaacctgcctctctcgtcccctggcggcgtccgcggcaggagggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtccatcccaagggtggacgcc

SEQ ID NO: 49192 - DNA, 443 bp, Zea mays
  unsure at all n locations
  Clone ID: LIB3067-050-Q1-K1-G7
tggtcgcccagtaatatctcaacctcatttcatatctgtctgcatttcaaattagatggaaagaaaaaattattgctgcagaatagcttatatcattacttgcactatagctgatagtagtcaaatacataaacttaaatttcccaatagtagttccttttttattatatctgagagcatagtagctctttcgctaatacatcgatcacccctatactaatttctcaggttggagcagcagattatatagcactagctaggaactaccatacaattttcatatcagaaattccagcgatgagtatgaagattcgtgacaaggcaagaaggtttatcactcttatcgatgagttgtacaaccaccactgccgccttatatgcctagctgcctcatccattgatgatctttttcaaggaactgangaaggacctctttttgattt

SEQ ID NO: 49193 - DNA, 435 bp, Zea mays
  unsure at all n locations
  Clone ID: LIB3067-050-Q1-K1-G8
cgcaagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgtaaggttaatccgaattctgaagtcatgggtgcgcttccagtcacagcgtctntagctaacaagctcgcatacatataggcaacttgagtgagctatgtag

SEQ ID NO: 49194 - DNA, 440 bp, Zea mays
  Clone ID: LIB3067-050-Q1-K1-H1
gttgcccgttgtgctctctctctttattcgttcctcgcctcaccccgagccagccgtctcgctggggtttctccgccgccgccgccgccgccatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgatgcttgcagcatccattctaaggctttccaagattgtctcaacaactatggc

SEQ ID NO: 49195 - DNA, 443 bp, Zea mays
  Clone ID: LIB3067-050-Q1-K1-H10
gggaaacaattccactcgccgcggaaaccttccttctgtgcctcgtccggtcgtccggccgttcgcgcccctgaaattgtccgaccgcgtggcgactcgggtcggacggatgccggtcgacgtcgaggcggcgatggccccgccccaggcggcatcggcctgcagctcgtcgtcgataggcagggacagcgacgagtgctcgccgccggggaaggaggaggaaggggagggggaggtgcagagcgcgtacgagggaggaggagggggcagcctcgctgggttggaggcattggaggaggcgctgcctattcggcgcagcatatccaaattctacaatggtaaatccaaatcatttgtgtgcctgaaagaagctataacattttcaggctctgcataagacattactaagtcagagaatgcatactccagataacggaagaatc

SEQ ID NO: 49196 - DNA, 356 bp, Zea mays
  Clone ID: LIB3067-050-Q1-K1-H12
cagatggtctccgggagcacttgctgtacgtggacggcggcggagcggcggcggtagccaggatacgggtgcgcgggctgcggcgccgcgcggacgcgaccggcgaggagatcctgcgcggcgtccacctcgacgtgccgcgcggggccgtcatgggcgtcatcggccccagcggcagcggcaagtccacgctgctccgcgcgctcaaccgcctctgggagcccgcgcccggcgccgtgctcctcgacggcgccgacatctgcgccctcgacgtcctcgccctgcgccgcaaggtcggcatgctcttacagctccccgccatgttcgacggaaccttggctgacaacgtacgatac

SEQ ID NO: 49197 - DNA, 321 bp, Zea mays
  Clone ID: LIB3067-050-Q1-K1-H2
gatgaacaccgatccttggtattcatcgtatcattactctcacccaccactcgtcgagaggctggagtctcttgaagattcagacagcaaaaaagaagattagtccgaacggcgaaccgtcacagccattgttcttgaagggacaaagtcttaatccttgtatgaggtttacatatggattttccctgccacatgcacaccgattcagtgcttggatggtgagggttttgacataggagtgttgtcaaagctttagagtgcatctttcggtcaggtgtaacagcctttcggtcattgagacatataaacgaattagctatt

SEQ ID NO: 49198 - DNA, 97 bp, Zea mays
  Clone ID: LIB3067-050-Q1-K1-H3
acccactcgtccgcatacaccaataccactactatacaacaaattttttctctcacacataaccaaacataagggtcggatttttcaacaatttaac

SEQ ID NO: 49199 - DNA, 360 bp, Zea mays
  Clone ID: LIB3067-050-Q1-K1-H4
gcggaacgcggccgacaagtcggaggacaagaataggtagaagaggtcgtgagcgtcgagaacggaggctctcccacatgcataggagtaactgccagggttccttcctggggtggaagtgtggaactgagcttgaatgttaagaagtgttcctttgttctcttcctctcttgatgactctgtaaatagctatgtcaatctggttaagtttggtttggttgcatgtgcctgtgttcgctgccctttggatagaatgcaaattaaagatgttgctattgcacaaaagaaaccaactttaccaaaaactgaagcataataaagttttacagtttttgagctaataaaaaaaaagggcgccct

SEQ ID NO: 49200 - DNA, 401 bp, Zea mays
  Clone ID: LIB3067-050-Q1-K1-H6
gttgagagagagagagagggatcgagagcgttgcggaggcgatggcgagcggaggggggggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaacta

SEQ ID NO: 49201 - DNA, 435 bp, Zea mays
  Clone ID: LIB3067-050-Q1-K1-H7
gaaggtttggtcggtttgatcgtgagattgttatcggtgttccagatgaagttgggcgcggtgaggttcttcggattcacacgaaaaacatgaagcttgctgaagatgttgacttggagctcattgcgaaggatactcatggttatgttggtgctgatcttgctgccctttgtactgaagctgctcttcaatgcattcgtgagaagatggatattatagatcttgaggatgagacaatagatgctgagatactgaactctatggctgtttcaaatgatcatttcaagactgcacttgggacaagcaacccatctgctctgcgtgaaactgttgttgaagtgccaaatgtctcttgggaagatattggtggcctggaaaatgtaagagggagctacaagagactgttcaatatccagtggagcattcagagaaatt

SEQ ID NO: 49202 - DNA, 410 bp, Zea mays
  Clone ID: LIB3067-050-Q1-K1-H8
cggacgcgtgggcgccgccgctgcagtgtccatagccaccgcaggagactgagatggggggttttgtcaagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcacgtgatatggttcttgcttctgcttactcgcatgagttgccacgatatggtcttgaagttggtctgaccaactatgcagctgcctactgcactggccttctgttggctcgccgtgtgctcaagacccgtggtttagataaggaa

SEQ ID NO: 49203 - DNA, 205 bp, Zea mays
  Clone ID: LIB3067-050-Q1-K1-H9
gacccacacttacgggcacacaaaaacacaaaaacaaaaaatttaaaaaaacacaaaaaaaaaaaaaaaaaaagagagaaatacacacaaaccaacaagacaaaacaaaacaaaaaaaaaaaaacaaaacaaaaaaaaaacaaaacacacacacaaaacaaacaacaaaaacaacataaaacatacaaaacaaaaacaaaaacaa

SEQ ID NO: 49204 - DNA, 355 bp, Zea mays
  Clone ID: LIB3067-050-Q1-K1-G4
cccacgcatacgaggacgcttgagcacacgtttgtctgccgcgctctctggccttgcgtccgccgggctctttcaacccaacggactctcaatgatgtcaaccctcacgagttcggtgttctgcaatgtcatgacctacaagcctgagttcaccgaccacctcacgcacaagctgaagcaccacccctgacagatcgaggccgccgccgtcatggagcacatcttggaacgcagctcctacatgaagctggcgaagaggctcggcgagctcgacccgctgatgaagccgaagcaggacaagtacgcgctccgcaccttcccgcagtggctcggtccacagatcgaagtcatccgc

SEQ ID NO: 49205 - DNA, 61 bp, Zea mays
  Clone ID: LIB3067-051-Q1-K1-A10
tcgaggacctgactgaggaccagatcgcctcgattcgggaggccttctcgctgttcgacac

SEQ ID NO: 49206 - DNA, 419 bp, Zea mays
  Clone ID: LIB3067-050-Q1-K1-E6
agcccgatcccgatccagcgaggcggcgaccctccctcctccccttgcttcgctcgtgcaggcctgaccacccgcatccccgtcagtcatggcagcggcagcaggcggaggcgcggtgcgtgcgctgtcccagaaggagcaggacatacagatgatgctcgccgccgacgtccaccttggcaccaagaactgcgatttccagatggagcgctatgcctttaagcgccgcaccgacggcatctacatcatcaaccttggcaagacatgggagaaactgcagcttgcagcgagggttatcgttgccatcgagaacccgcaggacatcatcgtccagtccgcccgcccctatggccagcgtgctgtcctcaagttcgctcagtacactggcgctcatgccatcgctgggaagcacacccctg

SEQ ID NO: 49207 - DNA, 327 bp, Zea mays
  Clone ID: LIB3067-050-Q1-K1-E7
atgctgcagtagggatctaatttattattctttatagtcgatgagtatgtcgatcggttgttgtacattagtagagctctgcgacaagagcgctgatacaactagcttccttttgccttctaattaaaaggttgaatgtaaattcgtttaatgctgataccagttctgatgatttttgtactggttcctccgattctggaggccagtgcaatttctgcaaataaataagccttctggtgaagcaatggttcttaaaaaaaaaaaaataataaactaaaactaaaaaaaaataatatataaaaaataataaaaacaaaattatataat

SEQ ID NO: 49208 - DNA, 431 bp, Zea mays
  Clone ID: LIB3067-050-Q1-K1-E8
cccacgcgtccgcccacgcgtccgcccacgcgtccgctagtcccctgctccattctgaggggccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagctgtggcccttcaaggtcatttctgggcctggtgagaagccaatgattg

SEQ ID NO: 49209 - DNA, 348 bp, Zea mays
  Clone ID: LIB3067-050-Q1-K1-E9
cccacgcgtccgcccacgcgtccggcgatcgtggcctgaggcggcggggctcttccgatggggtgaggggatggaccctagcctgaaggaggaggtgatgaaggcggtggaggaggcgaggtccgcggcggcgccgcggtgccgggtggtgcggatcatcgtgcacgacgaggacgccaccgactcgtcttccagcgacgacgagggagaggaggcgggggagcgcgccgcggcgcacccgggcgcggcgccggcggggagcgtgaagcgcagccgcgtgctgctccagtccgctgggtgcggggcggaggaggacggcgagggggccaggttcacgggcgtgcggcg

SEQ ID NO: 49210 - DNA, 424 bp, Zea mays
  Clone ID: LIB3067-050-Q1-K1-F1
cgacccagcgtccatacacacagcagcctttttgttctccccgcgagcgcgtctctttctctatcgactggcgacgactccgccaccgccgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccagagaggccgcgagggagggccccagggaagacagatgaggattgcggagtgcttggttggtgatgaaaccggcatcattgtcttcactgcaagaaacgatcaagtggatgtaattaggcctggaacaactgttgaac

SEQ ID NO: 49211 - DNA, 439 bp, Zea mays
  unsure at all n locations
  Clone ID: LIB3067-050-Q1-K1-F10
cccacgcgtccgctctgcaagggcttcggatcccacaccgaggaaaggagaagagagggggggaataatggcggccgaggagggtgccgtgatcgcgtgccacaccaaggacgagttcgacgcccgcatggccaaggccaaggagcagggcaagctggtggtcatcgacttcatggccccctggtgcagtgggtgccagatgatggccccggtgtacgcggactgcgccagcaagtacccttccgcggtcttcctcgaggtcgacgtcgacgaactgctggaagtcgcgaagatctacggcgtccatgtgatgccgaccttctgcttcatcaggaacggcgagacgctcgagagctttgctaccgtcgacgaggacgagctccgggacgccgtcaggaagtacgccgncgctggcactacgacggctcctgcctcggcg

SEQ ID NO: 49212 - DNA, 391 bp, Zea mays
  Clone ID: LIB3067-050-Q1-K1-F12
cccacgcgtccgcgcagacatacgcgtctacgtactcgcctacctccgcggctcatacctgtaactcttgtcccaattccatccagcgatgcatcccgttgcgcgacaccatgagggagtgcatttcgatccacatcggccaggccggtatccagttctgaaacccgtgctggcatctgcactgccttgagcatgacattcagactgacggtcacatgaccattgacaagaccattgatggaggtgacgatgctttcaacaccatcttcactgagactggcgctcggaagcacgtgcccggtgctcttgatgccgacctcgaacccactgtcatcgatgacgcgaacactgggacctaccaccagcacttgcacactgagcagctcatcaa

SEQ ID NO: 49213 - DNA, 436 bp, Zea mays
  Clone ID: LIB3067-050-Q1-K1-F3
cccacgcgtccgcggacgcgtggggcactatcttgctaaggcaaagattctggtggtgaaggacggggagagggatgagatggagttcatcaccaagaccctaaactgccttcccattgccaacattgagcacttccgcacggataagtttgggtatgcagatgttgttgaggaagtctctgttggagagggcaaggttgtgaagatcactggaatcaaggacatgggtaggaccgcaactgtacttgtcaggggatctaaccaattggttattgatgaagctgaacgcagtctccatgatgcactctgtgtcataaggtgcttggtcagcaagagatttttgattgctggtggtggtgctccagaaatagagatgtcaatgcagctggctgcttgggcaaaggagcttcgagggatggagagttactgcatcaag

SEQ ID NO: 49214 - DNA, 439 bp, Zea mays
  Clone ID: LIB3067-050-Q1-K1-F4
agcgaccacccgggaaaacagtgctaccacatgggtataatgggacgcccttggctgactggttgggaaagctagtggaagactaccttacccgaaaggggcaagggcagtaggggagaggtcagtgcggggaggtccctggttgattttgctgcgatggctgtcagccaggaaccctgtactggatcttcctataaactgtagcgggttttcggaagctagtggaactttgtaaaggcctcgtagtggatccctagccattcacctcggtagtgtctaagggccttgcaaacccaggcgacatgggatacacgacttgtgggtaaagatgcgcaacctctgcagagtgtaaaactagtatactagccgtgctcacggtcaagagcggctcggaccctcacatgattaattatggaacttaaaattaatttgacatctg

SEQ ID NO: 49215 - DNA, 361 bp, Zea mays
  Clone ID: LIB3067-050-Q1-K1-F6
gctggcttctcctccccctcttaccaagtttttctcgggttagggttccttagggtggtagagatgttcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggctgcggtggctactgt

SEQ ID NO: 49216 - DNA, 376 bp, Zea mays
  Clone ID: LIB3067-050-Q1-K1-F7
ctgacgcgtgggcggactcgtgggttgcattataagggtaaacccgctagctgagtaatctgggccagctatcatgtatgcttgatactgaccacttacccttgaatctagcggcgcttttggtgagagggtgcaatttactttaaacatggttcgtgacttgctgtaaatagtagtattaatcgattcgggcatctagtaactaaattaagggtgtgtatggttaggcttttgatttctaaacgacaaaagccaaactaaagagctggatccataaaatagcattttctaaaagtcagactttgtggcggtacaaaaaaaaaaaaaataataatattaataattataaaaaaaattatattaaataatatatatt

SEQ ID NO: 49217 - DNA, 427 bp, Zea mays
  unsure at all n locations
  Clone ID: LIB3067-050-Q1-K1-F8
cccacgcgtccgcggacgcgtgggaacgtgtgatttatgatcagtatggtgaagatgccgggaaggaaggaatgggtggtggtgggtcccatgctgatccattcgacattttctcatcattctttggaccctcttttggaggaggtggtggaagcagcaggggaagaaggcaaaggaggggagaagatgtagtccactcacttaaagtttctctggaagatctttacaatggaatctcaaagaagctctctctttcacgcaatgtcatctgctccaagtgcaagggcaagggctcgaagtctggtgcttcaatgaggtgccctgggtgccagggctcaggtatgaaagtcaccattcgccagcttgggccttccatgatacagcagatgcagcagccttgcaacgagtgcaaggngactggggagag

SEQ ID NO: 49218 - DNA, 434 bp, Zea mays
  Clone ID: LIB3067-050-Q1-K1-G1
cccacgcgtccgcccacgcgtccggatgaaatgccgattgcacccgctgcagtggtgtctgggggtcgttccgtgacctatgaggagctgcgagaacgccttcaacgccgcattactgtgcttcgaggcaaccggtgcaccaggcctgagttcttgaataagcccaggaaggagaagggtaagaagtcaaaggcgaagaatgaaaagaagggcaaaggtgagggcatgaagcgtaagcgtgatgatggcaccgaagatgtggatgtcaaggatgggaagaaggtaaagaaggaagctgaggagaagccagatatcatgtacgcaaatgtgtttgttgacccaaaggaagcaaggcgcaagaagaagaggagggttaagaacaagaagaaggcactggagcaggctaaacggttgcaggaagcaaagaaggatcc

SEQ ID NO: 49219 - DNA, 154 bp, Zea mays
  Clone ID: LIB3067-050-Q1-K1-G10
ccgagcgttgtgttgtctgctgttgtcatatttaaattttgtccgacgttaaatttctgtgccactgtttaaacggaacaaataatgatgttgcatgtggctatctttagttatgtggtacttgacgttgaataccggagttgttgtttatcag

SEQ ID NO: 49220 - DNA, 451 bp, Zea mays
  unsure at all n locations
  Clone ID: LIB3067-050-Q1-K1-G12
cggacgcgtgggtgtcggcgtcggcagctacgacagcgagcacactccagtatttcgaagagaacaatcatgnggatccctacaagcttcttggtgttgatcaagatgcatctgaagaagaggtccggagtgcacggaattttcttctaaaacaatacgccggatatgaagaaagtgaagaggccattgaaggtgcttatgacaagataataatgaatagctacacagaccgtaagaaatccaaattcaatctgaaaagcaagctaaaagagcaagttgaaggatccccatcatggcttaaggcactgcttggatattttgaggtgccatcactagagatcatttcaaggagatttgccttttttgcgttctttgccgggtggagcattgcaacttctgctgagactgngcctgcctttcagcttgcgatgtcactcgcctcatgcatata

SEQ ID NO: 49221 - DNA, 429 bp, Zea mays
  Clone ID: LIB3067-050-Q1-K1-G2
cccacgcgtccgcccacgcgtccggaccaggcaaactatattgaatgggagaggataaagcgtggcaacaaatgagagggatatctcaaggtcatagctggtgtggataaaaacatcaatgtgacatcaaagggtggagatgatgagttctcagagctatatacattcaaatggactaccttattgatacctcctaccacctcgcttctattgaacttcattggtgttgttgttggcattttgggtgattgcattacctcccgaggcactgaggtcgttctcaatttatttggtagtgttgacttgatccttggcggcaacccctggactggtctttgagttgcagcagagcgttgtcactaggaacgccatgatacacgagtatgcgtgcgacaacgcggaggctcaggagtgggcgttggagttgtt

SEQ ID NO: 49222 - DNA, 361 bp, Zea mays
  Clone ID: LIB3067-050-Q1-K1-E5
ccgcaaggggtggtggcagaagtacaactacgtgctctcggccgcgctcgacgccgggacggccttcatgggggtgctcatcttcttcgccctccagaacgcgcaccacgagctcaagtggtggggcacggaggtggatcattgcccgctcgcctcctgccccaccgcgccgggcatcgccgtcaagggctgcccggtgttctgaatcttccgagacctgagcgtagtaagcagtgtgtgtaacagtgtaaggaaatgtttgctacgggagccatggattcaaccaagcatcgattaaccgatgcagtgctttgtcactcgtgaatgtaacaccatagcgccagtggtggattcagatttc

SEQ ID NO: 49223 - DNA, 427 bp, Zea mays
  Clone ID: LIB3067-050-Q1-K1-C3
cccacgcgtccgcccacgcgtccgcccacgcgttctgagaagagcggcggcgcgggcggacaaggagcatgcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgtcccattc

SEQ ID NO: 49224 - DNA, 180 bp, Zea mays
  Clone ID: LIB3067-050-Q1-K1-C5
ggcagctgagtcataatgttgccaagttcatttttgcactcccaactgtagattactgcagttcatctgtaaatttcaatcttgttcaagaagaatgatcatatattggcatgttttttcttagcagttgtataaaaaaaaaaaaaaaaaaaaaaaaaaaaaaaaaaaaaaaaataaaaa

SEQ ID NO: 49225 - DNA, 434 bp, Zea mays
  Clone ID: LIB3067-050-Q1-K1-C6
ggtgctctgaacgttgatgtgaacgagttctagaccaacctggtgccctaccctaggatcgacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtgcggaatcaactaccagcctcccagcgtcgtccccggcggtgacctggccaaggtgcagcgtgccgtgtgcatgatctccaactccaccagtgttgtggaggtcttctcccg

SEQ ID NO: 49226 - DNA, 429 bp, Zea mays
  Clone ID: LIB3067-050-Q1-K1-C7
cccacgcgtccgccaagaaccacagccaccgtgatggcgcagatcatcgatggcaaggccgtcgccgccgacgtccgccgcgaggtcgccgccgatgtggccgcgctctcgtcggcccacggactcgtgccggggctggccgtggtcatcgtggggagcaggaaggactcgcagacgtacgtgaacatgaagcgcaaggcgtgcgccgaggtcggcatctgctccatcgacgtcgacctcccggaggacatctccgagaccgcgctcgtcgccgaggttcatcgcctcaacgctgaccccgccgtgcacgggatccttgtccagcttccacttcctaagcatatcaacgaagagaagatactgagcgagatttccatcgagaaagatgtggatggcttccatcctctcaacattggcaagcttgcaatg

SEQ ID NO: 49227 - DNA, 433 bp, Zea mays
  unsure at all n locations
  Clone ID: LIB3067-050-Q1-K1-D1
ggaaggaaatgagttgcctcgcctcgtttatgtctcgagagaaaagaggccaggttataaggatcacaagaaggctggtgccatgaatgcactggtccgtgtctccgctgtcttatcaaatgctgcatacctactgaacttggactgtgatcactacatcaacaatagcaaggccataaaagaggctatgtgtttcatgatggatcctttggtggggaagaaagtgtgctatgtacagttccctcagaggtttgatggtattgacaaaaatgatcgatacgctaacaggaacgttgtcttttttgatatcaacatgaaaggtttggacggtattcaaggacccatttatgtgggtactggatgtgttttcagacggcaggcactgtatggntatgatgctcctaaaacgaagaagccaccatcaagaacttgc

SEQ ID NO: 49228 - DNA, 148 bp, Zea mays
  Clone ID: LIB3067-050-Q1-K1-D11
cacacatctaaccacacactcccaaccaacaaccacagccccctccatacaccaatcatataacaccaaacctctaaaccatatacatctaaaacacctccaaccacaacaccctccacaaaccccaaccctaccactacataaacac

SEQ ID NO: 49229 - DNA, 64 bp, Zea mays
  Clone ID: LIB3067-050-Q1-K1-D12
cccacgcgtccgaaaaaaaaaaaaaaaaaaaaaaaaaaaaaaaaaaagacaaacaaaataggga

SEQ ID NO: 49230 - DNA, 437 bp, Zea mays
  Clone ID: LIB3067-050-Q1-K1-D2
gttccttctgtcagtggtggtgactgggcatcttttgattcttttggccaacaacaaacaggagcgaacaagcagcagtgtaaatcctcttgagtctgcacttgcacagctgtcattctctgaagcaccctctgcaccaaatgtgtcagcttatcctgtttctcttgatcccactttgaaagcaaatgatggaggacattcatctgtgctagaccagtcacattccttgtttgatgcgccctttggaatctcaggcaaccaggcctcaacagtaatgtccggccaaggatcatcagttcaacaatctcctctagctgccccaacagctggacctccatctcaagctactgcaaatccacaaggaaccagtggtattcaaggagcagcctcttctactgacagtaaattctgtagcaggaaagaacttccagcggata

SEQ ID NO: 49231 - DNA, 283 bp, Zea mays
  Clone ID: LIB3067-050-Q1-K1-D4
cggacgcgtgggggaaaatggaggagcatatacctaaggagcagaggcccaaggctaacgggaagaagcctgtgatgaacgaatgaatatctccagaagctttgttcaatgtgcaaccaagtccgatgtccgtctgctctggtcagcttaaaaccaacgcttccaataatcctattggtgtcttagtttccccttatagtgttatttgctcggcttgaacatggcaacggaaatgaaacttgaactatggtactgtcatcaatttgagacccccatgattgac

SEQ ID NO: 49232 - DNA, 373 bp, Zea mays
  Clone ID: LIB3067-050-Q1-K1-D6
cccacgcgtccggatggatttgcttgtgatggaaaatcttttgtttggacggaatatggcgaggctctatgatctaaagggatcttcaaggtcaaggtataatgcagattcaaatggtagcaacaaggttcttcttgaccagaacttaattgaagcaatgccaacttcaccgatttttgttgggaacaaggcaaagcggctactggaaagagctgtttggaacgatacatctttcctagctggaatcgatgtgatggactattccttgcttgtgggagtcgacgaggagaaacatgaactggtcttaggaattattgattttatgaggcagtatacatgggacaagcaccttgaaacatgggtaaaatcttct

SEQ ID NO: 49233 - DNA, 450 bp, Zea mays
  Clone ID: LIB3067-050-Q1-K1-D9
gtcccccgtcacagtcccaatcgcaacccccgcctgcagcacgcgtcacgccacgccggctgtccccagggtccggcgatgtcggcgccctccgacgccgcggtggcagccgcagcgcccgcatccacgaccaccgccgccgcctccagcggtgggctcaccttcaagctccacccgctcgtcatcgtgaacgtctccgaccaccacacccgcgtcaaggcccaggccgcctgctccggggacagctcttccccctcctcgtccgccccgggggccgggcagccgccgagggtgttcgggtgcgtgatcggggtgcagcgcggccggaccgtggagatcttcaacagcttcgagctcgtgctcgaccccgtctccggaaccctcgaccgcgccttcctcgacaagaagcaggagctctataagaaggtgttccccgacttctacgtgctc

SEQ ID NO: 49234 - DNA, 431 bp, Zea mays
  Clone ID: LIB3067-050-Q1-K1-E1
cggacgcgtgggcggacgcgtgggcggacgtgtgtgtggaaaagaaagattgtttatggaggtggctcgtttgcttcagaagaaagtatatgttggagctgcaaagctgcaaatactgaaacatttagagcttcctcaggagattatgcactggtttacagccaatgaagcagaaagtcacatacatgttgtccccatgtggactctagcaagcttcaagcggatgaaatatctatcgaatcaatatgctggccggtatgaccttatagtggcgttttgtcctactggttgggcatttggcaaaggtaggaaaaagacaccaggcaaaaggtggcaacaaggatcaatcattagatatgaagtgccctacagtgaacacagcagtttcacggaactgcagcagtttgtcaagttcatatcaccagagcaca

SEQ ID NO: 49235 - DNA, 411 bp, Zea mays
  Clone ID: LIB3067-050-Q1-K1-E11
cccactgactggtatattaacaaattgggtgaagcgaagattggcagccatggcttgggaggtatatttgcttgatgtggtcagccatgccttttgagttcttctatgccatggcagcagagctggaggagcttatgtcatgtgcagttgccgcatgcgccaatgctcctgtgtttgtaaaggtcggagctgaggtgctgcggctatcatctgggtccgcgataagttaattgtactgatagttgatatctaactactattttgtgtatcaaatgaaaatgttggaactaaaggatcggatggtataggtgtcttatgaacctgttctggctggcaaaattaaccagaaatatggatttgccaaaaaaaaaaaaaaaaaaataaatataaaaaaagaacaatatatataaa

SEQ ID NO: 49236 - DNA, 430 bp, Zea mays
  Clone ID: LIB3067-050-Q1-K1-E2
cccacgcgtccgagtgtccttcctccatcttccttctccactccactcccaagtccccagggccgcgcaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcaacacaacgtgggaaccttggggggttgtcaaac

SEQ ID NO: 49237 - DNA, 354 bp, Zea mays
  Clone ID: LIB3067-050-Q1-K1-C2
cccacgcgtacgcccacgcgttcgcccacgcgttctgggccagaggcgcagaaggcagtcgggggcatgaggaagaggaagaagaagcggcagcgagcgaggatgccgtgcctgaacgtgtcgaccaacgtgaacctggagggggtggacaccttcgccatcctcgtcgaagcctgcaagttcgtagccaacatcatcggtgagcccgaggtctacgcgatggttgttctcaagggttctgcgcatatggcatttcgaggttcccatgagccacaagattacgcgcagctggcttccatcggactgctgaaccctgagtgaacaagaggcttaacgatgaatctgctatatcct

SEQ ID NO: 49238 - DNA, 105 bp, Zea mays
  Clone ID: LIB3067-050-Q1-K1-E3
gaaatttaacagcatgaacgacgactgttcataccggctcttgatttcgtggttagtgacgttgcaggtggtttgagtcgcgctacacgctgtacataccttttg

SEQ ID NO: 49239 - DNA, 423 bp, Zea mays
  Clone ID: LIB3067-050-Q1-K1-E4
cccacgcgtccgcacaggctcaccccaccatcagcaagcgaaaatctcccgatcccctcgggtcggcgcggcgaagatgtcggggcgcggcaagggcgggaagggcctgggcaagggcggcgcgaagcgccaccggaaggtgctccgcgataacatccaggggatcacgaagccggcgatccggcggctggcgcgcaggggcggcgtgaagcgcatctccgggctcatctacgaggagagccgcggcgtcctcaagatcttcctggagaacgtgatccgcgacgccgtcacttacaccgagcacgcgcgccgcaagaccgtcacagtcatggacgtcgtctacgcgctcaagcgccagggccgcaccctctatggcttcggcggctaggctaggccggccctgcctggctgtcgtcgctgcgg

SEQ ID NO: 49240 - DNA, 353 bp, Zea mays
  Clone ID: LIB3067-053-Q1-K1-C3
aggactcctgggtgcagctgcagcgtcagcagcaagtactcaaactcgctgctgccgatactgctacgtgggcaatggcgcctcccgacactgtcgccccatcatgcttctcttctcctgtgcttacacggtctccatgactgcatagcacttctgtatcaactgggcaacctgacgttgtcgctgaacctaactcgatatgcaaacttcaggctcatctcctcattgccagcaggcactctcttaagcgtttccttgcgaaacgcctcgtccggatcttcaggcaagactccatacgcagcgctaagtcattcgatggcatggagtcaccgatgattgacgtgacatgctta

SEQ ID NO: 49241 - DNA, 299 bp, Zea mays
  Clone ID: LIB3067-053-Q1-K1-C4
gatgtgtcccgtccattcctttaggaggagccggatccggcgccgcagtcgcgcaaggtcgcgaccgccgcggcctcggccgccgccgccaaggagcggaaggaggtgcagcggcggaagcagcgcgacgaggaaggccttcacctgctgacgctgctgctgcagtgcgcggaggccgtgaacgcggacaacctcgacgacgcgcaccaaacgctgcttgagatcgccgagctggccacgccgttcggcacctcgacccaacgcgtggccggctacttcgcggaggccatgtcggctcg

SEQ ID NO: 49242 - DNA, 303 bp, Zea mays
  Clone ID: LIB3067-053-Q1-K1-C5
gcgcccacgcgtccggaagcagaggagagagcatctagctagcgctgtcagacggggctgcctcgccaccgaccgctcgcgaagagatcgatggctcatgctgctacgctcgctgctgcaaccgcagacggcgtcctaatcggcctctgctgctgctccgtttccgaggccgacagcaacagcaccaacacgaggcacgcgtcgatagcccacggcctgtccttggactatctacaaacggatctggctcatggccgagtgcggcacgcggatgttcgagcaagacaccctgcgcatggacac

SEQ ID NO: 49243 - DNA, 483 bp, Zea mays
  Clone ID: LIB3067-053-Q1-K1-C7
cccggtcgacccactcgtaccgaatcgccaagtcgaagaaccactctttttgtttgtcagttagttaaccaatttcttaacaagctggcttggtagagttctataccgcagaagccctccttgcgctgcaagaggcagcataattccacttgatagaactgtttgaaatggcgaatctgtgtgccatccatgccaagcgtgtcacaatcatgcaaaatgacatacaacttgcaaggcgtatcggaggaaggcgttgggcatgatatataatatccattctgattgcatcattcttgtgaatttgtttgtatgagctagacattagtgttgttgaatgctgcatggttcctaatccttttcgcagtctaacatctgtggagttagtatgttacatggcaacagctgaacatctgtggactataactatatggcaacatccgaagattgtgtctgtgggataactggttgttttggttgctcttc

SEQ ID NO: 49244 - DNA, 326 bp, Zea mays
  Clone ID: LIB3067-053-Q1-K1-C8
cggacgcgtggtcggacgcgtgggcggacgcgtgggcggacgcgtgggcaagcaaggtatgaaggctccatgattgtagtgctggccagcagcgtaaattgtgaattctgcatttttttatacgtggtgtttattgttttagagtaaattatcatttgtttgaggtaactattcacacgaactatatggcaatgctgttatttatacgcaaagactgatacattcttcggattgtgagcaaacagtcagaacactgtaatctcttaggacaactatataaggcagctgttgtatcaaaaacaaaaaaaaaaggatttataataaaa

SEQ ID NO: 49245 - DNA, 413 bp, Zea mays
  Clone ID: LIB3067-053-Q1-K1-C9
tcgcccactcgtccgctcttctttttttaaaaaaaaaacttcaccagctctagatccacactgttgcatgagtacagaaagtcattggcttcgagaggtagcgtggtcagccccaaaagatttgtgatgacaactcaaatatgagcttcaacatgctctcctgaagctcgaagcatcaaaaggcttcaacaacacagtaaaaggtggaaatgcaaattttttctttggagagagactaactactggtattgagttcttcatgtgcgaatagattgcaatttataacagtttattgcttactggattagcatcgtctaatcagatctggcttcaagttacttagaagtcttacagatcacagtgtccagtgattgtacaacctttttctttttaatccctgttcgatttgtttc

SEQ ID NO: 49246 - DNA, 368 bp, Zea mays
  Clone ID: LIB3067-053-Q1-K1-D1
cccactcttcctaccatggttacccactatctctttatgatcctggagtacgactccaagctccgcctcatggagcacctcaagcacctctccagcatccacctcaccatcctctcctcccagatcactcaatcaactgactatgcatatctcgtgagccatcaaccatttctctcaaccatgaacctagttctgaatcctgatatgctgatctagaagcgtttaaatagcatcctattgtctctcaactttcatttcaatcaattcaatgtatttgtcaaggatcagctttcgctttatgttgattattattattgcaatgctccaatcacgaccttcatcatctatccattttatccacattatca

SEQ ID NO: 49247 - DNA, 446 bp, Zea mays
  Clone ID: LIB3067-053-Q1-K1-D10
gagattttggactacgattcgtgcaaaacactaaaaaagaaaaggccatcgaaaacgccgccggcgcctctgatgctttccgccgtgcgatgtggtgcccttcgccggtggcgcccgccgccgcacctcctcccacgcatcctttcctcctcctttggtacatctcccgcgcgaccacaggtgggggcgctgctggagctcccggaggtggagaaggtactgcgcgacgtacgagcgggtgacgtgcgcgtattccccgtcggcgagagcggtctgcacggcggggcctgcgccgactacatggtcgtcgccacaggccgctccgattggcacgtccgtaacatcgcgcatgcgctcctctacaagataaagcataagcagaagggctctgatagaatattgatgccaagtgtagaatgtcagcaagccgggaaaatggggtggca

SEQ ID NO: 49248 - DNA, 57 bp, Zea mays
  Clone ID: LIB3067-053-Q1-K1-D11
tgttatcttctactaccactcctgttcgacttctggttcgtaaggttctccgaaatt

SEQ ID NO: 49249 - DNA, 440 bp, Zea mays
  Clone ID: LIB3067-053-Q1-K1-D2
cttgtcgggagccaaatatacggtcctctatgcgtcccaaccgtctggtttgctggagaggccttcgggcctgccgctgggtaggcatctcgcggagaagaagactaacggcacgaaagctgtccagggcgaaaaatgcgatggcgagtgcctcgtcaaatctagtctcctcgaaggaactttcgttgggatagtgcttctcatcatcctgatatcaggactcatgtgcatgatggggatcgatactccctcgaggtttgaagctccccaggagtcttgatctctcccttggactgcagaatccgcgggggggttgtgacgagggcacgcggcggcgttgaggggggccggtgttctgttggtctgcactgtggatatatatccgttagctttccatttggaaggtaggacgccttgtgtatttttttgtaccgagccaa

SEQ ID NO: 49250 - DNA, 378 bp, Zea mays
  Clone ID: LIB3067-053-Q1-K1-D3
gcggagacaacgaaggcctcctgcacctaccaaatgacatagccctactatttcatccatcgtgtcatcgagcacttgacacatacgcaccgcacgaagatgactactctgctcactacgaccaaggcactacctgaagctttcagaatctgtgatatccatcaagccataaagtgagagagaacgaaccataatagtgtgctggtatgccgtccgccaacccgcctagatatcttcgcttgtctgctctcaaccttgaatgaaaatctgatgaactctgctgaaaatatcgtctgtatgttgacatggatcatgattctatggtatctatctataatatctgtctcataagctttgatatgaagcgtgatctggttc

SEQ ID NO: 49251 - DNA, 312 bp, Zea mays
  Clone ID: LIB3067-053-Q1-K1-D4
tcgcggacctgggcgaccgtggggaaatattcactttaagggatattaaggctacagaagacctaagtggtcatgccttcctatttttggctgacatgtgagttttagatatctctctcatttattcaacgggagtacttgaaaacatatccacatgctagtatattgatgatgcaaaaccatggaccagcagtgtgatgttgcatttccttgtgcatcacataatgagattgacaaggggaggctgttgcaatcagcaactttgttgctttcttgtcagtgtcaaatttgtctgcctgctaagctttgatt

SEQ ID NO: 49252 - DNA, 331 bp, Zea mays
  Clone ID: LIB3067-053-Q1-K1-D5
cactccctcctccgtcgctatggcgcgcatgaagatccgggagtacgactccaatcgccgtgctatggagcacctcaagcgcctcgccagcatcgacctcaccatcctctccgcccagatcacccaatcaacggacttcccgaacctggtaaccaaccaccattgctttcaaccattaacctagtggtgaaacccgatatgctgttctggaagcctgcgaagagcagcctttttggctttcaacttgatattaattcaatccaaggatttttcaaggaaccgctttgggtttaagttgagattggttgcttcaaagctccaatcacgacct

SEQ ID NO: 49253 - DNA, 299 bp, Zea mays
  Clone ID: LIB3067-053-Q1-K1-D6
gtggtcatccttggggcttggagtctttggaaacagagaaatagatgtgtttttgatggagctcggccgtgcctttctactttagaggatggattcaaagatgagatgtggatgtggttttctgcaggagccaagaacatgtgctccctttttgaccctggttagagaaaggaaagtcttgtagcctcttggtaggctggggtggtggtgtgtcgtgtggctggtacgtgttagcgtgtgtgtgttctattcgtctgtgtatgtttgcaagtttttcttgaatctttttatcttttttt

SEQ ID NO: 49254 - DNA, 445 bp, Zea mays
  Clone ID: LIB3067-053-Q1-K1-D7
gcggagagaaggaaggccttctgcagctaccaagtgacaaagccctcctctctgatccatcgttccgccgacttgttgacaaatacgcagcggacgaggatgctttctttgctgactacgccgaggcccacctgaagctttcagaattgggatttgctgaggcgtaaagtgagagagaacgaaccagaagagtgtggtggttgtcgtcggccggcaggccttgtgtttttgttgtctgcttttctcttgaatgaagatgtgatgaactctgctgaagatgtagtgtgtatgttgtcatggttcatttttctattttatgtatctataatatctgtcggagaagctttgatatgaagcgggatctggttcggaacaaataaaattgaattatatttattattattatttaattatttttatttattttatattattttattttttt

SEQ ID NO: 49255 - DNA, 316 bp, Zea mays
  Clone ID: LIB3067-053-Q1-K1-C10
cctcattcccggtcgaccactcgtcctaaaaaacaaacaaaaaaaaaaaaaaaaaaaaattaaataaaaaaacaaaaaaaaaaaacaaaaagaaagaatacaaaaaaaaacaagacaaacaaaaccaacaaaaaaaaaacaaaaaaaaaaaaaacaaaacaacacaaaacttaacaaacaacacactcacaacaaccacgaaaactcaaaactcttcaacaacacacaaaaaaacaaaaataccaaatttctctatgaccacacactaactaatgatatccaactctccaccaccgccaataatgcaacccacaac

SEQ ID NO: 49256 - DNA, 452 bp, Zea mays
  Clone ID: LIB3067-053-Q1-K1-A6
cccacgcgtccgcccacgcgtccgggagctgggaaccgagtatctggttcagcctcttgggcgggctgaagacgaagagcactcgagcgactttgaaccggaagaaaacggtgagggtgccgacgatgaggagatcgatgaagaggacgatgacggtgaggactctgtgaaggcgcagacctctacgaagaggaagaggtcaggcgacgaagaagaagaagacgacgacgatggggatgatgatggtgacgatgatgacgatgggaggccaccatcaaagcgatagtatggttagctctagttttgtagctgtgtccttgggtgtttggtaggtaggtagtgctgctgatgttggtttagaagaactcatcatcacctgggatatgtgtgtgatttggcttggccgatggatgaatgatgaaggtcttgtactaaaaaaaaaataaataaaa

SEQ ID NO: 49257 - DNA, 412 bp, Zea mays
  Clone ID: LIB3067-053-Q1-K1-A7
acgacgaagcgcactaagaaggcaggaattgtttgcaaatatggaaccaggtatggtgctagctggcgtaatgaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgtcgcctgagggagcatactgaagcatgatatagctctttatattattggggtttcctgtaattgctcttgtcaggcatgttgtgggggccttctctagtggaaatgtggaatcactgtactggctgttttgccgagacaatgctccttatatttggtttat

SEQ ID NO: 49258 - DNA, 432 bp, Zea mays
  Clone ID: LIB3067-053-Q1-K1-A8
caaaagaggaaggtcttgcttttgctgaagaatatggatgtctgtttcttgagagcagtgcggaaacacgagaaaacgttgagaaatgttttgaggaacttgcattgaagattcttgaggtgcctagtctcctagaggaagggtcttcttcggttgtcaagaggaacatcctgaaacagaagcaggaaagtgatgcaaagaacggtagtggatgctgtcaatagatgtatgtgctgatccacaccacacggttggctttcttcgtgtgagctgccctgattgtctgctgtacatgttcttgtgagtaagaagggcgagcataattgatttgtacaaaggacatgtcagtttggtgtcatagttttcctcatctccagtttagtatagcaattttgttgtcgccctatcaaaaaaaaaaatattatttttttt

SEQ ID NO: 49259 - DNA, 356 bp, Zea mays
  Clone ID: LIB3067-053-Q1-K1-A9
cccacgcgtccgcgaggcccacgtcacctggcccgaaggacacaccaatcgagctggctcaggagaagacctacgatgaaaaggctgggatcggtatgcccgatctatagctgcggagagttcactgtaatgtgaccaggacctgactccctgtgctgtgctgtgctgtgcttcccgcgtaataacggtgtactagttaccttctttgcagaaaatgctttctaggaatgagagcggaaatatttctaccatttatttaaggtcctgtttggaaacaacccaacagtttttaagacaccagtttttatcttttagctttgagagaccaacttcttgtttttatgaaagtgggaatc

SEQ ID NO: 49260 - DNA, 414 bp, Zea mays
  Clone ID: LIB3067-053-Q1-K1-B1
acgaagcgcactaagaaggcaggaattgttggcaaatatggaaccaggtatggtgctagctggcgtaaggaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaagcatgttgtgggggccttctctagtggaaatgtggaatcactgtactggctgttttgcccagacaatgctccttatatttggtttatgctct

SEQ ID NO: 49261 - DNA, 447 bp, Zea mays
  Clone ID: LIB3067-053-Q1-K1-B10
ctactagtttatggacatcatttaagagttaatactgaggttgttgtttagcataagctcaggcaggctaatgttacaaaggtgaatatttttcttgaatacatgtgcattttcatgtctttaactctagatagatgcttgttgatgtggtaaagctgttgatccttatcttgctgattattatcaaaatttactcatgaccagtccatacttcatagcaggtatctttcataaaaggtttgtccttttgttccattggagaagtactaaaatgcacaggtatctaccgtgttccatctgccaagacaccaacgttcaacacaagcagcagttcagatagaccaccatcatcacaattgctcacaggatcatgtcagttcttacatccacatggtgttccttcttgataacggttagtgcctaccatggacagcggctagtacttgc

SEQ ID NO: 49262 - DNA, 326 bp, Zea mays
  Clone ID: LIB3067-053-Q1-K1-B11
cccacgcgttcgaccacgcgtccgatagagcacacattcgagtgtaaaccatccaaccaatcgtgtgttcgagttccaggagctcccgaaacctgaggtgccgcacccagtgccggagctgaccaagcccgaggtgccacctcacccgacagccgtccctaatctcccgaaacctgaggtgcctcatccagtgccggatctgctcaagcccgagctgacacctcacccggcggccgtgcccgagctgccgaagcctgaggtgccgcacccaatgccagagctgcccaagcccgaagtgccacctcacccgacagccgtcccggatc

SEQ ID NO: 49263 - DNA, 389 bp, Zea mays
  Clone ID: LIB3067-053-Q1-K1-B12
ctttgtgattctgaagaagaacccagagtaccacgaagagtgaagacccagatagcatattggtgtttccgaggcccgtccagataggcagcctcgaatttgcgcggccttggatatctatcttctttcttgctcagcggcagcgccatcctgggcctctccttcctgggtccgtgtccatgtttgattcttatcttaccggagctgtggctaactgaaagagctgtctttggttggcttaacttgtagtacgaccgtatttattaattactagaagacgtttatagagcttacgatgtacggcgaggtgatgacatggtggcatagcgtagtgtaatttttttttggcgttcgtctcggccaaaacatagcatacatagtccttggtt

SEQ ID NO: 49264 - DNA, 448 bp, Zea mays
  Clone ID: LIB3067-053-Q1-K1-B2
tcggacgcgtgggtcaacacagctcaggcagctcgagagagagagagagagaaggatgtcggggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggtgctcgcaatcaagcactccctcggccagtcccacccggtcaagctcgcgcctttcagcccggaccaggaagacgcgtcggtgctgtggacggagagcaaggacgtgggcaagggcttccgctgcatccgcatggtcaacaacacc

SEQ ID NO: 49265 - DNA, 405 bp, Zea mays
  Clone ID: LIB3067-053-Q1-K1-B3
attcagcaactactgcattaacagatttcgtcttccaggcagccgtgccaaagttcattcagttgcgtggggacccagctagcagcagcactcttgctgccagcgtaaatgtgtcagtcacacacagcctcagtgtccctaacaaccagcgtgggcagaaaccactggcaatgcgtatcccgatgtcttacaaagtgaatggagaagacaggctggagcaagggcacatcagcaactgtccttctgggttgtagtgccacctgtgtctattgagttgagagtgctcgatcagcgtgctacaagcatagcgtgtgtgttctagatctcgaacatttgcacgtgtgcgtgcgcgctaatgggttgtgtacactggtaattggtttaggtcgcccattctcttttata

SEQ ID NO: 49266 - DNA, 130 bp, Zea mays
  Clone ID: LIB3067-053-Q1-K1-B4
tcccacgcgtccggagctagcagctcgctctgtcctgcaacaatggccgctctggcctcctggcagcatctggtcgcggcggcggtcctggcaacggctctgctgctgctggcagctggggccgggaccg

SEQ ID NO: 49267 - DNA, 342 bp, Zea mays
  Clone ID: LIB3067-053-Q1-K1-B5
ctacccacgcctaccgacgcagtcgcactacgcatgcatgaattccttccgtaattgctaccagatatcgggctcgcaggcgttatgagatcaatatcactgctgtatatgaccattccatgtacaccagccagttctgcatgaagttagctgctctaacgaccgctatatgcagtttctgctgcaaagcctaatccaaagcacaggctgcgtgtgcttacaccatgaacactgctagtgcggtcaccgtcaggagcacgatccgtcgtctgagggagcagactgaagcatgatatatctctttatattattggggtttcctgtagttgctcttgtcaggca

SEQ ID NO: 49268 - DNA, 445 bp, Zea mays
  Clone ID: LIB3067-053-Q1-K1-B6
cccacgcgtccgcgcagaagaaaccccagagtactctgatcataggaagaaattctggtctgctgtcaagcctgcccattttggcgtgaagatcgcctccagatccctgctgatccttgtgcgcttcatcttcaccggaatcttcatcggcctgctcgccaacttctccttcggcaggtccctcctgctgaagtaccctgagtttttctccgctgggctgttcagcagagccggcccgaccgaggaagaggtgaagagcgcctcgttcaagatgtggtttgtcggtcacggctacagcaacgtggatagctcgttggagctcggaagaagcaagccggacaaggaggtgatcaccaaggtttcgggacccgaggtcggttacgtcacaactccgatcgggctgtgtcagtgcgctcttgtcctgctgagccagcgtgccaacctg

SEQ ID NO: 49269 - DNA, 345 bp, Zea mays
  Clone ID: LIB3067-053-Q1-K1-B7
cccacgcgtccggctacctcggcttccaaaccatggccgcctatcctacatgtggtgcctgcggagccgcttaggccagccggtcgggccagaggcatatccttgcctgggatgatctatctggtcgcgcgaggggtcgaaagggacgcttgactattgtcagcgcgggacgcaatgctttcagctgtgaaattattattcaggcttgaactaaaggtactgtacgaaggtcctacagtaatattattgaatcagagagaactgagtttagagggcaagaggaacaagaactgagtttagggtgaaagaggatgattacaaacaaatgaacgtgagagtgagcag

SEQ ID NO: 49270 - DNA, 466 bp, Zea mays
  Clone ID: LIB3067-053-Q1-K1-B9
gcccatgccatcaagtggcccagtaactggtccaactacaaacctgaatattgggatggactattgggccaacacagcaagctctgctcctgtaattcatggcaaagtgaccccaacaacagttccaggggctgtggtcccagcagagcaatggatacaggatgaacgtgaactcaaaaggcaaaaaagaaaacagtctaatagggagtctgcacgcagatctaggttgcgtaaacaggctgaatgtgaggagttggctcaacgtgctgatgttttaaagcaggaaaatgcttcacttagagatgaagtaaaccgtatcagaaaagagtatgaggaacttctatcaaagaataattcactaaaggaaaaacttgaaagcaaacaacacaaaactgatgaagcaggacttaacaacaagctgcaacattctggcaatgacatccagaaaaaaggaaactaatcgagc

SEQ ID NO: 49271 - DNA, 378 bp, Zea mays
  Clone ID: LIB3067-053-Q1-K1-C1
ctcaaagttggttcacgccaaggaacttcttatggaatacgtggatagggaaaagaagaatgctgaatagagatcggaagcccccaaaccgaacgaagctttcacataattcgatggatacctttattccacaaggcattataatcagccctttgcagaggagagtttcccaggataacagaattaacagtaacatctggaccgtgttgataaaccaccaaatgttcccctatcatcacagacgtctttggctgctcgtcgtgtgatgtatcattctgccgtacaaaaggatccagatcattcttactactggacagatatttgtattttctcatatgtcttgaaatcaaatttatacattttctgtgtctatgggtc

SEQ ID NO: 49272 - DNA, 142 bp, Zea mays
  Clone ID: LIB3067-053-Q1-K1-A5
cccactcgtacccacgcgtccggagagaccagaaacacctgactatggctcatcttttcgacaagccatccttccggagaccggttactcttgataaagactacatctcaatctcgcatgtcaacacacatctgcccatcct

SEQ ID NO: 49273 - DNA, 314 bp, Zea mays
  Clone ID: LIB3067-052-Q1-K1-G7
cggacgcgtgggcggacgcgtgggcggacgcgtgggcggacgcgtggggaagatcacgagaaggatgtcctattagttggtgatgacccatgggaggacttcgtgaactgcgtgcggtgcatcaggattctttcgccgcaggaagagaggcaaatgaggctggccagcgactacggagacagctttgttggcaaccaagcgtgcagcagctcggacggaggtcgcccgtggagtggcaccggcgactagaaatagcaggcgatgtctgagcacaaatgtttggtataatccgtccaacgattgcaagaaaatga

SEQ ID NO: 49274 - DNA, 455 bp, Zea mays
  Clone ID: LIB3067-052-Q1-K1-G9
cgcagaagccagaacccctcgtctcccggcgcctgttccccgcgcgcaccgcggctacacatgccctctccccatcccatttcccagatcccaccaacgcagcgcagggatcgagtagcccaccaccccaccccgcgacgctaaccgacgcaatggcgacgctcaccgttccttcctccgtcccggccgtcgccgaggactgcgagcagctccacaaggctttcgaaggttggggcaccaacgagaagctgatcatctccatcctggcccaccgcaacgccgcgcagcgccgcgcgatccgccgcggctacgccgaggcgtacgggaaggagctgctccgcgctctcggcgacgagatccacggcaagttcgagagggcggtgatcctgtggacgctggaccccgcggagagggacgcggtgctggcgaacgaggaggcgaagaagagccacccc

SEQ ID NO: 49275 - DNA, 231 bp, Zea mays
  Clone ID: LIB3067-052-Q1-K1-H1
gcctgcagggcgatcacgttgctgaacagaagttcggtggcggtggctatggaagtggcggtgggtgctgaggctacggcggcggtggaggaagaggtggtggtgggtatggcggtggcggcagctgctgcggcggtgggtacggaggcggtggcggctacacacccggctactctggcaccggcacctgcgactactggaagagccacccggacgccatcatctcgtgca

SEQ ID NO: 49276 - DNA, 339 bp, Zea mays
  Clone ID: LIB3067-052-Q1-K1-H10
agacaatcaatcatggctcacccgcgcagtgtcgctgccgctgcccccctcctcctgctgcgtcgtccgccgccgccgccggcgcagcggggctcgtgtccgccgcgtcgccggcagccagcgacttcgtccgcaagtcgtgccgcacgacgcagtacccgtcggtgtgcgagcagagcctggcgtcgtacggcgggtcgccgccgccgcggagcccgcgggagctggcgcgcgccgcgctgtcggtgagcgcggaccgcgcgcgcgcctgatctgcatacgtggtccgcctgtgctaatccatctgcggcatatgctcgaagaaagtttttgggaacg

SEQ ID NO: 49277 - DNA, 611 bp, Zea mays
  Clone ID: LIB3067-052-Q1-K1-H12
cccacgcgtccgcccacgcgtccgacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccc

SEQ ID NO: 49278 - DNA, 229 bp, Zea mays
  Clone ID: LIB3067-052-Q1-K1-H2
agagaattgacaaacctagtaattttctgcatgttcttgttcttagctattgactagggctagggacagtcaaagaacttggtaacattatgtgttaatccagatctaactaaatccactcagaacctggtgaacattaaacatgggaattctatacatcagcaaacaaggttaactagtaagtgatagcatgcaaccaaacagttatgctcccaataatacaaatgtt

SEQ ID NO: 49279 - DNA, 352 bp, Zea mays
  Clone ID: LIB3067-052-Q1-K1-H3
cccacgcgtccgcccacgcgtccgcccacgcgtccgcccacgcgtccgattatccttatgctttggtctttcaattgctttggcatcaagtggcattgtgccagcatttacggaggatgtcgctcgatctgtaaacgttgtacatgtcgtcgataccacaggagtacatggcgggcatatagaaccagtatcctatatctctttgttttccaatacacctggaaagctgacgaatgaattagtggaccttggaagcgaagaattttcttgcggaaggaacatgactactgacttggtaacatttacagtgaagtatggctgttggagttacaaagagagcagtaccggattg

SEQ ID NO: 49280 - DNA, 221 bp, Zea mays
  Clone ID: LIB3067-052-Q1-K1-H4
accacgcgtccgcccacgcgtccgcccacgcgtccgaccacgcgtccgaaaaaaaaaagaaaaaaggaaaaaaataaaaaaaaaaataaaaaaaaaaaaaaaaaaaaataaaaaaaaagataaaaatatatctaaaaaacattatacatataataaataccacaagtaatacataaataacatataaaactaagtataatatatctatttgttttccaata

SEQ ID NO: 49281 - DNA, 201 bp, Zea mays
  Clone ID: LIB3067-052-Q1-K1-H5
cccactcgtccgcggacgcgtgggaaattacaaaaaaaaaaaaaaaaaaaaaaaaaaaggaaaaaataaacatataagtaaaaaataaaaaataaaaaaaataaaaataaaatttggccgtcctttttaacgtttccaattttccttcccttttcttctatttttttttttttttttttgtcccccttaatttaaattttt

SEQ ID NO: 49282 - DNA, 358 bp, Zea mays
  unsure at all n locations
  Clone ID: LIB3067-052-Q1-K1-H6
gcagaagatagcagagggccagaggcgcagaaggcagtcgcggacaggaggaagaggaagaagaagcggcagcgagcgaggatgccgtgcctgaacgtgtcgaccaacgtgaacctggagggggtggacacctncgccatcctcgccgaagcctccaagtccgtcgccaacatcatcggcaagcccgaggcctacgtgatggttgttctcaagggttcggtgcctatggcatttggaggtacccaggagccagcagcttacggtgagctggtttccatcggaggcctgaaccctgatgtgaacaagaagcttagtgctggcatcgcttctatcctggagtcaaagctgtctgttccca

SEQ ID NO: 49283 - DNA, 313 bp, Zea mays
  Clone ID: LIB3067-052-Q1-K1-H7
ataatgctggagtcggaatgcagatttaagagaatcaggaagcccccttatgttaacaggtggatcaacttgagggtaccgttccaggaagtgtacggggacgtccgctgcaacctgaaggaggcagtccagctggccgggctcacatgggaggggcgcgctcactgcgggctcgacgacgcccgcaacaccgctcgccttctggcacttctgatgcaccggggctataagttctgcatcaccaactcactggtgtggcaacctgccgacgctccgcagtcaaccgtcggcacctgtcacttcttcccggacc

SEQ ID NO: 49284 - DNA, 243 bp, Zea mays
  Clone ID: LIB3067-052-Q1-K1-H8
tcggaatgcagatttttgagaatcaggaagcccccttgttttaacaggtggatcaacttgagggtaccgttccaggaagtgtacggtgacgtccgctgcaacctgtaggaggcagtccatctggccgggctcacatgggagggacgcgctcactgcggtctcgacgactcccgtaacaccattcgtctactggcacttctgatgcaccggttcttcaatttttctatcaccaactcactggtg

SEQ ID NO: 49285 - DNA, 178 bp, Zea mays
  Clone ID: LIB3067-052-Q1-K1-H9
ctgggaagcccgccgcgagtacggaatgccaagccagtagtagtttttgttctcggcacgaagccatttgatgttcgttttgtgcgacggtttgcggcttgatcgcgattggcctcgtagcctttttgaccgaacgagagaagcagcagctctgcaaagctacctccaggttcattcg

SEQ ID NO: 49286 - DNA, 327 bp, Zea mays
  Clone ID: LIB3067-053-Q1-K1-A1
ggcggattcctgctacctcgaccgtccccgttcccgtccccttccggcgcgcgagctcgcgcgagattgcaaacgctagatcgggtgtcgctgtgaatgacgagtgcatgctcaagttcggcgagctgcagtcgaagaggctgcaccgcttcctaactttcaagatggacgacaagttcaaggagatcgttgtggaccaagtcggggatcgcgctaccagctacgaggacttcacaaacagccttcccgagaatgactgccgatacgcgatctatgatttcgactttgtcactgcagaagatgtccagaagagcatgatcttctata

SEQ ID NO: 49287 - DNA, 390 bp, Zea mays
  Clone ID: LIB3067-053-Q1-K1-A10
cccacgcgtccggtgacactgcccgatatgtgccaaaaccgcatcacaaagggaagaagcacactgtgcatagtttgaaggaagagtatgagaaaaaacgtgctgaggaggagaaggctaaggaagagcgtgatgcaatggttcaggcaaagagggagcaccgggagaagtctgaggcgaagcggaaagaactgagggagaagatgttcaagaagacaagatctggccaacctgtgatgagataccggatcgagcatctcttggagactgcactgagcaagtaacacgataccaacctcgccttttgagaccaaagtgtgctaccaaattttgtagctccgtgcaaccatttgtttactgtaaccgtcttttgtcgcttcatcgttgtac

SEQ ID NO: 49288 - DNA, 242 bp, Zea mays
  Clone ID: LIB3067-053-Q1-K1-A12
ttcccgttcttcccactctctctccactcgtatctacactcctacagttacgattccttataccatttatcatcacacaatctggattagcttttcttccattacgattatactcattttcatgacttcatttcttgcatcttccaatccaatttcaagatgctataactctcttaacatcacttctcatattctataatcatttatctcgagtcaacaattaagaactgcaatagttttta

SEQ ID NO: 49289 - DNA, 451 bp, Zea mays
  Clone ID: LIB3067-053-Q1-K1-A2
cccacgcgtccgcccacgcgtccgcactcgtagagagaaggaaaaatatccccggaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgac

SEQ ID NO: 49290 - DNA, 410 bp, Zea mays
  Clone ID: LIB3067-053-Q1-K1-A4
ggccgcccttttttttttttttttttttttttttttttttttttttttttttggtttttagggaatctccacattgggggaacacctttattgaagcattttatcagcttcttttacaccaatagcttgtacattaaattgtaaaacttaacacatacaacaaagcaacttaaaaactcaattcgttttgacactgacaccgtccgttccaacaatgatcacttaactctccatgttcaaaaacaacccattgtcaacaactccttccaaagcttcaatttcctgtcctgcttccaactcattcttgattggctttttgaattataaattgaccatgtaatttgagttttcaaaaacatatggcttgtctcctttaaaccttattttttccttgacttctttcttcttaa

SEQ ID NO: 49291 - DNA, 286 bp, Zea mays
  Clone ID: LIB3067-052-Q1-K1-G6
aaaaaagctagctaaaacacaaaacaaaacaaaacaaacaacacaagatatcgagcaaaaaggcataatattggatcttgagtgcaacaaagtgctacaagaagatcaggaaggtcctctgcaaggtccaagacaaggtgagcatcaagaccatctcctactactagaagaacaacacggtgacagtgtccgggcccttcgactcctaggaggtcgcctacaggctcaccttctattctatcaaggtcatcaccgacatacacatcttttttgtgcttatgcttca

SEQ ID NO: 49292 - DNA, 376 bp, Zea mays
  Clone ID: LIB3067-052-Q1-K1-F2
ctctgtagtttgtgtttgtctcaaaaagcctttgaccctgttcgctgcaattgtggtggttgatggaaatgcatatcatggtgaatctgcacccaacaagaaagatgcagagcagaatgcagctcgtgttgtgatcaagtcgattttagctaagcatgacacttgtatggtgagaattgttagatcgaagaaacaacttataactgctgtcagatcttctggaaacaccccagctacttttactcctatacagtttacacggcctgtttcatatgcagcatatggcagaccagatgatacaacacctgttttgccaaatgaatcttcctcattagctgttcaacgaggcatcaatgttgtacctgcagttgggaca

SEQ ID NO: 49293 - DNA, 370 bp, Zea mays
  Clone ID: LIB3067-052-Q1-K1-F4
cggacgcgtgggtcccaatcttcaggaattgggtaaaagggcttttgttacctatcttgaggcagtatacctccagaaagacaaaaaagtgttcaacctgagcaggttctctgcagagcagtttgctgcatatgctgcttcgcttggtctgcctgttacccccaagatccgcttcataagccacaagaagaatgtgtcgaagaaggatatggaggacattgatatgaaacagatgaaatccagtttggaacatgaagttaccatcactccaaagatcaacattgatttaactttgtgtgatggagatgatgatatcctttatcccaagaagcccactgcagatgctaatatggatgacagacttgatgat

SEQ ID NO: 49294 - DNA, 346 bp, Zea mays
  Clone ID: LIB3067-052-Q1-K1-F5
gtttctatgaggggaaatcttctgatttctaactcaggacattatgctcctggttttgggattggagctctcgaagaacttgatgttgaagatgaagatatttatgcatcaggttttgcttatgaacaaactgaagttgatattgagccttcaaaaactgccaatgacagtaattataaacttgatgacagaaaaagaggtttctatctgagctttaagattgcctcaaattctgaatacaaacttgaacggtaatgcttcctctgattcatacttttcttcatcttgatggaatagtgtgaactaccttcgaaagtctgggctttggtttttcattctaccttct

SEQ ID NO: 49295 - DNA, 308 bp, Zea mays
  unsure at all n locations
  Clone ID: LIB3067-052-Q1-K1-F6
aacgaggccaccgacgtctggagcgcgggggtcatactctacatccttctgagcggcgtgccgccgtttaggggcaagaccaagtccaagatcttcgactgcatcacgtccatggagctgcagttcccttctgacccatgggacagggtttctgattccgccaaggagctcgtcaccgggatgctgcggcgcgaccctaggctgcagctcacggccaagcaggttttagagtatccgtggatgcaggaacacgcggacccacaagactcgagcggtcagtgccactagaccggcctncaacgggaggg

SEQ ID NO: 49296 - DNA, 233 bp, Zea mays
  Clone ID: LIB3067-052-Q1-K1-F7
cccacgcgtccgcccacgcgtccgagcggattacgttgagctggtataatcagttgatgggcttaagttttctgcgctagcccctgcagccgaagtgtttctgatggttcaaatagcgttgcagtgccttgttggtgttagtccttgtttatcttacatttgtgagtgaagttggacgtgccaaacatatttaaatatatcctcttgaacgggggaaagatcatatcaagtcc

SEQ ID NO: 49297 - DNA, 89 bp, Zea mays
  Clone ID: LIB3067-052-Q1-K1-F8
tcgcccacgcgtaccgcccacgccgtccgcccacgcgtccgcccacgcgtccgccgacgcgtgcgcccacgcgtccgcccacgcgtccg

SEQ ID NO: 49298 - DNA, 400 bp, Zea mays
  Clone ID: LIB3067-052-Q1-K1-G1
gcagcaaagggatccaagaattgatcggtctcattggaatgatgatgacagaagtaagagacaattgctcctttggataattagaccttgggatcccggactgcattacatggcatgtggttgcttggggacaagcaacatttcgacggggcggtaatgtaacatccggattctgtgatatgtgtggtctgcctgaactctgaagacggtgtgcaagtataggtaaatgaagtctgaacttctgaagattttgatgagcaagctgattgggccatattagttgtgggccggaataccggtgtgtattcatataagtactaagaccatgtactcgaacagcagaaaggaaatattctagactttggttaccaaacaaagcatcttaagttgctttttgggg

SEQ ID NO: 49299 - DNA, 626 bp, Zea mays
  Clone ID: LIB3067-052-Q1-K1-G10
cccacgcgtccgcggacgcgtgggcgccatcgaccatctggtgcgcgggaagacgcggaaggaagcgtcgaggatgttcttcgagaccttggtgctgacgacgaaggactacatcagcgtggaccaaccgaaccccttcgacttcgtgagcgtgaagccaggcccgaagctgctcatgtcagaattctagatcaacaaagtcagcgtacccctggcgcgatacattccttgttaccattgtatccatcatcgcaccgaccagcaacaacaccgcagatattccccccaaccacagtaccacaccctccctcccttccaaatccatttttgtgtatgttgttgcagttcccctcccctcccctgtagcatgtgctgcgctgatctgttgttgttgccagggcgtctgtccgagtaggatggtggttgtgttgtaccgtcggctatccaacagtatatagtagtagtacgattttagcgacactcgtgaagcccgccgtgtaatgtgctagggttcgcgctcccctaagttactgtcgctttagactggctaaagcccgtaggaattgtatacgacaaggacagggacagcccgagatgatgaatgatgtattgatgtgcctgtttga

SEQ ID NO: 49300 - DNA, 547 bp, Zea mays
  Clone ID: LIB3067-052-Q1-K1-G11
ctcgagcccgagcaaacaagggcggacgcggagccggcggcggagcggagatggcggagaagaagcgaggcgccggcactcgcaaggatgaggtggtgacacgcgagtacactatcaacctccacaaacgcctccacggatgcacctttaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgttagaattgcccgcaaccggaacgatgaggaagacgccaaggaggaactctactctctggtcacagttgctgagatcccaccggagggtctcaaaggtttgggaactaaggttgttgaggatgaggattaagccctgtataccatgagataaatttgagaatgttgcttgagcttattgttatctactgccaatgactcatgtaatagaagcttcgagacttgtctcctttcaagtaatccaaatatccacatggt

SEQ ID NO: 49301 - DNA, 610 bp, Zea mays
  Clone ID: LIB3067-052-Q1-K1-G12
caagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtaacttagagcattctcatggattgtcttgcaccgaaatgtgtgtcctgatgagtacac

SEQ ID NO: 49302 - DNA, 369 bp, Zea mays
  Clone ID: LIB3067-052-Q1-K1-G2
cccacgcgtccggagaaaattacgaggacaacaatggttacatgcctccgagttatgagagaaggaacatcctctggaggaggattgagaatgaaactcaaacagtttcacaaaagcacaacatcattcactgcccttgacaagaactatctcactccattttttaccagtcagacagatgatgataacgatgacgacttcagtcagcaaccccaaaaccgaagactagctttttatgatcaatagcggaatttgatactctacatatcaagctaaatacacggagcagaactgacgtgcatgactatgtctatgtgtgattgggtcgaacaaaatatagcaagagcatacttagttgagttgcatatg

SEQ ID NO: 49303 - DNA, 300 bp, Zea mays
  Clone ID: LIB3067-052-Q1-K1-G3
cccacgcgtccgcggacgcgtggggaacttcctgggattaatacattttgttatcctagaaaaaaagagaaaaaaagaaaaaaaaaaaaaaaaaaaacaaaaaaaaaaaaaaaaaaaaaaaaaaaaataaaaaaaaaaaaaaaaaaaaaaaaaaaaaaaaaaaaaaaggggggccacttaaaaggatcaaagtttattaacccagtaattaaaataaaaaattttataaaagggcaacaaaaattaaatcaataggccttattttaaaaaattttaaatttgaaaaaacttggatttacc

SEQ ID NO: 49304 - DNA, 262 bp, Zea mays
  Clone ID: LIB3067-052-Q1-K1-G4
gccaacaaccgtgcattccagaggttcgctgtgaagaccaacaggactcttgagagcgtatcgtcgaaagctaaggaagtgagggaagagttatcggaacaattgaaggaagctcgtggccagaaagatcacttcaagcagtgaagctggttcccacatcgattcagcaagatgatactgacaatcttgttacgagtttagtccttgtctgggtactatttatgaatgacattttggatgttattcaatggaaattagtttt

SEQ ID NO: 49305 - DNA, 286 bp, Zea mays
  Clone ID: LIB3067-052-Q1-K1-G5
gagagagctagctttggccaggcgtccacagcagccagcacaagatgtcgacggtggtcatgggggtggatcttgagtgcgacaagtgctacaagaagatcaggaaggtcctctgcaaggtccaagacaaggtgagcatcaggaccatctcctacgacgagaagaacaacacggtgacggtgtccgggcccttcgacgccgaggaggtcgccgacaggctcaccgtctacgccggcaaggtcatcaccgacatacacgtcgtcgggggcttcggcttcggcttggg

SEQ ID NO: 49306 - DNA, 697 bp, Zea mays
  unsure at all n locations
  Clone ID: LIB3067-052-Q1-K1-F12
cccacgcgtccgcccacgcgtccgcggacgcgtgggtgagcattcaaagcgttctagggtagaagatattgaccaatatagtggagaagaatattctgagtgatgaactgtaaatcataattatcttgcaccaacgaattttatcagtacatgtgaagccttaaaaggtttcaagcaataggcacaagtggtttcatggtgcatggtcatgcagtgaaagaaaatgtctgacaacaagaggacattggggcttggccaatttgttgatctctgtagtgataatagaaagcgtcacattgttctaaagaagttgtcttcaaagtcttggatgatgcgtatattgcagttgctccacatgttccaggatagtgaaattttattcatggttgcctgataaagtgtggaattatataaattttcagcataaattgttttattattaacgttcgtttttgcctaaaataatgcataagtatatgagatgataaaagggtaatcatgaagcattctgtggtccggtggcccttaagttgcaattctattccagcacanagtgacaatgatatgatgacttttggtctggtattattaattctggacagtaattcagtagctgtggtaacgggcaaaaaatttttcccccccccttttttttcccacaaaaaaaagggggggggggggggggtttttttttttt

SEQ ID NO: 49307 - DNA, 297 bp, Zea mays
  Clone ID: LIB3067-052-Q1-K1-D8
gaccgtttttcgttcgaggcagtgccaagcactgaaacatggatgaagcggacgacgacccatgggtatcctatccaggggcaatcgaatatagattttcttgtggcgtggccaagggcggtgccgagcctgtaccagtacgacgactcaggccagaacacacggcgtatggtatggtacacagcaaggccgtgttgttgctgtaagttttgtaatttctgtttccttcttctcggcttcgcagcatgcagttgctgtatatgatggaagaacactctgttactgggcatgttgcgc

SEQ ID NO: 49308 - DNA, 629 bp, Zea mays
  Clone ID: LIB3067-052-Q1-K1-D9
gcctcaaggaaatggccttgcttttacggtatcttcccttacaataacattggtggttcacagctaatttggattgcaccgagtggtggtagagatcgcccaaatccttcaacaggagagtggtacccgggcaggcgccttttgattcatccacagtggacaatatgaggaggcttctggagcatgctggtgttcctgggcacatatatccactattattactgtgctacgaggttatgcctccaccacaacaggtcgagaaagagattggtgaacagagggtgatatccttccatggagtaggcttgtcagcaactgaagaaacaaagtatggggatattacttgtcataccaagaatgctgatgagggaagggagctattcacaaatactttgtacaactcagttgttaatcagtacaatgtcctcaaatctgctatctttagagatcgtggagcagctgtatcaaacaatgccatctcactgtcacaaccatggcgatgaatgttagctttcccagtccagattcgatactgaagttaccttttcagaagaacaggtgaactgcaattgtgcaaattttctgggaaaaactcttgaaagttaatctttctgatatcactggacttt

SEQ ID NO: 49309 - DNA, 294 bp, Zea mays
  unsure at all n locations
  Clone ID: LIB3067-052-Q1-K1-E1
caaatactgatctcactgatccagtatggctatggcaaaggcaggcgcgccgagggtctcggcggcccagctggtggctctcgggctagcgctcctctgcgctgtcgccggcccggccgccgcgcagaactgcggctgccagccaaacgtctgctgcagcaagttcggctactgcggcacgaccgacgagtactgtggcgacgggtgccagtcgggcccgtgccgtctnctcaagctcttcgcccgcctcgccgtccttggcagctcgcgcaagcgccgcgctgcctccgcggg

SEQ ID NO: 49310 - DNA, 663 bp, Zea mays
  unsure at all n locations
  Clone ID: LIB3067-052-Q1-K1-E10
atgaccgtttccttcctcgaccatgtccctctccagctagcttcctcccctccatgtcgttgcttcttcgtcgtcgccggccgtcgtcaccactttttgacgcgctagcgcctagctgctgctcgttcttccacctcgccagtctccatcaacgcggctccgtcgccctcacgcacgcgcgcatagatataaacataaacgccggctggcactggtagacattcttcactcccacgctagctacgcccactccccccgcgctatgcctatggccgaccgcgtccaccccatgccatctccctcctccccgccgcttccacctccgccagggcgacggcgacctgacgccgaccccgccacggagacgacgccgctgcacccgtccttcttccacgccatccgcggcctcgccaacgccaccgccaccgccaccggcgccgcagccccgctctcccccgcgctcgacgccgccgtgcgcgccgacaacgggcgcaacgggaaggtgggcgtggagtaccgcgcgggcggcgccgtcgcggtgtcctacgcggggcagcggctggccgcgggcccgtggcccgcgttccgccaggcgccgcggaacgtcacggtggtcgcgggccgttctttagnaaaggggggaaaaattttttcccccccccc

SEQ ID NO: 49311 - DNA, 590 bp, Zea mays
  unsure at all n locations
  Clone ID: LIB3067-052-Q1-K1-E11
catgcactgttttatgtggtcttcatgctgtcagcctgtgctctgttctcaaagacatggattgaagtttcgggttcatcagcaaaggatgttgctaagcagctcaaggaacaacaaatggtgatgccaggccatcgtgagtcgaacttgcagaaggaacttaaccgatacatccccactgctgctgcatttggtggtgtatgcattggcgcattgaccgtcctggctgatttcatgggtgcgattggttcaggaactggtatattgctcgctgtgacaatcatataccaatacttcgaaacctttgagaaggaaagggcgactgagcttggtttctttggtttttgattagtagctgtggaaccttaacttggctatagctgaattttcttgtaagtccctgtagtgcttagccagttgtaacttaaagagttctgtttaagttgccttcttgcggccacaatcatgtagcagaatgtgcgtgtgtttcaagttagcgtgggggtatgtgcatctgtccaaagagtctgcaatttggcaaccggatattttgntatcaatttcagttacttcgaactgagcatgttctc

SEQ ID NO: 49312 - DNA, 706 bp, Zea mays
  unsure at all n locations
  Clone ID: LIB3067-052-Q1-K1-E12
cccacgcgtccggagagcgcgaagttaagccaccatgtggacgagggctttagcgacggtgctgctgttcgtggcaggcgccgcgctgctcggcgtcggcggcgccagcgcgcagcagggcgtgtggagcatcatcactcgtcccatgttccagagcatgctgagccaccgcggcgacagcgggtgccagggcgccttctacacctacgacgcgttcatcgaggccgccagcaagttccccggcttcggcaccaccggcgacgagcagacgcgcaggcgggagctcgccgccttcttcggccagacgtcccacgaaaccaccggtggatgggcgactgctcctggtggaccgtttgcctggggatactgccgggtgaaggaacagaacccgacggacccaccctactatggacgaggacccatacagctaactcatgagtacaactacaggctcgccgggcaagcgctgaacctgaacctggtgggcaacccggacctggtggcgagcgaccccgtggtagccttcaagacggccatctggttctggatgacgccgcagtcgcccaagccgtcgtgccacgccgtgatgaccggcgcctggacgccgtccgncaccgaaccgggccgtccccggggggtnngagaggggggggggccccccctttttttttttccccccccccccccccccccgccgggggggggg

SEQ ID NO: 49313 - DNA, 268 bp, Zea mays
  Clone ID: LIB3067-052-Q1-K1-E3
ctcatgcacggtcaactgagacaacagaaatccaaatacgaccattttcaatatggacagaggaaagaaaccccatgaggagcaatcgagcagcatccccatattgacggagccaaacagatgatgcctcaggacaatgatttggtacatgcgcgcccctaccatcgcagcgtttcctttcttcttgccttgtagttgggctacctatactgctttgttcttcctttctaattgccttcctatgatcttccctagttctagatcgcga

SEQ ID NO: 49314 - DNA, 375 bp, Zea mays
  Clone ID: LIB3067-052-Q1-K1-E4
cccacgcgtccgagtcgctcgcgccgttcccgcaaggctgcttctactccaacgccctgggagggcgcaagtgctacgagaaccccaagcacaaggtcaccgctgtccccgccgacgaagaagagatctgcggtgccactttcaaggtggtggaagggtctactgtcctgacggcgctgcactgatctatcatcatcaggcggaggcgatgcgatgatgatgcagaactttgtacatgcgttggtggatggtggtgtaacatagtggctgccaacaagtcatgctcatgcaaaccgatgaatctatctctgtatcatcgatctcgggtgcttgctagtccagacttcagacatggctatatatatatagctgggg

SEQ ID NO: 49315 - DNA, 329 bp, Zea mays
  Clone ID: LIB3067-052-Q1-K1-E5
cccacgcgtccgcccacgcgtccgcccacgcgtccgggcacgccacgcaacgctcttggagtcggtagctcactcgatcgcagaggccacgctgctcaagttccctcagatctccgcagtccgagtgaaggttggcaagcctcacgtcgcggtgcgaggcgttctggactacctgggcgtggagataacgaggcacagaaagaaagaatgagatgctgtacacatgtggtgatggggagccagttcaatgctgatggcactgcggccataaccataatccacgcacgcttgttgcttgttggcaactaggcatatccctttcacctttg

SEQ ID NO: 49316 - DNA, 291 bp, Zea mays
  Clone ID: LIB3067-052-Q1-K1-E6
cccacgcgtccgcccacgcgtccgcccactcgtccgggcacgccacgcaagctctttgggtctgtatctcactcgatcgcagaggccacgctgctcaagttccctcagatctccgcattccgagtgaaggttggcaagcctcacgtcgcggtgcgaggcgttctggactacctgggcgtggagataacgaggcacagaatgaaagaatgagatgctgtacacatgttgttatttagagccagttcaatgctgatggcacttgtgtcataaccataatccacgcacgcttgt

SEQ ID NO: 49317 - DNA, 355 bp, Zea mays
  Clone ID: LIB3067-052-Q1-K1-E7
cccacgcgtccgcccacgcgtccggcagaaacgagagggcaggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaagtgctccacctgctgagaaaccacctgctgcaaagcctgatggcaccagtcagattgctgctggggttaccagccaaaccaattactaccacaaggcccaccgtcaaaac

SEQ ID NO: 49318 - DNA, 57 bp, Zea mays
  Clone ID: LIB3067-052-Q1-K1-E8
tggagttttacattaaaaaaaacaaaattaaaaaaaaaaaaaaaaaaaaaggaaaaa

SEQ ID NO: 49319 - DNA, 573 bp, Zea mays
  unsure at all n locations
  Clone ID: LIB3067-052-Q1-K1-E9
caatttgaaggctgcccaacccttgcgccggtaggcggtggcggtgaggatagagggttacctgaggaggcagtgatggcggccacgattcagtacaaccggagcaacccggcggtgaagcggatcctgcaggaggtcaaggagatgcagtccaacccctcacccgacttcatgtccctccccctcgaggaggacatcttcgagtggcaatttgctatccttggtccgagagacagcgagtttgagggtggaatttatcatggcaggatccagctaccttcggattatccattcaagccaccgtccttcatgctacttacgccaagtggacgctttgagattcagaagaagatttgcttgagcatatccaattaccaccctgagcactggcagccttcatggagtgtccgcacagctttggtagccttgattgccttcatgccgacgaacccaggtggggcattgggctcactggattacaaaccagaagacagacgagcacttgctataaaatcacgtgaggtgccgncgaaatttggctccccacaacgtcagaaactaattgatgagatc

SEQ ID NO: 49320 - DNA, 412 bp, Zea mays
  Clone ID: LIB3067-052-Q1-K1-F1
cccacgcgtccgcagtgcccgtgtttcgggtccgcgaaggcggcggagcaggagcggcgggcggaggcggaccggctcgagtcgcaggatgctcgcgccaaggccgccgaggccgcgcagaggagacagcaggagtatgagaaatcggcagctggaagggcagccaaagcacagatgaaagcaatgaaggaatcaaagacatcaaaccaaggtggagagccggttcttaagtggcagatgggatcatgagtttcgtttctgttgatttgcatccctccgcttacttttgatggccgacagaaaattgattgcgactaatttctgataggatgcactgtgattgtgtgattatgccagtgaagtggacattcgggttaccatctgctatgctggacatgctattccatagact

SEQ ID NO: 49321 - DNA, 327 bp, Zea mays
  unsure at all n locations
  Clone ID: LIB3067-052-Q1-K1-F10
gcgtgattctcttcctgcgacggaagcaaacactgcccgagatacagacagcgggacgtcgagatggccgacggggaggacgccgccgcgcgcgccggccggccgtcatcacagactaccgcaagaagctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgataatgaacgctntatcgtgaaagccagcaatggtccccgatacgtggtcc

SEQ ID NO: 49322 - DNA, 331 bp, Zea mays
  Clone ID: LIB3067-052-Q1-K1-D7
cccacgcgtccgcccacgcgtccgcccacgcgtccgcgcttctccacctccgtcacatgggctactctccgcgcgcctaccgttccgcgccgcatcggattgggtggtcggggcctagtcgaggttgcgcgggacagcgtcagtccatggcggagcttgtgggaccgcgcgtctacagttgctgcacttgccggaaccacgtttgccttcacgacgacatcatctccaaggcctttcaggggaggaatggccgtgcgtttctgttctctcatgccatgaacgtagttgtgggggcgaaggaagatagacacctcatgacagggctacacac

SEQ ID NO: 49323 - DNA, 350 bp, Zea mays
  Clone ID: LIB3067-052-Q1-K1-C3
acgcctaccgacacgcgttcgccaaagcctccgacacctaagccgaccccgccgacgtgacccctgctcccaagcctccgacgcccaagccgaccccgccgacgtacactccaagccccaagcctcccacacacccgactcccaagccgaccccaccgacgtacaccccttccccaaagccttcgacgcccaagccgccggccaccaagccgcccacctacactccgacgccgtcggtgtcttacaccctcagcccgtcgtcaccatactactagaaagcgatgcctaccataccacactgctgtcagtctctggagcatttaggtgggctggatcaatggaaaggttgt

SEQ ID NO: 49324 - DNA, 275 bp, Zea mays
  Clone ID: LIB3067-052-Q1-K1-C4
cccacgcgtccggctactgtaccggccccggcctcttgtttaatctgaaatgctcattggatatccgcttacgaaacgcaaacacgtgctttggcacgttcgtcgtcgaaaagagaagagaatataccattttgctctcttgaaaaaaaaaaaaaaaaaaaaaaaaaaaaaataaaaaaaaaaaaaaaaaaaaaaaaaaaaaatataaaaaaaaagaaaaagaaaataaaaatattatttgttataaaaaataagaaaaaaaaaaaaaagggggg

SEQ ID NO: 49325 - DNA, 139 bp, Zea mays
  Clone ID: LIB3067-052-Q1-K1-C5
cccacgcgtccgcccacgcgtccgcccactcgtccgaaaaaaaaaaaaaagaaaaaaagaaaaaaaaaaaaaaaaaaaaaaaaaaaaaaaaaaaaaaaaaaaaaaaaaaaaaaaaaaaaaataaaaagggatgaatttt

SEQ ID NO: 49326 - DNA, 345 bp, Zea mays
  Clone ID: LIB3067-052-Q1-K1-C6
ctgcatttgcaaatgcattccacatgctacaacccttgagagttcctgcctggagctgtgcttggcttgagctggtgagtcacaggagcttcatgccaaaactgctgatgtgcaattcacagaaaggttggccattttttcagcgactgcttgttgctcttctcaagttcatggaaccatatctgagaaatgctgaactcccagaggcgatggaccttttatacaagggaactatgcgagttctgcttgtactactgcatgactttcctgaatttctttgtgattatcacttcagtttctgcgatgtgattccttcaagttgcattcaaatgcgcaatgtcattc

SEQ ID NO: 49327 - DNA, 398 bp, Zea mays
  Clone ID: LIB3067-052-Q1-K1-C7
tccctggtctacccactcttcctcttactcttttggcaaaaaaaaaaaactataaaaaaaaaaaaaaaaaaaagaaaaaattgaaaattttaaaaataaaaataattaaaaaattaaaaacaatattattatattatttttttaattaaatttattttttattttttaatttttttatttttttttttttttttttttatttttctatatttttttattttttttttttttaaatctttttattttctatacttattttttttttttttttttccttttttttccttttttttttttttatctttttttcttttttttttctccatcattattttttttttttttttttattttcatttttattcctttttttttttttttatttttttatctttttt

SEQ ID NO: 49328 - DNA, 258 bp, Zea mays
  Clone ID: LIB3067-052-Q1-K1-C8
gataaacatttgatatgcacagataataaaaatatatagtagtaaataataggccatagatatttttattatctgtggataaacatttgatatgcaaaaaaaaaaaaaaaaaaaaaaaaaaaaaaaaaaaaaaagggagaaaaaaaaaaaaaaaaaataaagaaataaaacaaaaataaaaaaatgataaataacatttattgccactaatcccaatttataaaaggagaaggtaaatcattgaaaaaaacactaggg

SEQ ID NO: 49329 - DNA, 454 bp, Zea mays
  Clone ID: LIB3067-052-Q1-K1-C9
ccctctcttccgccatccccagctcagcccaccacacagtcacagcctccaccgccgcggcgcgcgcggccagccagccagccagccagccatgaggcagtggaaatccctggtcccggcgctgcacctgcacgccccggcggcctcctgcttcccgcacccgccgtcgccgtcgccttgcccgtcgccgccccgcggggacgacgccaccacgacgccgccgccgccgccgccgcacctgcaggcggtgcggctggtgggctgcgacgggcgcgtgcgcgcgtacgctccgccggtgacggcgcgggagctgatgcaggcgcacccgcggcacctggtgtgccgcgccgacgcgctgctcatcggcgagaagatccccgccgtggcggttgctcgatgagcttgtgcccggtgacgcctactttcctgctgcctgttcacctgtttcgttccg

SEQ ID NO: 49330 - DNA, 188 bp, Zea mays
  Clone ID: LIB3067-052-Q1-K1-D1
acgcatcgatttgaatgacaaccttctacataattgcccctgtaatttgtacactaattatgcggagagggagctactgcagtagagatgagctgatgtaaaaaaaaaaaaaaaaaaaaaaaaaaaaaaaaaaaaaaaaaaaaataaaaaaaaaaaaaaaaaaaaaaaaaaaagggcgaccgatttaa

SEQ ID NO: 49331 - DNA, 601 bp, Zea mays
  unsure at all n locations
  Clone ID: LIB3067-052-Q1-K1-D10
cacgtcctccatagctctcctccaggagaggttcagaaacctgcagaaggtgaaggagatgagggaaggcagggagctgcagagggtgcacgctgctgatactactactaccaccaccaaccgcaccgcttcgtcgccgtcgtcctcgtcgtccctgtcgtcggctctcagcctcggcctccaacaggccgccaacgccaacgaccacccgaggtggttcttgcacccggacttgatccggccgtccaggccgctgcgcggacacgcgtgccacggcctcggcgccaccggtggtggtgtcgtcgtccagacgacgtcgccgccgccactaccgccgagctcatcgtggggaggagcgcagaattcgggctataggactgatatagatgtcgatacctcgctccatctgtaatctcttctataataagcacgtatggccgtgctgntctttcgttgcttttttttttggtatggcttgtcagtttcccggccttatttgcagctagctagcactacgtacttcttctgtcgtctcgcggcctgccttgtaactgcttgggtacttttactatatatgaggctttctatagatcgatgattt

SEQ ID NO: 49332 - DNA, 601 bp, Zea mays
  Clone ID: LIB3067-052-Q1-K1-D11
ccctaggtttgggggtcaaagagcatgaggacagcagcaaagacgctgatggcacttgtaacggtgacgtttcacaggaatgtccccattcttgatgggaagatttggttgcagttttctaggccccaagctttacatggactaagcctccatttgtttttgcacctcgagtttttgatccagcagttagcatgacatccatccgttggtgagaaagaggcttgccgggttttttttttggcatattatattagttgatggggcaccccctttagttttactcagaaattgatgattgacgcgtcggcctgggaaaagaatgaacccgtgcagttctgaaaaagcgtttactccatccagccagctaacttaatgtgcagctgaaaagtcggcatgtagaagaatgtggaggataacgtcccttcttttgtttctcgtcgttaacttgagactccgagggcgaatgcagccattgaatcgtcgtaaatgttacatcagttgttgttttgttaataggtttttttatgtcttcgctagcgcattcctggaatctaatctcattcctgtaagataattcacatgtctgtaagatcagctaatg

SEQ ID NO: 49333 - DNA, 441 bp, Zea mays
  Clone ID: LIB3067-052-Q1-K1-D12
cccacgcgtccgcccacgcgtccggcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgactatcacacgcccatcgatcgatcgatctggaggctaaataatttctccaagctgctagtatacgtacgtacgttgatatatatgatgtagtattatatatatgtccatgcatctcgtcgtctatcgcatgttgttgttgttgttgttgtttttcgatgatcctgtctctgttataaatatcattattattac

SEQ ID NO: 49334 - DNA, 382 bp, Zea mays
  Clone ID: LIB3067-052-Q1-K1-D2
cccacgcgtccgcccacgcgtccgcccacgcgtccgtccacgcgtccgcccacgcgtcggctgagatgattggaagcattgttggggtctacaacggcaagaccttcaaccaggttgagatcaagcctgagatgatcggccactaccttgctgagttctccatctcctacaagccggtcaagcacggcaggcccggtatcggtgccacccactcctcgcggtttattcctctgaaatgagctgttactcggctctttagtatcccaagagtccgttggcaatgttcattcagatttttctacttctttagtatcccaagacatttgtgttgttccattccagcttaagaattcaaagcttagcattgcacaattatgctggt

SEQ ID NO: 49335 - DNA, 351 bp, Zea mays
  unsure at all n locations
  Clone ID: LIB3067-052-Q1-K1-D3
cggacgcgtgggtgcggtcattgaaaaattgcataaggtactagtagtgactgtattgtgatctntgatctntatatatcttcttcttcttttctttaaaagagtgagttggatatgcatcgtcaatgcatgtacatatcacatatgggctagttagtagttaattaggagtacaattgataaactaccacatgtgacagtgaacagtatttttcatctcgtgcagcacacaggaatcttattcttgacgatctccagtgattccaaagactaaaacatgttcaactgtcttgtgattgattccttgcaggcacatcaatcgacctggggattgcgtacattcttatgctg

SEQ ID NO: 49336 - DNA, 219 bp, Zea mays
  Clone ID: LIB3067-052-Q1-K1-D4
acccacgcatacgccgactcctgtaccctatcatttcgaaacagcgtcatgcactgatacatacatgaatcggtacgactggccatgtatattctatccagtagcaatctaatatagattttcttgtatcttcatcaacatcggcacctcacctgtacacatacgacaactcatgccataatacacgtactattgtttggctcacacctaggccatttt

SEQ ID NO: 49337 - DNA, 51 bp, Zea mays
  Clone ID: LIB3067-052-Q1-K1-D5
atcacatcatactatttgcggatatataagcttaatcattcggatgcgtgg

SEQ ID NO: 49338 - DNA, 329 bp, Zea mays
  Clone ID: LIB3067-052-Q1-K1-D6
catgatgtagatccaccaactatggtcaaggccagcagccgtgaggatgcccaaccagtgactgaatcatctaatgctgaggtgaacacatcaagtgctgtggctgctggagagtctgagtcccatgaaattggatcgccaaagagtctaaaagatgctatcaaaccaaaacataaaagaaagaagaagaaaagtgacaggagttagtttagttgcaagcctgtaattttgtatgccccagataaatcaaggacagtctacaacacctcaaactcctgattgatgaagtttcatccggggtgccatacatgggtttttttggggtttca

SEQ ID NO: 49339 - DNA, 475 bp, Zea mays
  Clone ID: LIB3067-052-Q1-K1-C11
cccacgcgtccggcgctgggcgcagcagggccacatggtctactactactgcaacgacttccgcagggaccactcgctcacgcccgagtgctagcgagcgcgcctgtctgctgtgctgtgtcgtcgtccttgttgctttgtgctttgtttcgttgttgatgaaaaggtcgctaggcgtggctgccctactacgcccgcgcccgccgccgctctctctgcttgcggtgactgaggcgcccgcgcgagccggtggttgaggcgttggtcgttggcttatcgccagcaaactcgtgtcgtcgctcgtctacgtacgtgcccattgcatttcttccggttgttgctttccatttggtctcgcatcgcatgcatcacacgaggcgccccaaagggggcaagcgcttccatgattcatacggatacactatgtataccatatatacacatattatatatatatttaatacatgtttcctgt

SEQ ID NO: 49340 - DNA, 435 bp, Zea mays
  Clone ID: LIB3067-054-Q1-K1-E4
cggacgcgtgggatttccaccggacgctcatatatggcggggtcgctatgaacccaagggaccatctgcggctggtttatgaggcgaaccctctcagtttccttgctgaacaggctgggggtagagggtcagatggcaagaacagaatcctcaccattcagcctgtgaagttgcaccagaggctgcctttgttcttaggaagcatggatgacatgcttgagttggaaagctacggagatgtgcagcagaaggtcaatcctggatatgaagtttaacgatatgtaaaaaaaggttcagattttttcaagcgcccaagcagaaaataaggtaacactcgtgtggcaaccctgtatctgccgatactataccttgtcttttcctctcggtttttagcccaccgcaacttgattgggactaaatccagttgttgttatt

SEQ ID NO: 49341 - DNA, 429 bp, Zea mays
  Clone ID: LIB3067-054-Q1-K1-E5
catgaagggttttcctgagtctccaatgtgtggcttcagtgcactggctgttaaggtctggcagcaatatggcgtccctatctgtggtagagacattcttggggatctcaagctcaaagagagtgttaaagcccacactaactggcctacatttccacaaatatttatcaaaggagagtttgttggggggtctgacatcatattaagcatgcaccagaagggtgagcttaaggatcttcttggggatattgcacaaagagacgaacaaaaagtgcatgctcacgattcatgaagcaatcaacagtaggttcttttactatgcgctatctacttagccactaaaatgttctatctcggagtctttaggcgacagcgtacgtgacattgtgaactgtcctacgcattggacatggatgaccggatgtgttc

SEQ ID NO: 49342 - DNA, 123 bp, Zea mays
  Clone ID: LIB3067-054-Q1-K1-E6
cccacgcgtccgcccacgcgccgcggacgcgtgggaaatggtcatgtatgagtgtgacagctatgaatggtcgaatgaaacctgtagcgtattatttgagtacgttttaagacaggttttttg

SEQ ID NO: 49343 - DNA, 394 bp, Zea mays
  Clone ID: LIB3067-054-Q1-K1-E9
gaagaacagtacagtgaccggacatcgaagatacttgctgctcaccatgcaaaatccatggggttagttgctgaaaaccggaatggagatagaaagagcaggagatctggtagatggggcttgttagggaataacttcacggtcgctctcatggttcaactgcgtgacccactacgtaactactagccagtgggcacaccaatgttcgcgttaattcaagttgaaagggtttttgtacccccgaagcccaaaatctacagtaccgtctcagacaaaggcaacagcgagcaggatgactaggaacccaaggccgaagaggttccagacaaggcattggtcacggaagagaaagctgaagaattagaggatcccgttccccaattcaaggtttcag

SEQ ID NO: 49344 - DNA, 227 bp, Zea mays
  Clone ID: LIB3067-054-Q1-K1-F1
aatgagtccgtccagagttgcgacattgtggctttcaacaagatctagagttcagtttctgagtttgggcaacggcagcggctcagctcgtcaagtttgtgctgggatgccagtttatcccttctagtctattacagaaatgttgttcggagctgagtctattataaacatcttggtctgagtttattgttgagtggtgccagtttttttcaatatacatttatctt

SEQ ID NO: 49345 - DNA, 337 bp, Zea mays
  unsure at all n locations
  Clone ID: LIB3067-054-Q1-K1-F10
cccactcgtccggctcggcgtgctctccgttcgaaccgatgcccatctgctgaatcggatcggatcgtgcgatcggccgccacgccacggcccgcgggtgaggcgtggtctccgggaggcagccaacctatcccacccggtctagcctctagcgatcccggcgccggcagcgcgcacgagaggaatggacgcgtcgcacccggagggcgaggccacggctgggtggctgacggtcgaggagtggagcggctcgtcagccttcgcgctctcccgcaccgtcgtcctcaccgncttcggctnctctctcaccgcacacaggttcggcagccggtgggag

SEQ ID NO: 49346 - DNA, 454 bp, Zea mays
  Clone ID: LIB3067-054-Q1-K1-F12
gcgaagagataaattaaacgagcagttccaggacttgggaaatgcacttgatccagaccgtgccaggaacgataaggcaactatacttggtgacacaatccagatgctgaaagatttgactactcaggtgaacaagctgaaagctgaatacacgtcactttctgaagaagcgtgtgagttaacacaagaaaagaatgagcttagagatgagaaagcttcactgaaatctgaggttgataatttgaataatcagtatcagcaacgaatgctggtgctatacccatgggttggaatggagccttctgttgtcatggggccacctcctgcatatccctacccagtcccagttccaataccctctggtgctgtacccatgcatccgcagttgcaaacataccacttcttccacagtcaagcttctggaaccatcccatacacatgcatcccttacatg

SEQ ID NO: 49347 - DNA, 313 bp, Zea mays
  Clone ID: LIB3067-054-Q1-K1-F3
cctttatccaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaataaaaaaaaaataaaaaataaataaaaaataaatttaaaataaaaaaaaaaaaattataaaataaaaaattttttttattataaataa

SEQ ID NO: 49348 - DNA, 84 bp, Zea mays
  Clone ID: LIB3067-054-Q1-K1-F4
aaaaaaaaaaaaaatttaaaattaaaaaaaaaaaaaaaaaaaaaaaggtaaaagtaaaaataaaaaaaaaaataaaaataatac

SEQ ID NO: 49349 - DNA, 434 bp, Zea mays
  Clone ID: LIB3067-054-Q1-K1-F5
agccgccgccatgtcgaagcgaggcaggggaggttcggcggggaacaagttccgcatggggctgggtctgccagtggccgcgacggtgaactgcgcggacaacacgggcgccaagaacctctacatcatctccgtcaagggcatcaagggccgcctcaatcgcctcccgtccgcctgcgttggcgacatggtcatggccaccgtcaagaaggggaagcccgacctcaggaagaaggtgatgcccgccgtcatcgtccgccagcgcaagccgtggcgccgcaaggacggggtctacatgtacttcgaagataatgctggagtgattgtgaatcccaagggtgagatgaaaggttccgctatcactggacctatcggcaaggagtgtgctgatctttggcctaggattgctagcgcagcaaacgctatcgtttgag

SEQ ID NO: 49350 - DNA, 404 bp, Zea mays
  Clone ID: LIB3067-054-Q1-K1-F6
attgctgaccaatctctctggcctgctgcttcctgataatcgaccagttccccagtcttgctcctttcactcgtccggcctgcatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctttccagggcccatattgacttctgttctggatcttgcacgtttcacatttgtgtctgagtctttttaacattgatttcttctcatatgttctttttttatttttgctatttttatttattcttttttatttgtcttttttatcctttttttta

SEQ ID NO: 49351 - DNA, 436 bp, Zea mays
  Clone ID: LIB3067-054-Q1-K1-F7
cgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacttggtgctccgcctcaggggtggcatgcagatctttgtgaagacattgactggcaagaccatcaccttggaggtggagtcgtctgacacaatcgataatgtcaaagccaagatccaggacaaggagggcattccaccggaccagcagcgcctgatctttgctggcaagcagctggaggatggccgtaccctcgccgactacaacatccagaaggagagcacccttcacctggtgctccggttgcgaggtggtatgcagaatcttgt

SEQ ID NO: 49352 - DNA, 414 bp, Zea mays
  Clone ID: LIB3067-054-Q1-K1-F8
cattattcgacctcacctcaccttgccaccagccatggctgccgtgaccgccggggccatctctctgtcctcctcctccgcctcctcccctgcggctgctgccaaggccaaggcggcgtccccgtcgtcgtcgccatgcaggcacctccagttcctgtcggcagcgagcccgcggcggcggtggcgggccggcgcccgcgcggtacgggcgcaggtgtccaccaccgagaccgcggcggcggggccggcgaagacgtccaagaagcaggacgaggggctggtcaccaacaagtacaagcccaaggagccgtacgtcgggaggtgcctgtccaacaccaggatcaccggcgacgacgcgccggtggagacgtggcacatggtcttcagcaccgaatgcgagatcccgtatagaga

SEQ ID NO: 49353 - DNA, 451 bp, Zea mays
  Clone ID: LIB3067-054-Q1-K1-F9
cccacgcgtccgtctgcccttgccgccgccaccgcaaccgcccgatccaggtccgcagactgcgcactcctcctctccgctccgaatggcccgcacgaagcagacggcgcgcaagtcgaccggcggcaaggcgccgcggaagcagctggccaccaaggcggctcgcaagtcggccccggccacgggcggcgtgaagaagccgcaccgcttccgccccggcaccgtcgcgctccgcgagatccgcaagtaccagaagagcacggagctgctcatccgcaagctccccttccagcgcctcgtccgcgagatcgcacaggacttcaagacggacctgcggttccagtcctcggccgtggctgcgctgcatgaggccgcggaggcgtacctggtggggctcttcgaggacaccaacctctgcgccatccacgccaagagggtcaccatcatgccc

SEQ ID NO: 49354 - DNA, 351 bp, Zea mays
  Clone ID: LIB3067-054-Q1-K1-E3
cccacgcgtccgcccacgcgtccgcccacgcgtccgagctagatcattggacacatatcgaaacagctctagctagcgcgctcgtcgtctaacctggcttccggcatggcttccaagcagatcggagtcttgacctgcttcattgccatcaccgctctcgccttccgtccctgcgcatccgccgtgcccatggacggtggctggtcgaacggctgcgccacctggtacggcccagccaagggcgctggatccgactgtggtgcgtgtgggtaccagggtgccgctcaccagccttctgtcttgttaatgattaccgccggcagccaatccatctttcatgactgcaagggc

SEQ ID NO: 49355 - DNA, 333 bp, Zea mays
  Clone ID: LIB3067-054-Q1-K1-G10
ttgactcgttgtctatgatcattcgactctatatacatacagctctagctagctctctgggcgtctaacctcgcttccggcatggctctcaatcacatcgtactcttgacctgctacattgccattaccgctctcaccttccgtccctgctcatcctcccttcccatagactcttgctagttcacactgcaaaacaacgctctcagcatactcatatacgcctccttacatcagagcttgataattcgcatcatcagtttcatcatcaaattctcgttctattcccatatatctgaatggaaccttctcctatcatatgtccaccttttgcat

SEQ ID NO: 49356 - DNA, 205 bp, Zea mays
  Clone ID: LIB3067-054-Q1-K1-G11
tcgtgggtgaggctcaagatggtgaactagaagatcaagaagatgagccacctcaaaatgactgcaactgtcgagggggagtgattctgatgtttggctgttcgtttgcatgatgaccaggttttagtttgtctggccatgcttgggtcgcatcaatctgtgacacgatgaatatcactttgtcaacctattcttctcacaaaat

SEQ ID NO: 49357 - DNA, 293 bp, Zea mays
  Clone ID: LIB3067-054-Q1-K1-C8
cccacgcgtccgcccacgcgtccgaaaaaaaaaaaaaaaaaaaaaaaaaaaaaggaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaataaaaaaaaaaaaaaatattaaaaaaagaaagatggaaaaataacagaataggaattgaaacaaatgaaaaaaacaacaatatgcgcaaattgaataagataatggg

SEQ ID NO: 49358 - DNA, 416 bp, Zea mays
  Clone ID: LIB3067-054-Q1-K1-D1
caccgctcactgctcaccgtcggcaacagccatctcaagcaaagaatcgcggcgctcgcgcatgacaagatcttcaaagacgctcaccaagaggcgctggagaaggagatccagcggctgcgccaagtgtaccagcagcagcaggtcaaggtggccaccaccggcggcgccgacatcgccaccgccgcctcgccgtcgatgcaggccaggcaagagctgctcgcgtgcgagggcgctgctattcgatagcggaggcggcggctgcggcggcggcgttcacgcccctgttactgttagtagcttaattaacttttgtgcagtctgatcaatacgtgttggcttgtttgtttgctgcttcttaatttaattcgtatgtgaagtattctgctcaccctagcaaaaaaaaaaaaaatgca

SEQ ID NO: 49359 - DNA, 261 bp, Zea mays
  Clone ID: LIB3067-054-Q1-K1-D10
tccctggtcgtccctctcttcctctgtctcttggtctgtctcttggggcatcatagtttcttccggtacacccaatccttccgcagggataccacatccaatataggtcaagttcaagatcctagctcagggttccaccatcatcatcaccaccaacacatcatcatctcgcatctcgtccagtctatgcttgatctatattggatgtggtatcactggagacggcttgggtctgggggatgcatgatcctgctcatctct

SEQ ID NO: 49360 - DNA, 408 bp, Zea mays
  Clone ID: LIB3067-054-Q1-K1-D11
cccacgcgtccggcacccttctctcagtctcagcgccgtctttcttcgttacctgccgccgctccccgaaggctcgaaccctttacagccggcgaagaagatgcacctgtggccatcgctccggatccgcgactcgttcaagcacggctacctccagaagctggagctcaacctcggcaacatgaagcgcgcgcagcggcagcgccagggccggcagggagagagccaggaggaccaggacggccagcccggcggcaacgggaaggcgccgctgctcgaggaccgctcgccatcggggtccgtgcttgccggcgcgctcgagctcgcctgggacgccgtcttgctcctcacctgctgctgctgttgcttctgctgcggagcctgtagcgacgaaaaggatcacccaac

SEQ ID NO: 49361 - DNA, 427 bp, Zea mays
  Clone ID: LIB3067-054-Q1-K1-D12
tcgcccacgcgtccggaagcggtgacgaagttcttgaaagagagggaggtggacgccgagctcggcggattcttgcacgactacatggcaaacaaggagaagatggaactgctccggtggttgaagactgtcgaatcattccttaacaagtaggataagatcgcacacagaagacaccgtcgatgttactggctggtttgggaacgggtacgctccaacaacaactcgtgacggtcttctgcaatctctgtgatcattcgcatctacccctctgctgacaattgtgtgctgaaaatgtttgtttttaatcagcttagatagctcaacgcacaacgcctctggaaactggtgatctgaatatcctactggtactttcatttctttgtgataagattgttctcaacggtgtatcttttaagatacaccc

SEQ ID NO: 49362 - DNA, 438 bp, Zea mays
  unsure at all n locations
  Clone ID: LIB3067-054-Q1-K1-D2
gtcttcagatcccattgacaatgtcaaggccaagatccaggacaaggagggcatcccgcgcggaccagcagcgtcttatctttgccggcaagcagctggaggatggacgcacccttgcggattacaacattcagaaggagagcaccctccacctggtgctgcgcctcaagggaggaatgcagatcttcgtgaagacattgactggcaagaccatcaccttggaggttgagagctccgacaccattgataatgtgaaggccaagatccaggacaaggaaggtatccncccggaccagcagcggctgatcttcgccggcaagcagctggaggatggtcgcaccttggctgactacaacatccagaaggagagcaccctccatctggtgctccgcctgaggggcggtatgcagaatcttgtgaagaccttgactggcaaga

SEQ ID NO: 49363 - DNA, 439 bp, Zea mays
  unsure at all n locations
  Clone ID: LIB3067-054-Q1-K1-D4
cggacgcgtgggcggacgcgtgggcgacctcggcggcaacaccatcgtcgtccactggtgcctaaggaagaccaacctgcaccacgtatgggacgtgaacgtcatcgagacggccatgaaggacttctacggcaacgaccagagcaccatgatacaggccatccagcagaacattacggaggaatgggctgatgaggagaagaagtgggaggcctgccgtagccggacaaagacctgcgctgacaagtacgctgcagagagcgcgaagctggcctgcacggcgtacgagggtgtcgaccaagactccacctnggaagatgactacttcttcgccgcgctgccggtggttcagaagaggatcgcccaaagaggcgtcaggctggccgcgatcctcaacagggatattggtgggaacagcagatcaagcttcagagcagtt

SEQ ID NO: 49364 - DNA, 429 bp, Zea mays
  Clone ID: LIB3067-054-Q1-K1-D6
cccacgcgtccgcccacgcgtccgtgcagtggcaacttggtcaggcatagattgtcttggttccaaacccagtaggaatcaaatcaagatgcttcacaaaatatgagaaactggtgacacaagcacgttgatggaagtaccatgcaggcccatgaggagaaaattcagaatagatatgtttgaatgccacgtactgagcagcttggaggacattgacaattggcatgccacatactgtgttgtcaaaagcgcgacaggactcataggcttactcgtaagaagtctgaatctatggcttcacttagtcttggtggagaggctttttttttgttctttttttattattttattatttatattttttattctttttttattttttttttatttttttctgtttttcatatttatttattttttttttatttt

SEQ ID NO: 49365 - DNA, 432 bp, Zea mays
  Clone ID: LIB3067-054-Q1-K1-D7
cggacgcgtgggcctgaaaacctcacaaaaccctcgctcgctccccaccaccgcgccgcgccgccgcctgtaccagctgcgtcaagatgagtcggcaccctgaggtgaagtgggctcagaggatcgacaaggtttacatcactgtacagttacctgacgcaaaggatgctaaggtcaatttggatccagatggtgtcttcacattctctggcagtgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttggtgaagatgatgatggtgctgata

SEQ ID NO: 49366 - DNA, 445 bp, Zea mays
  Clone ID: LIB3067-054-Q1-K1-D8
aactgcggattctttctttctctccattcttacgtttccatattaaaatggtatttgttcacttaaatggtaatatttttatctaattttcccattggtttttcaaaagttccttacctgattcccggtgattaaacaactaccttggactgacttataaaattttatttatttagaatggtccctttttttaatttaaataatttcttttttagattatcatattattttttcattttttatttttatatttcattattttatttttttaattttcttttttcttttttttctttaattatctttttgtttttttttatttttttttttatttgtttatattttttttatttttctatttttcttttttattttatttttttattctctttttttttttttttatttttttttatttttttttatttatattttatatattttt

SEQ ID NO: 49367 - DNA, 383 bp, Zea mays
  Clone ID: LIB3067-054-Q1-K1-D9
cacctgttcctcctcttcctcctcctagcacatctagcgcctgctccccttcgtctgtgatcgtgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggctgctgcgactgcaacacctgcaactgcggcaccagctgctgctgctcctgctgcagctgcaactgagccggcccgcccggcccggcgatggctcacgagagtcgagaggactactactactaggcgtttaaatattattaatag

SEQ ID NO: 49368 - DNA, 392 bp, Zea mays
  unsure at all n locations
  Clone ID: LIB3067-054-Q1-K1-E1
tcgnccacgcgttcggccacgcgttcgctgcgattcaaaagaagacaacacatttccttccaagccattgttgcaacctgcatgtattgaaggagcttcattagctcatgttcgggatggccaaacttcaaccttgcttccatctatagcttcctcaagacctgcatgtgtcctcaattggagaagccttgtgccaaatagcgagcaatcttgacagatacatgaaagccctaagcaccaatttgaggagatggacatncacaggcgcttgcatttattagttgatgaggattattaacccgggacaacaaccattcactccactccaattcctacaaaggaaggtccagaactagcatcccagatgatcgaaggattcctccatgccacta

SEQ ID NO: 49369 - DNA, 356 bp, Zea mays
  Clone ID: LIB3067-054-Q1-K1-E10
ctacactcgtccgaccacgcgtacgaaaaaaaaaaaaaaaaaaaaaaaaaaaaaaaaaaaggaagaaaaaaaaaaaaaaaaaaaaaaaaaaaaagaaaagaaaaaaaaaaaaaaaaaaaaagaactagaaagggaataaactaaaaggtagtttctaatggttcaactgagtgacaaactacgtaactacgagccagtgggcacaccaatgttagcgttaatacaagttgaaaggattattgtacaatcaaagcccaaaatctacagcaccgtataagacaaatgcaacagcaagcaagataactaggaacataaggccgaagaggtttgagacaaggcattggtcacggaagaga

SEQ ID NO: 49370 - DNA, 290 bp, Zea mays
  Clone ID: LIB3067-054-Q1-K1-E11
ggaactggaggaactgatcggtggggcccgctcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 49371 - DNA, 240 bp, Zea mays
  Clone ID: LIB3067-054-Q1-K1-E12
tcttgccttctcgaatcggctgcaaccccacctcataccccacctcctcctccgctagggtttgggtgcgaggatcgacagtgtcgaccgctcctagtcttgcctaccgaggcccatgtgcctttctgattgtaacgtcactctatctcagttgcttctactctgttcatactaggctacttcgcacccattcattaaccaacatggtctatggctcgattgattctgttacttctagtc

SEQ ID NO: 49372 - DNA, 425 bp, Zea mays
  Clone ID: LIB3067-054-Q1-K1-E2
cgcagagccagagcaaggcaagacgactcatatatagccacgcgaacacagttagatcgagggagtaagtaagagtgatagccataacggagctgatcgacacatgtgtgaccaggctaatctacatgcttgatgtgctgtaccgcttcgtcaacacatacatctaccgtcaatcggacagccactacgcagaataccgagaatgttacacacatacatgaaagctcgtagcacgcattttgacgagattgacattcacaggcactgccatttattacttgatgagatttattaacccgggacaacaaccattcactctactccaattcctacaaaggaaggtccagaactagcatcccagatgatcgaaggattcctccatgccactaatagtgacatgcctagtattaccattcaaggttgca

SEQ ID NO: 49373 - DNA, 397 bp, Zea mays
  Clone ID: LIB3067-054-Q1-K1-C7
cccacgcgtccgcccacgcgtccgcccacgcgtccggaaaatgttgtggaagcgttcaaagatgtgtctcgaaatgccagtaaagcaaaagacataatcgatcaatgcgataattccgaggggcagccggctgcagaggaggggcggccggcggcgtgctgcagaggaggggcggccggctgtagaggaggggcggccagcggcgtgctacagaggaggggcggccggctgtagaggaggggcggccagctctgtgctgcagaggaggggcggcttcaggtaagttagggtttaggttttgtaatgggcctttggactggttggaccgaactggggacaagtctgccgacttgctagccctagtctacttatatatttcagtcgtgggcaagtttag

SEQ ID NO: 49374 - DNA, 380 bp, Zea mays
  Clone ID: LIB3067-054-Q1-K1-B10
ggtttcttcttgagtttttgggttcatgggcttgcgtgtgagacgtgctgtgtcaaggggggcgcaatccagtgtcccagaggtcacgtggctcacacaggggaagggggggttatgacactggtaggccaaaccatgtcacaaatgtggagaggcggaagggtcgcagccatcttgaataccagccagtctgaccccaaatcaaatctgcagacttccaacagagcctgagcatggaagaacgaaccgaggggcctactgcttctggacaagcgttcatgcagcgtggacacaacagggggctactcccaacatgccgctttgtccagcgaaaccctgcttctacgcctaccactaattctcaccaaaatgaataatct

SEQ ID NO: 49375 - DNA, 426 bp, Zea mays
  Clone ID: LIB3067-054-Q1-K1-B11
cccactcgtccgcccactcgtccgcgttcttgacggcctcctccggcagcgtggactcgtgggtctcaaccatggccttggtcacgcaggaagcagagcctggtgctagagaagctcccagtgccccatgtgttggcagcatatcagcatgaaagatcctatgagccaagagctactagaggctgttgaacaagagaggaacatccgatctaatccttcacgtaatactgctgttttccaccatccaatgctgggtgattttgaggttaagaaactccatcaagaaaagcagttaggaatgatggtggacaaaggcctggtagcaactaggacagggttgagtcagtaccacctgtctcactggcctaaaatggttgaggtgatcaggatgcttgaaggagacatgctcacagagagatgggaggt

SEQ ID NO: 49376 - DNA, 61 bp, Zea mays
  Clone ID: LIB3067-054-Q1-K1-B12
tcggattgttttgcttgtattgttgagcttgtaaagaatatccaacatttgtttggacttc

SEQ ID NO: 49377 - DNA, 435 bp, Zea mays
  Clone ID: LIB3067-054-Q1-K1-B2
aggccaacagagagaaaatgacgcagattatgtttgaaaccttcgaatgcccagcaatgtgtgttgctatccaggctgttctttcgttgtacgctagtgggcgaacaactggtattgtgatggattccggtgatggtgtgagccacacggttccaatctatgaaggatacacacttcctcatgctattctccgtttggatcttgcggggcgtgacctcaccgaccacctaatgaagatcctcacagagagagggtactccctcactacgagcgctgagcgggagattgtcagggacataaaggagaagcttgcctacgttgcccttgattatgaacaggagctggagactgccaggagcagctcctctgtcgagaagagctacgagatgcctgatggtcaggtcatcaccattgggtcagaaaggtttaggtgcc

SEQ ID NO: 49378 - DNA, 353 bp, Zea mays
  Clone ID: LIB3067-054-Q1-K1-B3
gtaaactattggtggccggataacctcttcctcagatttcttgaactcagcttctatatgctgtgaaatacttatgatttatggaacctaacttgggtatgctaacatgggtgtctgctcctttgcagatgcgattcaggcttatgctgttgagccgcaatgacccattgtcctgtggactgctactcatgtttggtagattcgtaaatactactgttatatgcttgaaggcgtgtgttggcattgccatgtggggtttgtgtgactcgatggaaactttgctgtcttattgtactttaaaatccaataatttgcgcgattgcggaaaaaaaaaataaatattttaaaattaa

SEQ ID NO: 49379 - DNA, 481 bp, Zea mays
  Clone ID: LIB3067-054-Q1-K1-B6
ttcctcggtctactccactcgtcctctgactcttggtctgactctttttctagttctagatcgcgagcttcctaccttgtgttggtttattttttgttttggtttttctattcttttgttttatctttttttttttttattttttttatttttttttttttttttttatttttttctatttattttatgtttctatatttttttttttttctttttttctttttttatttttttttgttttttttcttttattttctctttttatttatttttctttttttatattatttttcttttttttttttttttttttatttttttttttttttttttttattttttttttttttttattttttttttttttttttttatattttttttttttttattctttttttttttttttttttttatttttttatttttcttttttttttttattttttttatttttttttttttttttttttttattttt

SEQ ID NO: 49380 - DNA, 55 bp, Zea mays
  Clone ID: LIB3067-054-Q1-K1-B8
tgttctcctgagttcggcaacgtttttgttttcatctagattattaacacaaagg

SEQ ID NO: 49381 - DNA, 465 bp, Zea mays
  unsure at all n locations
  Clone ID: LIB3067-054-Q1-K1-B9
ggtaaccagaagggtgagactgaacaggagcaggctaatcctacactacgtcgccaaggccagcccaatgcaaggtaccacaggggaggtgggtcacacaggggaagggggggttatgacactgggaggccaaaccatgtcacaaatgtggagaggcggaagggtggcagccatcttgaataccagccagtcggaccccaaaacaaagctgcagacttccaacagagcctgagcatggaagaacgaaccgaggggcctcctgcttctggacaagcgttcaggcagcgtggacacaacagggggctactcccagcaggccgctttgtccagcgaaaccctgcttctacgcctaccactaattctcaccaaaatgaataatcttccgcggctgccacatccactgagcttcangaactcgcgcttgttggtggccgttcacaacagataggtttggatgcgcttggg

SEQ ID NO: 49382 - DNA, 316 bp, Zea mays
  Clone ID: LIB3067-054-Q1-K1-C1
ctgtttaactgttgttaccctggttttatagttttaattattaaattttattttatttggaggatgtgtaagagtatgcaggctttgtgggaagattttataagaacatgcgaggttcgtttgaagaatttaactggtttctatggataaaagccagcttgtgtggactgtttcatctgcaatctctgtagaagcaaccaacagagtacggattaaaagccaagtgaatagactgtatgatgtaaattctgttgtagatcttcataggtcccattgttaacactataaatatgttaatcctccatgcggctttcct

SEQ ID NO: 49383 - DNA, 387 bp, Zea mays
  Clone ID: LIB3067-054-Q1-K1-C10
ccagccgccgtcggatcggatccgatccaaagcaagcagcagcagccggctcctcctgcgcctgccgcagcagccacaccccgtccgtcaccagaggaagaggaggaggatgtcgggatcgaaggtgtacacccttgaggaggtggccaagcacaacaccaaggacgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaacaccgtccgtgcaatgattgacgagttccttgtcggtgagattgattccgccacgattcccaattaggtgaatttcacgccccc

SEQ ID NO: 49384 - DNA, 362 bp, Zea mays
  Clone ID: LIB3067-054-Q1-K1-C11
ggccgctccttttttttttttttttttttttttttttcttttttttttttttttttttgtttggttttttttttttttttttccataaccagccaggacccttccttttgtatttccaccccacacaccaacatgacaaactttccaaaccaatcggactaaatccgagcaacccggcaaaatcaaactcagctcgaaaccggcttagcgcggaggcaaaccaggcccaagggtttcaagcccccttaggcaacaaaggacaggacaggaacaggaaaggcgaggcacttggacattggggcaaagaggggaaaaccagtttgcgaccagggtttttacggccgttaatgcaatgctccacg

SEQ ID NO: 49385 - DNA, 286 bp, Zea mays
  Clone ID: LIB3067-054-Q1-K1-C12
tcggactcgtgggatccatctccttatgtgaaataacataacatgcagtgattaccatgggacgggttctgctagctgttaatacatgttgattgatcagcattggatgattgcgaatactaaacaagtcatccttcttcacaacaatttccaatactacctaatccatgtgtattgtgaataaccgcacaagccgtcatgtggtcggcgcatcatagtaatactacatgacagcctcttcatcttattactaatgtagtacatcatcatccccgataaaacataa

SEQ ID NO: 49386 - DNA, 435 bp, Zea mays
  Clone ID: LIB3067-054-Q1-K1-C2
ctgatgtttgacggtcaggacgacaagctgtttgagcacttctccatggtcgcgcagaggcttggcgtttacactgccagggactacgccgacattcttgagttccttgttgacaggtggaaggtggcggacctgactggtctgtcgggtgaggggaacaaggcgcaggactacctctgcacccttgcttcaaggatccggaggctagacgagagggcccagagcagagccaagaaagcaggcacgctgcctttcagctgggtatatggtagggaagtccaactgtgaaatcggaaacccattgcgactgcttgagttggagcatagtctatcatgcaccctaagacgcatcgcgacgacaagacctggtgtgtcgcgtgacatagttgttcaggttttgaccaaatggtctgggagcatttgttttgccttgtg

SEQ ID NO: 49387 - DNA, 432 bp, Zea mays
  Clone ID: LIB3067-054-Q1-K1-C3
cagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggaggctaggctaggcgcctcttcgtagtcggggactggttaggggacatgtctctgtgtgatgctttctgaggtagtattgc

SEQ ID NO: 49388 - DNA, 429 bp, Zea mays
  Clone ID: LIB3067-054-Q1-K1-C4
cccacgcgtccgggtatactctctgcaattgatgatgggaagtctgagggaggtccatgtggacgacattgggtgcttgatccgattgacggtactaaaggtttcttgaggggcgaccaatatgccattgcattggctctgcttgatgaaggtaaagttgttttgggtgtattggcttgtccaaatcttccattgtcatcaataaacaacatcaatggtaactcttcgggagataaagttggtgccctgttttctgctacaattggttgtggggctgaagtagagtccttagatggctctccaccacaaaagattagtgtttgctccatcgacaatcctgtcaatgcatcattttttgaatcctatgaaagtgcacactccatgcatgatttgactggctctattgcagagaaacttggtgtccaagct

SEQ ID NO: 49389 - DNA, 430 bp, Zea mays
  Clone ID: LIB3067-054-Q1-K1-C5
cggacgcgtggttcatccggcttcgcctgcaaccgcgtgcgctccacgcctggtccagggaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgatcagcgcaagaatgttgctac

SEQ ID NO: 49390 - DNA, 220 bp, Zea mays
  Clone ID: LIB3067-054-Q1-K1-B1
cagctagctagcgttcctaatcaccgactaataatctcttcttcacctcactaacacctgtctagcagctcgctctgtcctgcaacaatggccgctcgctcctgctcccagcagctggtcgcggcggcggtcctggcagcggcgctgctgctgctggctgcaggggccgggacggcgtcggccgcggagagctgcggcgaggtgacgtcgtcagttgctt

SEQ ID NO: 49391 - DNA, 441 bp, Zea mays
  Clone ID: LIB3067-053-Q1-K1-H3
cccacgcgtccgcggacgcgtgggctcaaggagggaggcgtcctccctggcatcaaggtcgacaagggcaccattgaggttgttggcaccgacaaggagaccaccacccagggccacgatgacctcggcaagcgctgcgctaagtactacgaggccggtgcccgctttgccaagtggcgtgctgttctcaagattggccccaacgagccgtcacagcttgccattgacctgaatgctcagggtctggctcgctacgccatcatctgccaggagaacggtctggtgccaattgttgagcctgagatccttgttgatggccctcatgacattgatcgctgcgcttacgtcactgagacagtccttgctgcctgctacaaggctctcaacgagcaccatgtcctcctggagggtacccttctgaagcccaacatggtgactcct

SEQ ID NO: 49392 - DNA, 363 bp, Zea mays
  Clone ID: LIB3067-053-Q1-K1-H4
cacctgtaaacaatgtacattcttccaatgtaagaccgcagcatactcaagaagtataccggtcaaatcccagttcaatcttctcatcatcgctgaatgtacagattcagttcaaagaatgaccggtctactggcatgatcacatatatcctcatgacattacatctgacgaactgctggattctacgtgaggcagcattgaacacaactcctactgaaaagaagcaagaatcatgctacttctggctgcagattgtttggcattgagataggttctgcagtatcaccagtggctactgttgctagtgttggccaggatcagccacctgctctgtcatttgacgttgaatctgatcagctggc

SEQ ID NO: 49393 - DNA, 431 bp, Zea mays
  Clone ID: LIB3067-053-Q1-K1-H5
cccacgcgtccggtgcaggggagttgcagtaccgggtgtcgaaagcgagtctggatgaccggctgagcactgataccctattctccagccgtgccataagcgaagactgcagggttctcacgatccacggcgccaaagacgagatcgtcccggcggaggacgcccggcagttcgcggcgaacatccgcaaccacgagctgcgcatcatcgcagatgccaaccaccgttacaccgggcacagggacgagctggcctcgctggtgctgggcttcctcagctcccatccctaccagaccacgtcgcgcttgcgtccgagactgtagatagagtagagcacacccacttgaccgtttgcgaacaaacaaacacaaaaaaaaatcccctgtaccaatccaagagttgtgggtatggtgatgtgtttatccagaacc

SEQ ID NO: 49394 - DNA, 369 bp, Zea mays
  Clone ID: LIB3067-053-Q1-K1-H6
gaaatccccagctgagcctgcccaagctttctcattttcaagaccgcagcaaactcaggagtgataccattcaaatcccagttcaatcttctcatcatcgttgaatgtaggattcagttcaaagaatgaccgttctactccaatcaacagtcatttgtactggacaatgaggctgacgaactgttggattctactgaggcagcattgaacccaactcctactgaaaagaagcaggactctgctacttctggctgcagattgtttggcattgagataggttctgcagtatcaccagtggctactgatgctagtgttggccaggatcagccacctgctctgtcagttgacgttgaatctgatcagctggca

SEQ ID NO: 49395 - DNA, 414 bp, Zea mays
  Clone ID: LIB3067-053-Q1-K1-H7
cacacgccaaatttacagctagttagctgaattcgatcgatatccaggaactaataatccggcgacccggctcatggcggcttcgtcgcgaatgggcttatccgtctacctcgccatcatggcggcggtgctcgcctcggcgctcggagcggagctcaccgcggactactatagcgagacgtgcccgcaagcgctgaccaccatcaagctcctcgtcggcgccgccatcctgagggagcccaggatgggggcgtcgctggtccgcctgcacttccacgattgcttcgtcaatggctgcgacggctccatcctgctggacgacaccgacgacatggtcggcgagaagaccgcgaagcctaacaacaactccgtgagaggctacgatgtcatagacaccatcaagtcggcggtgaa

SEQ ID NO: 49396 - DNA, 363 bp, Zea mays; identical to SEQ ID NO: 49392
  Clone ID: LIB3067-053-Q1-K1-H8

SEQ ID NO: 49397 - DNA, 450 bp, Zea mays
  Clone ID: LIB3067-053-Q1-K1-H9
acttgaagaagctgaaactctcagctgggggactcaacgtgatacaatgcaacagggaatggtgggatgggcttgagtgggatgatgaggaagtcaaagcttcttatgagccattgttccgcccattgcactgaactcagttttggttgctagagattcttctgttattttagaggttgctcttcctcgtgcatgcagtagatcgcgttaattcagagatggccagtctgcactctgcagtgggtgtgatcgtttgtatttgtccagcttgcaagtacaagttgggcgattctttcttttttgcccaactcgtgttctatagaaagaccagtcagcatgtgtggcagccaggaaactggcatatgtaactgtcgaaatctcctgaacagaatggctggtggataccggtataaccattttctctaattctcccattctgctctctatgag

SEQ ID NO: 49398 - DNA, 282 bp, Zea mays
  Clone ID: LIB3067-054-Q1-K1-A1
cacgtttgttgacagaatcaggaatgactgacgcgtatgacttatctagcgatactacaggtgcttaaaaccctgtgtctacaaaacccactgaatctgccagagttgaggccacatattctactgatattcaactggagaatgaagaagtagataagaaagaagaggaccagcatgcatacacaaccaatgatgatgtttctaaagagtattgtataatgctcaaatataaatctgcataaaataacaaggcctgattttttatctaatgtgcttgaatct

SEQ ID NO: 49399 - DNA, 179 bp, Zea mays
  Clone ID: LIB3067-054-Q1-K1-A10
tcccggtctacccactcttctctaaaaaaaaaaaaaaaaaaaaaaaaaaaataaattaataaactaaatcatatcgtaataaatgaatgattagtataaactcctgtcatgttcaaacgtaatgattagacagtatataaagaaaaagataaaaggaattaaatatacaaaatatttaa

SEQ ID NO: 49400 - DNA, 220 bp, Zea mays
  Clone ID: LIB3067-054-Q1-K1-A11
aattccctcgtctacccactcttccttccactcacattcccacaccttcaatttccattcctcatcatcaccatcctctatcagattggcttcctaacaatactatcctactcatattattacttcattccatccatacaccaatccaatctcatgattctataactctattattaccatatctaatattatataaccatcaaactctaatacactctta

SEQ ID NO: 49401 - DNA, 437 bp, Zea mays
  Clone ID: LIB3067-054-Q1-K1-A2
cccacgcgtccgcttcccgagcaggaggcggacaaggtaagcagcaatcgcaggaacccgagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggtggcgagtg

SEQ ID NO: 49402 - DNA, 435 bp, Zea mays
  Clone ID: LIB3067-054-Q1-K1-A3
cccacgcgtccggaaaaatcgctccatcccctgactatcactggctcactgcccttccagctccaggttccagcggccatggtgaagaagcccaacggtgtcgccaaggccacggcgacctctgctgacgcggcagcccagccatccaaggagaatccgtccacccctgggttggtcaaggcctcgaagtttaagaagagaaaggtcaaggccaaccgtgcgaagcaggcagtcgctgcagcagctattgacgaggtcgccccggtaggtgcaggcactggtgatggcgatgcatctgcatcagtggctttaccgcaaccatccgatgttgccgaggcattacctgtggtgcaaacgccaaagtcaaccacttttgctgaggcatcacctgtggcacagactcaaaagccagccactgatgttgaaggattggtg

SEQ ID NO: 49403 - DNA, 396 bp, Zea mays
  Clone ID: LIB3067-054-Q1-K1-A4
ggcgtgctgaaatcggtatccagcacgttgattggcgtcagtcctgagtttgaggttgcgctctacacgttgtgcttttttgttggaggggaagataaccgcgtcgatattggcccgtatagtgtgaacgtcaagtgctaccgattggggaacaacaaaattggatcagcctttcccattgcagagaactgattatctggtgctatgcttctgcaggtaccatactgttcaatttgttgctgccatctgcaatcgtattgctacttgcactgctaaaaagttgacgaccgagactgaagttacttttcatgattttgttgctgtggatgtggaagctttccgatgtatattttctgcctttgtcatgtttatttactgatatgctgtttgttgatg

SEQ ID NO: 49404 - DNA, 430 bp, Zea mays
  Clone ID: LIB3067-054-Q1-K1-A5
ggaaattcaaacgacgttgcgtgaggaaatcaaaagtgcttgtgaatatcgtgcatttggaaagtgtgattacagtgcaaggattgctggccgagctgcagaagctggaggaggcgatggggtcgccgcgcaagggcggcgtcaaggccatctgaccatggcctgcgatgaaccgcgcgcgatgcatgcatcatgtcctgctagtgctagctggatcagttgcgtgcttatttgattattgttatgatggcttggtagatccgaattattaactgactgcaagtagacagacatatatatgcgtgtgtgccttattttctttactattatatatatgatcgttcgtttgtgtgttcttaaaaaaatatatttattatttaatttatttatttattttttatttaattttattttatttttattttttttt

SEQ ID NO: 49405 - DNA, 442 bp, Zea mays
  Clone ID: LIB3067-054-Q1-K1-A6
caccgactcggcgtagacaacctcctcgtcggtgccatggacaccaactgggtcttgtctctacttccggggcgtgcccgtctttgatatggccagcatgattgtcacttttgattccttctttggctatttcttattttttttctctttctttatttacttttttttattttcttattttattttttttttttttttattttatctttttttattttttaattttttattattttttttttttttttttttttttttttatcttttattattttattatatttttttgtaatttttttttttttttttttttattttttgtttttattattatattattattatttttttttttttttttttatatttttttttttttttattttatttttttttttattctatttttttttttttatttatattttatttttttttattt

SEQ ID NO: 49406 - DNA, 388 bp, Zea mays
  Clone ID: LIB3067-054-Q1-K1-A8
cagactgatgcgtgaatactgatcaaagggggctggaactcgagaacaatgagtggtgtgagtatgatcagttcagagttaggcaattcagttagtgcaaggatatttcaaattagttacccgacctctttttttattgcatattgatatctagaataagatcgatccaaatcacttgaatgctaattttgtcaaaagtatccttgtgtgcttaatttaaccaaactttgctaccttccgtcattacatgtatttatcagaattcgcaatttcgtcctattttgtaatatggtgaactgacctgactgtttgcttatttgcttgcttggtcccacctttttccctcaaaaaaaaagagactttttgctcatgagctttgagattgcca

SEQ ID NO: 49407 - DNA, 219 bp, Zea mays
  Clone ID: LIB3067-054-Q1-K1-A9
tcggcggacaagcccccagaccggttgcctccattactgagctgtgcgtgcgtggtggcggtctgccttgtggctgcgccggtcatggtgatggtagagatggactgtggcgtaggaggaggaggaggtggaggactgtatgacgctcttaagatcatttctcatattctataagcatttatcttgagtcaacaattatgaactgtgatggtttttaag

SEQ ID NO: 49408 - DNA, 363 bp, Zea mays; identical to SEQ ID NO: 49392
  Clone ID: LIB3067-053-Q1-K1-H2

SEQ ID NO: 49409 - DNA, 205 bp, Zea mays
  Clone ID: LIB3067-053-Q1-K1-F7
tcccacgcgtcctcccactcgtcctaaaaaaataaaaaaaaaaaaaaaaaaaaaaaaaaaaaagaaaaatttgaaaaaaaaaaaaaaaaaaaaaaaaaaaaaaaaaaaataaaaaaaaaaaaaattttatttatattaaaattaaaaaaaaaaaaaatatattttaataaattaaaattaaatttaattttattaaaaattaaat

SEQ ID NO: 49410 - DNA, 433 bp, Zea mays
  Clone ID: LIB3067-053-Q1-K1-F8
ggcagaatttgtgctgaggctgagaaggtattcaaccaagatttatactacaagcggactgtgaagtatgtgggagaacctatgacccacttggagtctattgcttcttcagcagtgcgagctgcaatcaaagttaaggcatcagtcatcatttgcttcacctcttctggacgagctgcaaggctcattgctaagtacaggcccagcatgcctgttctatctgttgtcattcctcgtctaaagacaaaccaactgaagtggagtttcacaggtgcttttgaggcaagacaatcactcatagttagaggcctcttccctatgcttgctgatccacgacacccagctgaatctaccagtgctacaaatgagtctgtgttgaaggttgctcttgaccatggcaaagcctcgggcgtgatcaagtcccacgaccgcg

SEQ ID NO: 49411 - DNA, 415 bp, Zea mays
  Clone ID: LIB3067-053-Q1-K1-F9
cccactcgtccgaatcttagtggccctctgtcacttccaactcgtgcttctgcaaatagtctgtctgctcctattcgatcttctgcaggttatgtaggctctttgggtgataaacctaagcgcactatggtggaaattaaaggccgcttctcagtgacatctgagaatgtggaccttgcaaaggttcaagaaattccagggagcagtgcctcacgtaaattgcaagtggtaagaattttccttggtcccttgttcataaggaactgttactttgctttagatatatccattttttcaggggccttcactgagaaaatcagccagtgttggcgattggtcagcaaatgataagacaacgtctactaatcatcaaaagaaggaactctgcaatagctctgtatctacatcaattctg

SEQ ID NO: 49412 - DNA, 449 bp, Zea mays
  Clone ID: LIB3067-053-Q1-K1-G1
cccacgcgtccggccaactcctccgcggcccacgcgggaggcccgcacgccgggcgcgtctgctgcaaggccggcggcgaggactacagcctcacggtgcgcaacggcacggcgtgcctggcgcccaccaacccgcgggacgagtaccagcactgggtcaaggacatgcgccacagcacccgggtgcgggacgaggagggctacccggccttcgcgctcgtcaacaaggtcaccggcgaggcgctcaagcactccacggggcagggccaccccgtcaagctcgtgccctacaacccggactaccaggacgagtccgtgctctggaccgagagccgcgacgtctgcaacggcttccgctgcctccgcatggtcaacaacatctacctcaacttcgacgcctttcacggccacaaggcccactgcggcgttcatgacggtaccgagatcgt

SEQ ID NO: 49413 - DNA, 385 bp, Zea mays
  Clone ID: LIB3067-053-Q1-K1-G10
tcacacgcgtctgaccacaccatcgaccacgcttacgactctagatcgccagcggtcgcagaggagtggctttatcgataaggcaactatacttggttacacaatccatattcttaaagatttgactactcatgtgaacaagctgaaagctgaatacacttcactttctgaagaatcgtgtgagttaacacaagaaaagaatgagcttagagatgagaaagcttcactgaaatctgaggttgataatttgaataatcagtatcagcaacgaattctggtgctatacccatgggttggaatggagccttctgttgtcatggggccaccttctgcatatccctacccagtcccagttccaataccctttggtgctgtacccattcat

SEQ ID NO: 49414 - DNA, 428 bp, Zea mays
  Clone ID: LIB3067-053-Q1-K1-G11
cccacgcgtccgcccacgcgtccgggccgccctttttttttttttttgatccagggggaaagggagtaagcttggccgtgacctctatatcaggatatcaagtagtaagtccgtaaatctagaaattctgtactaaacagcaaagccaaacgaatatgtagagtgagcgaacagacgggacgaatcccaaaacgttttcctactactgccctacagccttcgttcgcatgatgtagggatcgagagcgccctcatagcggtggccctccgagcccgtcatcgttgtcgaactcgtgcatgtgatccaagaggtagttggcggtcagctgctcattcttgttgcacgcgaagaacaacttcaggaccagtgcccggtcaaagcccatcccttcaagacgaagtatagcttcgttctcctttggagtcac

SEQ ID NO: 49415 - DNA, 448 bp, Zea mays
  Clone ID: LIB3067-053-Q1-K1-G12
gctcaatcggttgcaatggactgtgaacccactctgcaaatcgggtaccctcctcatcaccagtttctgccttccgaggcagccaataatatcccaaggagcccccctggaggcgagaacaacttcatgctgggatgggttctttgagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaaaatttaaagatttatctatgctgccggtgctgcggtgcatagcccggtgcatagaatcc

SEQ ID NO: 49416 - DNA, 423 bp, Zea mays
  Clone ID: LIB3067-053-Q1-K1-G2
gaccgaggcagagctagaggaccgcaagctccgcatagaggacgcgaagaatgcgacttttgcagcaatagaggaaggtattgttccaggaggcggtgcagcatatgttcatctatcgacattcgtaccggctatcaaggagacgttggatgatcctgaggagcgcctaggtgctgatatcattcagaaggctttggtggcacctgcagcgctgatagcccataatgctggggtggaaggtgaggtgatcgtggataaaatccggtaacgctagtgggagttcggttacaacgccatggcggacaagcacgagaacctggtggaggctggtgtgatcgaccctgtcaaagtgactaggcgcgccctgcacaacgctgtctccgtggctggaatggtgctgactacccaagcaatcgatgtgga

SEQ ID NO: 49417 - DNA, 432 bp, Zea mays
  Clone ID: LIB3067-053-Q1-K1-G3
attttggtctgaactcggcatcagatattccagagctgattggtaccctagaggtccctgatatccctttctcctgcatctctgttctgaagaggtacagcgaaggcgacatggcggcgtacaagatgttttcacgggcaaagctggatgatggtttgctggatcagatcttcagggctcggatagagacgatccggatcaactgggctgcttacccgcactaccaagccccagaggagtttgctccgatagcgttggaccggaagcagctgtactacgtgaacacctttgagagcgcctcgagcgccatagaaactggtgctgtagcagcagaaaacgtggcgcggctcatcatctccaggctctctctactaccgcaggcacagcagcagcagcctcatatcatcaagtcattccccgaacaaggaatcc

SEQ ID NO: 49418 - DNA, 405 bp, Zea mays
  Clone ID: LIB3067-053-Q1-K1-G6
tacccactcgtcctactagtactagatctgcacccctcacatgcttcactacttatgatttcctccaccaaccacgccaccatgcatcttattctatcaactcattcttattatcaacattacaataataattttcttcctatcaacaacattcacatctactacctacctttctgcttatataattacattacctctactatctacttctctattaaatctacctcctattttcttcaataattatctcttttctttactcttctcttatattctatctatcacattatattatattattctcattttattttataattcttaatcatctttctaattctacttttctttctattaattttatcaaactatattattaattaaatttatttaaaaaaataaaat

SEQ ID NO: 49419 - DNA, 448 bp, Zea mays
  Clone ID: LIB3067-053-Q1-K1-G8
gaaatccccagctgagcctgcccaagctttctcattttcaagaccgcagcaaactcaggaattataccattcaaatcccagttcaatcttctcatcatcgttgaatgtaggattcagttcaaagaatgaccgttctactccaatcaacagtcatttgtactggacaatgaggcagacaagaactgaatcctactctgctagcattaacaaagctcctactgaaaagaagcaagaatctgctacttctggctgcagattgtttggcattgagataggttctgcagtatcaccagtggctactgttgctagtgttggccaggatcagccacctgctctctcagtagacgttgaatctgatcagctgtcacagccatccaatgccaacaaaacggatgccccagtggcaagcagcgagcgctctcttaacgagtcagagagccggcaagtc

SEQ ID NO: 49420 - DNA, 272 bp, Zea mays
  Clone ID: LIB3067-053-Q1-K1-G9
ttctagatcgcgagcggtcttcctttgtttgtttttttttttttttttttttttttttttttattaatattaattttaaaaggtaaaatactattaaaatattgtacaaatacacaaataaatgggtacatatttaatatcgtatcaagtatacggtaaatttatagggccaataaaccaagcatacaatacaattatgtttcactaatgaaggaaagcaaaagtcgttattcaagaactattcaaactagggtaactttagacttggtcaa

SEQ ID NO: 49421 - DNA, 261 bp, Zea mays
  Clone ID: LIB3067-053-Q1-K1-H10
cccactcgtccggtctactctaggagaggaggctgttctgtggtggcctcacctgccctgcgatgagtatacaaaataacggagctctactcgggtagaaacctgatggcccgccgcttcccaccacttattcctttcagttccacacactcctccattctacgtctacgcctatacgctgccttacctcctgcttcgagctgctcgcgctaactgcgcgaccatcaatgctcactatgcagtatctacgttcggtggcat

SEQ ID NO: 49422 - DNA, 430 bp, Zea mays
  Clone ID: LIB3067-053-Q1-K1-H11
ctgaacaaggagaagttccgggcgctcgtcctcaactccgtcgtgctgctgacgttctcagccgcgctcgtctgcgtgaaccacggctcggacgagaccggaagcagcatcccgaaggggaagttcccggcggggttcgcgctcacgctgtcggcgtcggcgctcttctccctgatcctgtccctgacgcagctgaccttcgacgaggtgctgaagagcgactcgctccaaaccgtgctggagatgcagttctggagcaacaccgcggctgcgtgcgtgtctgtggccgggctcttcgcctccggggagtggcgcaccatcttcggggagatggatgcgtacaagaagggggaggtggcgtacgcgatgacgctggcgtcgactggcttctcgtggcagctgtgcacgatgggcctcatggggctggttg

SEQ ID NO: 49423 - DNA, 369 bp, Zea mays
  Clone ID: LIB3067-053-Q1-K1-F5
tgcctcccttttttttttttttttttttttttttttttttttttttttttttttttttttttgttttttttgtatttttttttttttttttttttttttttattaaaaaatttaaaatattttaattttataaaaatggaaaaaattaaaaatattttttaaaaaggataaaatcaaaaaggaaaatttttttaaaaaaaaatcattaaaattttaaacttcttatgtaaataattttaaaatattgacttattaaaaaacttttttgtcaaaataaaaaaattcacttgaaatgtttttaaataatttaaaattataatttttttataaggcctattattaacaaaaattaaaaattgtccttttttt

SEQ ID NO: 49424 - DNA, 295 bp, Zea mays
  Clone ID: LIB3067-053-Q1-K1-E10
attccctgttctacccactcttcctaaaaaacatacaatacaacaaaaatacacaaatacaaaaacaaaaacaacacaactcatcaacacggacctataacatatactaaaactcaaaacatacaactaaacacaaaactaactaacatacataacaacataaaattcacctccaacaattacaaccctatcatccctatccttgcaactccccctactctccttcactatcaccatctatctctcccttttcttccacaccatcaaacccacacttacactcttttccatactt

SEQ ID NO: 49425 - DNA, 306 bp, Zea mays
  Clone ID: LIB3067-053-Q1-K1-E11
ccaacccttccggttcctttcctccaaccttgtaaaaccgaaagttttttcccattcccctaaaaagccaaattcctagatcccaaacttcccaaaaagcccttccctattaacggttcctcccttgtaatgtaatagtcctggtcctccaaaaggtccacctaagtttcctcaacgattccaatcccaaaaattccttccgccagatttttaagaagggccctataaccccggtttgccctggccttcctaaccattgccacccaccattccaaattttataccttccttttgttccaattcttt

SEQ ID NO: 49426 - DNA, 419 bp, Zea mays
  Clone ID: LIB3067-053-Q1-K1-E12
gcaatcatggaaggggaatgctggacattacttgcctgactggaaccacaatgctggtgcacgtaatagcgataattctggtgatcgtagctccaatggacgtgaccggcgatcggcctcaggctgggcgcttcctgggaccgagcaaggccgtgatccgaggcgcaacgggaagccaaaatcacgggtcatccctatctcctgaagagcatggacggagtagatatatagtagataaataaacagctggtttgtactactatgcaaggtttaggttcaagatcgtttcaaggaaacgacctgaggtccaggtaaccggagtccgtccagcacatcgcgtgctattgtctgattctgtagctgtacaatgctctgctaccttattatccgtgatgtgaaacattttgtgtcgtccagtc

SEQ ID NO: 49427 - DNA, 214 bp, Zea mays
  Clone ID: LIB3067-053-Q1-K1-E2
cactcgtacgcccacgcgtccgcccacatcgtccgcccacgcgtccgtccacgcgtccgcccacgcgtcctgccacacgtccgcacacgcgttcgggaaccgcaagccttccggttctacatcagatacttgtctagtgcctacatgcattccaaatcatatgcaaccactctgtacatatctgacttatctcacttagtatgggactgtgctt

SEQ ID NO: 49428 - DNA, 451 bp, Zea mays
  Clone ID: LIB3067-053-Q1-K1-E3
cccacgcgtccgcacaagaagaaggtggagtccaagaactcgctggagaactagtcctacagcgatgcgcaacacgatcaaggacgagaagatcgcgtccaagctggctgccgacgacaagaagaagatcgaggacgccatcgacgcggccatcagctggctggacgccaaccagctcgccgaggcggacgagttcgatgacaagatgaaggagctggagagcctttgcaaccccatcatcgccaagatgtaccagggcgcgggtgccgacatgggaggctccggcggcatggacgaggacgctccggctggaagcggtggccctggccccaagatcgaagaggtggactaagcggtttgtgtcagtctcgtgtgtctgctgcagtggctggctggcccaatcgctgctcgatttatcgtcgtcttcccggtgtatccgcgttagaacctt

SEQ ID NO: 49429 - DNA, 450 bp, Zea mays
  Clone ID: LIB3067-053-Q1-K1-E4
actagttctagatcgctcgctacgctgatcgcctgcccttcgaccttgatcgcgagaaacggcgttcacttactacacttgctgcgatctcgatcacacttctgtttgcctggaaaatgttgagagctcctcaagagcaacctcggaggcctcgtaggagagctgccccatcatctagcaacaccagcactagatcgcgaccaggtgctttaaccgcagcagatgcttgttcatcagcagattcaagagcacacgaagcagtcaaccagcttttccagccagtaaatctgactcttgagcagcttgtcaggcataagctaagcgaagggcgaaagttcacatgccgcttgcttggtgtgattttagaagaaacagctccagaggagcttcagaaccatgtcacagtgaagccttccgtggtggaagttctccttgagattgcaaaattct

SEQ ID NO: 49430 - DNA, 298 bp, Zea mays
  Clone ID: LIB3067-053-Q1-K1-E5
gagagagcggcccccgtgaggagctcccacacctcgactgctggcctgctcgcgtggcctcgcccctatgtcgccctttaacttccagcacgccaacctaaccagccaactgaggaattcaggaatgaagaagatggaggacaccatcaacgctggcatcaactggcttgacaccaaccatcttgcctaagcctatgaattctattacaagattaaagaactttagagcctttgcaaccccattatcgtcaatatttaccaaggctctgtttcctacatttgaagcttcttctgcatt

SEQ ID NO: 49431 - DNA, 436 bp, Zea mays
  Clone ID: LIB3067-053-Q1-K1-E6
gctgaaagccaagaagcactgaagaatggcactgccttggaagctgcaaggaatagtagagcgtagaactgtatagccctgaatttgtgataccatgcccttcctgcttgtacctagatcgcctgcatttcgggtgcctacctccaatccaatgctttgccaccagtagggttgtttttggtattccctaacttgtatcgttatttcccgtggttttacaagtcgaagaactcctaggtcagctgttattacacctccaatatatccatgaatacaggaatgggcaactagtctgctaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaataaattataataaatataatattatttatattaatattaatttttat

SEQ ID NO: 49432 - DNA, 306 bp, Zea mays
  Clone ID: LIB3067-053-Q1-K1-E7
acccactcctacccaccactcctcccacacctcataacaagaactctaccaacactacacactcaatctacacttcgcccactctgatccctttaaccatcactaaccacccgactacatccatatcctcctctcctaccacactaacaatatctaggacaccatcgacgcctccatcatctcactccactccaaccatctctcctattcttactatttctataacaatattaatgatctctataaccttttcaaccccattatatccaaaatttaccaatgctctttttcctacattttattctc

SEQ ID NO: 49433 - DNA, 383 bp, Zea mays
  Clone ID: LIB3067-053-Q1-K1-E8
cgacccactcgtccgcccacgcgtccggttctgcgtttcgcgactgagatagccaaccctgcgactgcgtgcgggcgggcgagcgagcaggcagaatggagcgccactcccagaagcaggcgccgctagtcctcgcgctgtcctgcctcctcctcctcgcccccgccctcgtcttcgccgtccccactccaagaagcctgcgcctggggggccagcagcagcacccgccggctctgaagctcacttcttctcaggaggcggcgatcgcggcggcgatgaacatgggcaggccgactgctagggtggccgttgaggttaacgactaccaaccgtccggccccaacataccgtacgacctatccatgggcccctgaagagcttgt

SEQ ID NO: 49434 - DNA, 423 bp, Zea mays
  Clone ID: LIB3067-053-Q1-K1-E9
cccactcgtccgggacgactagatacgcgtgggcccggaccggtcgtcgcagctcgtcggccggtaccagggcgtcttcttcggcacgagcgtgcagctgggcgccggctacctgtcgtccatcacgctggtgttcaccgccggcgagtacaaggggagcaccctgtccgtgcagggccccctgctcgggttcacgggcaccatcgagcgcgccgtggtcggcggcacctgcaagttcaggctggcgcgcgggtacatgcttttcaagatgataagcaagccgacgcctgagacggacgtcaacgagatcaacctgttcgtgctcatgcaccccgctggcaagtactagcgcacacaccttgagactcgagtgagtggctactaccgcattgttgttgggcagaggttgggtgaagtgtctat

SEQ ID NO: 49435 - DNA, 291 bp, Zea mays
  Clone ID: LIB3067-053-Q1-K1-F1
gaccaatcaactgatcttgctcctcgtaggaggaagcaaaaaaaaaaaaaaaagaaaaaaggaaaaaaaaaaaaaaaaaaaaaaaaaaaaaaaaaaaaaaaaaaaaaaaaaaaaaaaagaaaataaaacaaaataacaattctataatgacacttaaataaaataaaatagtccgaaaatttacaacattaaaaactaaaaaaacctcggagtaaataaacttaatcgactttaaaaacattaccattacgcaagttaacatattagcaaaaaataccttatcaaccagaa

SEQ ID NO: 49436 - DNA, 451 bp, Zea mays
  Clone ID: LIB3067-053-Q1-K1-F10
cggactcgtgggatgttgaaactgttgagtacaagaacattagcttcacggtctgggatgtggggggtcaggacaagatcagacctctctggaggcattacttccagaacacacagggtcttatctttgttgtggatagcaatgaccgtgaccgtgttgttgaagccagagatgagctgcacaggatgctgaacgaggatgagctacgtgatgctgtgctgcttgttttcgccaacaagcaagatcttcctaatgccatgaatgctgctgagatcactgacaagcttggattacactccctgcgccagcgacactggtacatccagagcacttgtgccacaactggcgagggtctgtacgagggcctggactggctgtccagcaacattgcgagcaaggcttgaatatcaaatgcgaactgactaggagctccggatgtatcatggaaact

SEQ ID NO: 49437 - DNA, 279 bp, Zea mays
  Clone ID: LIB3067-053-Q1-K1-F11
tcttcctctcactcttgagaaaaaaaaactaaaaaaaacataaatacaaataatacaaatacaaaaaaaaaagaaaggtaatattaaaatctaaaaacatataatataaatcacttacaaaaatcacacataatctaactatgttaaagaatcaaaagtcaactttatagtgacatctaatactgttatcctctcaaaagtttaccaaattacaattagcttcaccttacttaaatagcattatttaacaactttccatacctacctaattatataaaa

SEQ ID NO: 49438 - DNA, 297 bp, Zea mays
  Clone ID: LIB3067-053-Q1-K1-F12
ctcacgcgtgcgaatatcacactccgcaggtcactttcacctagtccaacctcatatatcggatgggctcctactatatctcatctatcctatgtcagctctttcagcgctcaccctaaactctctataatctatactaccagtcctctcctcagtctcatctaacactgtcatccttcacaagatgcacgaaatcacaataagcttcgcgttacgtaacttccaagtgtcaagaactcgactaatccaactaatcataatgatccgttactatagctctagatatactctagattt

SEQ ID NO: 49439 - DNA, 428 bp, Zea mays
  Clone ID: LIB3067-053-Q1-K1-F3
ggcggagaagcttgacaagatctgaggcgggggcattgggtaacgaaaaatgggtgcgatgtgcaagaattcagcatgtctctttgctgctttatcattgaacttcccattcttgtcttgctgtcacgtcccctggggttcaatactatgatgcacacagcatcctggcagctgcaagaattcatccccagtcgagtcacgaaaatggtttgcgtgttggctatgtcgtgtaagcttattcagttattcttggtggtttgggtcggtatcgtgtcattccccgtttaggtagctctgtaatctactattctcatgtgtgttgccttccaatcagtaatagtaatcagcaattgtctgccaaaaaaaaaaaaaaaaaaaaaaaaaaaaaaataaaataaaaaaataattaaaaaaaaaaaaggggcggc

SEQ ID NO: 49440 - DNA, 422 bp, Zea mays
  Clone ID: LIB3067-053-Q1-K1-D8
attgtgtgtgtgtgcagcacatataatccgctctctctcccccggtttctcttgtcttctggctgcggcgatggaccaagaaacctcacgggaaccccactccttgaggagccgtccagtgccgcattagtgggttccattcttctttggatcgctgctcgcgatcgcattgcccgcgtttcttttggccgtcttggttcgttcttgattcttggacgaggtgggatttggagagccgagagcggcgcggcagcggcgggtttctcggtcgggctagattgtttccatcgagatggtgggcggctgaaggcattcgtcgatggaccacacttgcgccaaagacctcgagcgcggcgagcttcgccgtggcgcgcctgagtttgcggacggcgacgatggagacggggaagaaagccagtact

SEQ ID NO: 49441 - DNA, 328 bp, Zea mays
  Clone ID: LIB3067-060-Q1-K1-H12
agcagttgaatatgaaagagagcaagatgacctattgaagctatcagggaaaaccagacaggtgggtctaatcgtgagctaaggcaccgaattcatgctggactcatcaaccgatggaactgctgcaatggccaatgcttatgttgaaaaacgagccttagcttgcacctgggaagctatcgagaaccagactccgatgtcggccttagaaccctatgagtctgtcccagaataggccgatgcttacgctgtatattaggctggtgaaactgctacatgcgaggatgtaccggtcaaatatcagtatggtcacgacgagccggaagcc

SEQ ID NO: 49442 - DNA, 398 bp, Zea mays
  Clone ID: LIB3067-060-Q1-K1-H3
ccgacgcgtggggccgactacaccaccagtttatagcagacccgccgtcttcgttatcaggacgcatgtaaccctgcagctagatataaccagacacactcagacagagagatacatagagaagaggaagaagatatcagatgaggaagaccatccatgtgctattggagaagctgtagactaaactggctgtgactgttatatactattaaatagtgctgatcacattatagattcaaacggacaacatatggaccacctctacatgatagcacttgttaaaagagacactacgaacgtacgttaatccaagatggacattagtgaaattatatggcacagaattcatgacctcttaccagctaatgatgattcatcatctagtgcagtgaatggaa

SEQ ID NO: 49443 - DNA, 431 bp, Zea mays
  Clone ID: LIB3067-060-Q1-K1-H4
cccacgcgtccgcccacgcgtccgcccacgcgtccgcagcagcttctgcttgctctgggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcgtccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgggtcgtctgagccagcagcacgggctgtcaagcaagggcgcc

SEQ ID NO: 49444 - DNA, 435 bp, Zea mays
  Clone ID: LIB3067-060-Q1-K1-H5
cccacgcgtccgccggcctccgtctcccgccccgtcctacacggagaaggacgtgctctcgtcgatgctgagacggctcggtgagctggagggcagggtgcaggtgctcgagacgaagccgtccgagatgccgtttgagaaggaggagctgctcaacgcagccgtccgccgcgtggacgcgctggaagccgagctgatctccacgaagaaggccctttacgatgctctgatgcgacaggatgagctgctcgcgtacattgacaggcaggagctgatcaagttccgtaaaaagaagttctgcttctaagatctgaccatggagcagctggtcatgtccggagccgttcgtgtatattgttggatcgcggctagtacggtgaatgatgtaatgtgtccatctgtacaagtgtgtaactgaacggtgtaagtatagta

SEQ ID NO: 49445 - DNA, 434 bp, Zea mays
  Clone ID: LIB3067-060-Q1-K1-H7
ggacttcaacaactacaagtttcgtgtgcctgtgtccggcgccatcatcctagacgacacttatgagaggtgcttgcttgttaaaggatggaaggctggggccagctggagctttcctcgtggaaagaggaataaagatgaggaagaccacacatgtgctgttagagaagttctagaggaaactgggtgtgatgtttctagactattaaatctggatgattacattgaagtttcaattggacaacaaagggttcggctctacatcataacaggggttaaaagagacactgtgtttgcacctcaaaccaagaaggaaattagtgaaatttcatggcacagaattgatgacctcttaccagctagtgatgatgcagtatctcgtgcagtgaatggaatgaagctgtacatggttgcgccatttttgacgggtctta

SEQ ID NO: 49446 - DNA, 428 bp, Zea mays
  Clone ID: LIB3067-060-Q1-K1-H8
aggcctcgtcatgtctcaggcgcgaggtctctggccgctgaccaacgacgcttgcatctgtactgtgatcagcctagctggagagtctattgtagcagtatgacgggttatcccacccgatcgtgaaactggcctgtgatcacgcggagcgagctgtaggcgctacccagaggtgttgggggctattctacgaactgggtcaccgcatagcagagcatggtgcttacggacgacttcttcggcatgacgagctccgaactgctatcgcaatacgggttccaccaagagactcagctgtcagtcaactgaggctagcttgctgcgtactaggcgaacccgatatatgtcaatatgttcatcacggccgagctgtttgttggctagcaggagagtctaagacagctcgctcgctactgcagctctggctc

SEQ ID NO: 49447 - DNA, 420 bp, Zea mays
  Clone ID: LIB3067-060-Q1-K1-H11
ggacgcgtgggcggacgcgtgggctttcatggtgctaccatgtgctggactggcactactggttcatccttcagcatctcataacattgagaaccggatctcctgggcgttctgtggttatttggaagctgtttcagtgctgccacaattacgcttgatgcagaatactaagatagttgaaccgtttacagctcactatgtatctgcattgggggttgcaaggtttcttagctgcgcccactgggttctacaggttttggatacgcgtgtgcgtctgctgacagctcttggctatggactgtggccgtctatggctgctgtttcagaaatcgtgcagacattcatccttgcagatttctgctactactatgtgaagagcctggttggtgggcagctggtgctacggcattcctcaggggt

SEQ ID NO: 49448 - DNA, 262 bp, Zea mays
  Clone ID: LIB3067-060-Q1-K1-F6
gactcctcccacgcgtacgaactagaaatgcttcccatcttttcgacctaaataacatcctctctaccggcagcgtgcatactagctcatcatgcatcggtcgcacacttaatttaacggattagcgtgtggatctgtcaaccccatggcgcctctgcttgattcgtgtttcacctgttatgttctgagattcatgataatgctatgagaactgaaattcccgtttcatgcttcttaaatctttgacctctgcggttgtgcc

SEQ ID NO: 49449 - DNA, 223 bp, Zea mays
  Clone ID: LIB3067-060-Q1-K1-F7
actagttctagttctcgaaaatattaccttttttttttatttcgaaagctatgaaaggttgaggagttatggttgctgctagttattgccgagtttgttactggcgatagatttatgttatgctgtttaggcacttggctctcggctgcagtatgttgctgttaaggtgttgaaacttctgttatcattactgaactggtttataatgtgacgtcaatttact

SEQ ID NO: 49450 - DNA, 239 bp, Zea mays
  Clone ID: LIB3067-060-Q1-K1-F9
cttttgaatgtttaaccaaatctgttttgagaccgatagtattgaatcagtgatgatgtccaagctcgcctgatggggagtgatagcaagccacatgattggcgagacagattacaccatcattgctgaccttacaattggtcagtctacaggccaaatcatgacgggagctccttgtctggctgagcgcctggccttatacaatcagctgctcatgatcgaggaagagctatgcgttt

SEQ ID NO: 49451 - DNA, 297 bp, Zea mays
  Clone ID: LIB3067-060-Q1-K1-G1
gcagatgaggacctacctgaacggcctccacttttagtcggatgagcgtgcactatcgtatgcgagggctcttatcgatcagtggtagcatatcgacacggaagctactcttgacatggcacaaggactacttcaacgcgccgaactgctacccgcagaatgacgctgacatcgtcaagatgctcaagggcccggtgttggtcaacggcagttacatcgggcgatactgctcctacaagggctactcaatatgctgctgcctctaaaacatctccaagacgttcaccgagaccaaat

SEQ ID NO: 49452 - DNA, 271 bp, Zea mays
  Clone ID: LIB3067-060-Q1-K1-G10
catcagagccatcccgttcaagagcaggtcttaagctgccgtggccgtgccgagacatgccagtccgaagaacgggcgtcttcctgtgatgtcttcttgtctgcccacgcctagtttctctgtcgattcctattcgtcgtctcttcagggctggtgctcactgctgcgccgttctgttaaccgaaacaagaactctgtgtattcctgtaccgagctgtgcatgtttttttctttccatcgtggagaatttaagttattatccgtttgctgc

SEQ ID NO: 49453 - DNA, 424 bp, Zea mays
  Clone ID: LIB3067-060-Q1-K1-G11
agcacgagctctcgtatcaggtctctcgccccgcgcgccgccggcggcttgcttcgccgctgcccgtgcgccaccgtcctccccgtcgcggcatcatctcgactcgaggcgatgcagatcggaggtggatttggttgagcagcttgcgaggcatttctctaggcctctgaccaaggaacaaatggaggcaattatggagctggcaactcaggggaaggaaaaggaagggatcaagaagaagggcagcaaggtgacacctctcaaggctcctatcatggaggctgctgaaatgctctgagttcaattatgagatgtgtgggtagttctagtgcatcatgttatgtccccggtgtacttgcctatgagtcgcccaggatcttttgttggctgctttgtgtagcaggttgttgtctgggcagtggtg

SEQ ID NO: 49454 - DNA, 433 bp, Zea mays
  Clone ID: LIB3067-060-Q1-K1-G12
atcgatggacgcgtcaatgaggacaagctcgtcacctgaggagatcgacaggtctggtgagctctcggtgtccgtcagcaatgcgagcgaccaggagagggagtgggtcgaagaagacgagccaggcgtatatatcacaatccgggctttacctggtgggatcagagagcttcgccgcgttcggttcagccgggagaagttcagcgagatgcatgccaggctgtggtgggaagagaaccgagcgaggatacacgaacaatacctctgagaagagacgcccgacaccatcagcagcacgagcacatgaatagagctggcactaacacattcacatgcatttccagcttcatacgatgttttgctaacctaaaaggtccggtttccggtattttacatttcgttcagtctcacgtgtggtggtggtggggtggga

SEQ ID NO: 49455 - DNA, 442 bp, Zea mays
  Clone ID: LIB3067-060-Q1-K1-G2
cccacgcgtccgcccacgcgtccggaaccaaacatggagcgacaaacgatcgagcagaagggtggctttgtatcaaacctaccgggtgatgtgccacgtgttgatgggcagctggcagttgcaagggcatttggagaccggagcttgaagaagcacctcagctctgatccatatgtggtcgagcaaactatcgatgaaaatactgagtttttaattctagcaagtgatggcttgtggaaggtgatgtccaaccaggaggctgtcgacgagatcaaggattgcaaggacgcgcatgcagctgccaagcacctgacggagcaggccgtgaaccggaagagcaaagacgacatttcagttatcgtagtcaagttcatgtgctagcacattgtcaggttaaatggtctcccgattgtataccgtgttaaattatcttttaagtctt

SEQ ID NO: 49456 - DNA, 209 bp, Zea mays
  Clone ID: LIB3067-060-Q1-K1-G3
tccgcccacgcgtcctcccactcgttcggaacctaatttggatcgacaaacgatcgaacacaaggggggatttgtatcaaacctaccgacttatgttccacatctagattgtcacctacctaatgcaaggtcatttcaacacctgagcttgaataatcacctcatctgtgatctatattttgtccaccccactattaatgaccatacta

SEQ ID NO: 49457 - DNA, 380 bp, Zea mays
  Clone ID: LIB3067-060-Q1-K1-G5
cccactcgtccgctgactcgtgggaaaatttaaaaaaaaaaaaaaaaaaaaaaaaaaaagggaaaaaaaaaaaaaaaaaaaaaaaaaaaaaaaaaaaaaaaaaaaaaaaaaaaaaaaaaaaaaaaaaaaaaaaaaaaataaaaaaaataggctttaccttttaaaatatcaaaacttactaacccttcctttcaactttttaattttcatatagattcatctaaatctaatcaattgaccagtatttaaaaacgttatacctgtaaaacctctggtattaccaaattaaaaccatttgcaaaaaattcccttttctcaagttgtctatatatcataaagacccttaccaattgctttttaaaaaattttaccatcctaaa

SEQ ID NO: 49458 - DNA, 401 bp, Zea mays
  Clone ID: LIB3067-060-Q1-K1-G6
aaacatcatgcctaattactttgcttctttgttacaatgacacaatgcttataaacgcggattatttgataactaaccgaaatttgatattccttgatcataatgactatcatcaatctatacggatacctagatccaagaactataaaaccctctccaacatacctcctcatgggtcctttcaactgatgacatacatacttcgctctcaaatcatacctattatctggttctaaacccatattgtaacccagtttattacccgtataaacctcattttaaatgctccgaatcatttcttaaaaagaatcacattacctaatgttaacattgaaatgactgataatttataggcctctatccccaatataagatctttacacatttctgcttcatatgct

SEQ ID NO: 49459 - DNA, 438 bp, Zea mays
  Clone ID: LIB3067-060-Q1-K1-G8
gaaacagtggaatgcctgagtgcaaactcggcttgaatgatagggttcttttggaggctgaaggcagagcaactaaaggaaaagcgatagaccttgatgatatcaaatttcatcagtgtgtacgtttagctagattcgagaatgatagaactatatcgttcatacctcctgatggatcttttgatctaatgacatacaggcttagcactcaggtaaaacctcttatctgggtcgaagcacagattgagaaacattctagaagccgtatagaactcatggtgaaggcaaggagtcagttcaaggaaagaagcacagcaacaaatgttgaaattgaagtgcctgttccttcagatgccacaaacccaaatataagaacttcaatgggttctgctgcatatgctcctgagagagatgcaatggtctggaaagtaaaatcat

SEQ ID NO: 49460 - DNA, 293 bp, Zea mays
  Clone ID: LIB3067-060-Q1-K1-G9
cccacgcgtccgcatcaacacagtattgtgattttgatgggtcatgtgttttcctctcaagttagtgtttacgttttcgctagaggaagaaaaggggcgtccttctctttttgcctccttttctgctgtggtggcttctcacgagcaccagactcatttgttgtacctgatccctccttttttgggagaaaggttcaacgttttggtgcaggataaaatgggcttgctatcctccagtgctgtgtatatctagcgtatgttagtgaagaaattgcaaattagacaatctaatt

SEQ ID NO: 49461 - DNA, 435 bp, Zea mays
  Clone ID: LIB3067-060-Q1-K1-F5
cccgtgccaggtttgaggagctcaacatggtacctgttcaggaagtgcatggagcctgttgagaagtgcctgagggatgccaagatggacaagagcagcgtccatgatgttgtccttgttggtggctccactaggatccccagggtgcagcagctgctccaggacttcttcaacggcaaggagctgtgcaagaacatcaatcctgatgaggccgttgcctatggtgctgccgtccaggccgctatcctcagtggtgagggcaacgagaaggtgcaggacctgcttctgctggacgtcactcctctctctctgggtctggagactgccggaggagtgatgaccgtccttatcccgaggaacaccaccattcccaccaagaaagagcaagtgttctccacctactcggacaaccagcctggtgtgttgatccaggtg

SEQ ID NO: 49462 - DNA, 439 bp, Zea mays
  Clone ID: LIB3067-060-Q1-K1-H1
cccacgcgtccggtcaccggtgggcctgagatccccttccaccccggcagggaggacaagcctgagccgccacctgagggccgtcttcctgatgccaccaagggttctgaccacctgaggcaagtctttggcaagcagatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggtcttcttcagctcccaagtgacaaagccctgctgagcgaccctgtcttccgccctcttgtggagaaatatgctgcagatgagaaggcattctttgatgactacaaagaggcccacctcaagctctccgaactggggtatgctg

SEQ ID NO: 49463 - DNA, 431 bp, Zea mays
  Clone ID: LIB3067-060-Q1-K1-H10
cggacgcgtgggatcatgcgtgcccatactgccagcctctccctccatagatgacctcaacaacgaggaaaacctggctcgacattgaagtataggagcaccttgaggcgagggttggatttcaactcgttcttggaagacgaagaaagagcgctcgtaccgacaccggcttcagatggtgagctcacgggcacaggagggctcagcaccaccactggcatgcggacaggggggcgcgacgtcgcaagctccagcatgggccgcgatagggctgggcctggactcgccaccgcgagcctcgacatggtgagcactgggcgcggcctcaccaccgcgagcactacgcgcgacagagcacgaagtcggaatagtagcgttgtgtgcaacattggctctttgtccgcagggcgcggcaatggcgccacgatcgc

SEQ ID NO: 49464 - DNA, 393 bp, Zea mays
  Clone ID: LIB3067-060-Q1-K1-D7
cccacgcgtccgcggctagccaagctcgaggaggtccagagcaggctggtccacgccgggaaggacagcgacatcgatgagatcagaggcctgctgaaggaggtggagctagccggccaggagaggcagggcttctcgcagagggcgatcctggccttcgccgcaggaacgatcatcttcaccttgtcttgtgtcctcatcgccttcacagctactagcgacggctgatttgggttctgttgcatgcccctgggtctgaatgttagccactttctcctgggctgcactgttttcttgtagtatgttgactgttgagtgtcgttggttgtggggaaaccatgtttaggactaggttgagaatctcaattttacgagggaatttcaattttcttt

SEQ ID NO: 49465 - DNA, 160 bp, Zea mays
  Clone ID: LIB3067-060-Q1-K1-D8
aacacacatacacagataagccaaacttttttacaaatacatcatacatactccaaacggggtggttcttcctcattgatgacatcacatgacctttttccaacgttgacctagcctttcttttcacgcactgcttgacccactgcaatgtcctttactt

SEQ ID NO: 49466 - DNA, 427 bp, Zea mays
  Clone ID: LIB3067-060-Q1-K1-D9
gcggatccgtcctgcaaatctcctctcatacttctccaccggatccctgtaagattccgggagatgtcggacgaggagcaccagttcgagtccaaggccgacgccggcgcctccaagacctacccgcagcaggccggcaccatccgcaagaacgggtacatcgtcatcaagggacgtccctgcaaggttgttgaggtgtccacttccaagactgggaagcatgggcatgccaagtgccactttgttggcattgacgttttcactggaaagaagcttgaggatattgttccttcttctcacaactgtgatgttccccatgttgatcgcactgagtatcagctgattgacatcactgaagatggatttgtgagccttttgactgacagtggcaacactaaggatgacctcaggcttccgactgatgaag

SEQ ID NO: 49467 - DNA, 110 bp, Zea mays
  Clone ID: LIB3067-060-Q1-K1-E10
aaaaaaaaacacttagcaaaagctcacacatttttttacaacatagtaaactaacctataggtgtgatagatataagataaacgagaaaggccctctctctatcttttta

SEQ ID NO: 49468 - DNA, 425 bp, Zea mays
  Clone ID: LIB3067-060-Q1-K1-E11
gcagcatacagtcacaggttgccaagatcgaggatgacatgaaggttcgagcatcggaatataataatgtaaggagccagcttagtgcgatcaacaggaagcaaagtgggagcttagcggttcgtgatctttccaatctggtaaaaccggaggatatgatcacctcggaacatctcgtgacacttcttgcaattgttcccaagtactcccaaaaagactggttgtcaagctatgagaaaattgacacattcgtggtacctaggtcatctaaaaagctctatgaagacaatgaatatgctctctacactgtaacactgtttgctaaggttgttgacaattttaaggtccgtgctcgcgagaagggttttcaggtccgtgattttgagtacagtcctgaagcacaggaaagtcggaagcaggagatg

SEQ ID NO: 49469 - DNA, 318 bp, Zea mays
  Clone ID: LIB3067-060-Q1-K1-E12
cccacgcgtccgggcgccacgactggtttcgattttgttgagaattgggtcgtttgtttggcatggttcagtgaaatagaaaccataagttttagctcgctccatgtaaaagatgtttatacgagctgttaattctcaaatctcacggtctgagcgggtctgttcgcccattggcaacactttcaggtttagtcaggtggcaataagctgtgtcctttgggagcacaggtctgtacaggatacttgtgttcgggatcagttctaacgctacctgaattcatggtggaaaaaaaaaaaaaaagggccggccgttttaaa

SEQ ID NO: 49470 - DNA, 412 bp, Zea mays
  Clone ID: LIB3067-060-Q1-K1-E2
agcttctgatagcagcaacgacatcaaccttcgtctaagccagattcaactagctgcatgcgtgcatacttacactgatacgtgggctgtaaagcgccgtgaactcccatcctatggctgacagagccagactacaaggtcgcctgagaccgacattaacccatggcgcacaatccggaggacgcgaccaagaccaagccctcaaacccattgccatagacgaaacccaacaatacctagccacccaagggcagcacctgagtacccagcgtccttgcaccaacacggcaaaagcccctactacaatgcggtcgtctgcccttccaaggagccccggacgcgcccgccagtcatgcgtgctacaggcgactgaactgccaagggccctgatacacgcacgactgacacgcgt

SEQ ID NO: 49471 - DNA, 432 bp, Zea mays
  Clone ID: LIB3067-060-Q1-K1-E3
gcactacatattccctctccctcttgtacagaatacgacattgtccatgtacactgcaaataagatagcaaaagatcaatatgtatgtacagcaaccaaatgtaccaacaacaacaatttaaccatgacaccagaccatatgtatatgaaaggttcccccggtacactctttattcatccttgaacacaaaatctagacgccgcctctcaccatcgggtgtaaaaccaatgagccagacatggtctcacaatgccaactaaaaatcacaatatctgagtacagttatgattatcatattctattagcccatatttccaagaagtcgctccactgcagcatgaacatttccagcggtagcggccaaagctcggatgttctcttgtgtgtcaaagaaacccatttcttggagctgagctaattgtgtggcgtac

SEQ ID NO: 49472 - DNA, 255 bp, Zea mays
  Clone ID: LIB3067-060-Q1-K1-E5
ctcaatcatccgtgctcctatactccatttttctacactgggcatgtccactccaactgggaaaactctagttcactatgcatctacagcaacctaatgtaccaacaacaacactattaccatgtcaccacacaatatagatattaaacgttcttcaccacacactgtactcatccttttacacaaaacttagccgccgtgctcttaccatcatgtttaaaacccaacagccagatattggctcaccatgacaac

SEQ ID NO: 49473 - DNA, 265 bp, Zea mays
  Clone ID: LIB3067-060-Q1-K1-E6
agacgagcaaggccaggcatgaaggaatttcaattagaaagtatcttccttcaccatgtgtatatgtatggaggttgccgacattgctcttatacatgtatatttgctactggatataatatttctattttacattattctcatacttcttttttataataccttactattaatgatttatacatttctctaatgtatattgttgcttattatcatttttatctatattatatctcattctcaatatctttttaatttttaattt

SEQ ID NO: 49474 - DNA, 285 bp, Zea mays
  Clone ID: LIB3067-060-Q1-K1-E7
accacgcgtgcgtgcataagatacccaaaggttctatacttgtaggccctcactgggacagggaagactttgctcgccaaagctacaacaggagagtctggtgttccattgtggtctatgactgggtcagatctcatggaaatgtttgctggtgttgcacctttcacggttctgcacttgttacaagaagcatggcagggggcttctagtatggtgttcaattaccaaatcgaagctattggtcgatgcaagatgacttcatgagatctcacggtcaaatgatca

SEQ ID NO: 49475 - DNA, 438 bp, Zea mays
  Clone ID: LIB3067-060-Q1-K1-E8
ccaggtttctgattttggacttgcaaggttagcggctgattccaatacacatgttaccacacgtgtcatggggacatttgggtatttggctccagagtatgcattgtcaggaaagttaacagcaaagtctgatgtatattcttttggggttgttcttttggagctgatcacaggaagaaaacctgttgatgcttctcagccattgggagatgaaagtctggttgaatgggtgagttcatcacttcattttatataataagtgaccttactgcatgtcactaatgttaggttctaaattatgcgtaacttttctgttttttaaccataaccagtaaccatagtcatgagattgagatccactaataaatgacatgattatttcgtgatacaccaatggatgtgtctagacttcttcaagcttcaactgttgatttcctg

SEQ ID NO: 49476 - DNA, 426 bp, Zea mays
  Clone ID: LIB3067-060-Q1-K1-E9
atccacctagtggaccaaaccttaaattcgacttgctaaaggaccttcgtgcattaacaggaaagaaaggagttagcttggttctccatggagcatctggtctatctcatgagctcgtaaaggagtgcatagacttgggcgtgagaaaattcaatgtgaacactgaggttcggaacagctacctggcgtccctcagaaagccagaaaaggacttgattcaggtgatggcgtctgctaaagaggcaatgaaagctgttgtagcagagaagctgcgcctgtttggatcatgtgggaaagcctgagcgaagtacttgcgttgcgccggcaacatgcagtacaagaccgactgcatcatcgggttcgtgatgctgctgctactgtgcagttgcttacggatacagctcattgcgttgaacagctgaagtg

SEQ ID NO: 49477 - DNA, 387 bp, Zea mays
  Clone ID: LIB3067-060-Q1-K1-F1
gcatggacgtggatatgagtgctgaagaaaggtatttgttctcagttggtatcaagaacactgttggagcaaagagggcatcatggagaatcatttgttcacatgagcaaaaggtcgctgctgatcgtcagactggtgtgatgatagatgcctataagaagaaagtataagaggaactaaggaaggtttgcaatgaagtattgtcagtcattgctattcattgccttcccttggccagtacgggtgaaaatatcgtattcttttataagatgaaaggtgactactaccgttacttggctgaatctagcacttgaactgaaaagaaagctgcctctgatcagtcacttatggcctatcagcatgccatggttgtcgcctccagtgagc

SEQ ID NO: 49478 - DNA, 231 bp, Zea mays
  Clone ID: LIB3067-060-Q1-K1-F10
cacactctagatgttatgcccgcatgctatgtttcgattctcaagttgataaatgatggctggatgctggttttcgtgctccaagcctgctgcttcttccagggaaaaaagacctgcccttgttgcagcgttgttgtttagaatgacctatatttgactggtattctgttacggtggctttgcaaagctgtttgtttggtttaatgtctcggaataatatgaattggctgc

SEQ ID NO: 49479 - DNA, 314 bp, Zea mays
  Clone ID: LIB3067-060-Q1-K1-F12
cgcagatccgtcgtccggtgagtggaagccgcacgaacccatggcctccggcgagcttgcctgcacctacgccgctctcatcctcagcgacgatggcatcgccattcaccgcccagaaaatcgccacaaccgtaaaggcggccaacataaaggccaagtccaactggccggcctttttggccaagttcctgaaaaaccccaacgtcaaggacctaatcctttccgtggaacctggtgccgaacctgttcaagtggttgttgccgaacctgctgggggggctccggttgttgttgccccggtttgtaagggaaaa

SEQ ID NO: 49480 - DNA, 432 bp, Zea mays
  Clone ID: LIB3067-060-Q1-K1-F3
cccacgcgtccgcccacgcgtccgcccacgcgttcgcccacgcgtccgcggacgcgtgggctgggatacagcgatgagcgccgtgttcagccagtaccaggagatcgacatctacaacatctacgcgcccagatgcaacctccctccgtcgtcagctgcacttgcacttgctgttgacaaggcagtcgtagccaacagacaggaacatttcaggcgaaggatcaggatgttctccggatatgacccgtgctactcttcgaacgcggaaaagtacttcaacgatgcaggtgtgcagacggcattccatgcgaatgccagtggagctcggaaatgggaagtttgcagtgattcaattttgaggtcatacaatttctcggtgctttctgtcttaccaatctactctaagctcatcaaagcaagactgagagtgtg

SEQ ID NO: 49481 - DNA, 435 bp, Zea mays
  Clone ID: LIB3067-060-Q1-K1-D6
agctcctcctgccgcactaccgtgacaccatgaacatcaactccaacgcgcgccagatgctcgtcaacgccggcggcatcttcgagaccaccgtcttcccgcgccagtacgcgttcgagatgtcctccgtcatctacaaggactggaacttcacagagcaggctctccctgacgacctaatcaagagaggcatggcggtcgcagacccgtcgagcccgtacaaggtacggctgctggtggaggactacccgtacgcgtcggacgggctggccatctggcacgccatcgagcagtgggtgacggagtacctcgccgtctactaccccaacgacggcgtgctgcgggcggacgtggagctgcaggcgtggtggaaggaggcgcgcgaggtcgggcacgccgaccttaaagacgcgccctggtggcccaagatgcaga

SEQ ID NO: 49482 - DNA, 432 bp, Zea mays
  Clone ID: LIB3067-057-Q1-K1-D11
gcagctttgtatatcaagatggagaaatattcagatgccgctgctttgtttgtaagacttggttcagctgctgataagtgcaatgccatcaatagccaatgcaaggcctatctgagtgcgatcatcatctatctttacgcacatgattttcagcaagctcaaaaatgctacaatgactgctcagaggttcaagccttcctcaatagcgaccagaatcgatgctcaacgaacctattgtctgcttatgaggaaggtgatgctgtagaaatcaatcgcattgctcaatcaagtgccttcaatcacgctcgaccatgtggtaattaggcttgcacggaagctaccaacacgtgatctgcaggccatcaattaagctgacgatgcgctaggaatcctaggactaggatgacctgacctataacgatctccctagcc

SEQ ID NO: 49483 - DNA, 190 bp, Zea mays
  Clone ID: LIB3067-057-Q1-K1-D3
cggacacgtgggcggacgcgtgggcggactcttttggtataggcagtagaaaaaaaaaaaaagaaaaaaaaaaaacaaaaaaaaaaaaaaaaaaaaaaaaaaaaaaaaaaaaaaaaaaaaaaaaaacaaaacacaaacaaaaaaaaaaaaaaagaaaaacaaaaaaaaaaacaaataaacacaatgacac

SEQ ID NO: 49484 - DNA, 439 bp, Zea mays
  unsure at all n locations
  Clone ID: LIB3067-057-Q1-K1-D4
ggtggtggaagctgtggcggcggcggatctggcggcgggccgacgagcggtcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgngcatcaacctcaacctgcccatcaacctcagcctcctcgtcaactactgcggcaggcgcgtcccctcgggcttccagtgcttctgactatcacacgcccatcgatcgatcgatctggaggctaaataatttctccaagctgctagtatacgtacgtacgttgatatatatgatgtagtattatatatatgtccatgcatctcgtcgtctatcgcat

SEQ ID NO: 49485 - DNA, 454 bp, Zea mays
  Clone ID: LIB3067-057-Q1-K1-D5
cccacgcgtccgcccacgcgtccgcggactcttgggctgactggtactacatcagggcttgatgcattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaagggtggacgcctcatcaccaaccatggaaggcgtgatctggaccaagtggctggaagggtcgctgttgaagcgtgagcagtgtcatctctggtgtcaatggtgtcatgtttgatggttgacaaggcagctctctatttgctcttgtgggttaggattttcgagctcagatgaccttaatgtttattgcatctagctatagcgccacactattt

SEQ ID NO: 49486 - DNA, 269 bp, Zea mays
  Clone ID: LIB3067-057-Q1-K1-D7
ctctccctcacctctctctctcacgcctcgtgctctctcactcttatctctctgccccctggcgtcttgctacacacacgccgagcgccaggccggctcctccgcgccgagcgggcccaccggcggccccaccacgacgccgcggcatcctgccctgctccggccatccgcgccaaactaggtagcccgagccgagcgcgccaaacgaggccgcgatgtcgcgcagccgcccaacgccaaacgcccagcctcgcctagcgcgcatgcag

SEQ ID NO: 49487 - DNA, 259 bp, Zea mays
  Clone ID: LIB3067-057-Q1-K1-D9
cccactcgtccgggaggtttagtttttcgtgtaacgctagcctaagattgatcgcgaaccggtccatttgaagaatcatgaccctaacagcattacacaaccacttcaaacctgaatgctctgacccccatgcaactgttacactttccctcctccaagctctagctcacattgcagaacacaatcaagacatcttgacaactcatcttcaccaaatcgccaccaactccaccaccaaaccttatgacatcacgacgtt

SEQ ID NO: 49488 - DNA, 416 bp, Zea mays
  Clone ID: LIB3067-057-Q1-K1-E1
ccgcgagctgcaggtcccaattgtgcgcggcgaggatctccgtgcagaggtccgtgttggagatgccggtgacggcctggaagtagctgaccttgtcgtcgacggtctcggccatggccgccggcgacgagggctagggtttgcagattgaggccagtggtagcggtggtagttaggaactaggaagaggccagaagccgagagagatgcggttgcgagccgggagggcgacggccgacgggtcagtgctgaactgctgagtgttgacgtcttctattctccgtctcgccgtcccggtagattgaacggcgtgccgtattactgcactccgcgacaacgcgtcagtttctacgagattttattttacgactgttgggcaaaggaaacgggcgaagaattctgagaaccacatgatc

SEQ ID NO: 49489 - DNA, 339 bp, Zea mays
  Clone ID: LIB3067-057-Q1-K1-E11
ggtgggttggcttctccttcccctccggttctggttcgggttcgtgaggttctccggggttcggttccgtgggtgagcggatcgagatggccgcgtcggatgttgagtaccgatgcttcgtcctgcgcctcagctgggccacagacgaccactacctacacaacgccttcagcacctacggcgaggtcctcgaatgcaaaattatcctcgatcgggagacgcagaggtcccgcggcttcggcttcgtcaccttctccactgaggaggcgatgcggaacgccatcgatggcatgaacggcaaggagctggacggtcgcaacatcaccgtcaacgaggccc

SEQ ID NO: 49490 - DNA, 426 bp, Zea mays
  Clone ID: LIB3067-057-Q1-K1-E12
tcgtccacgcgtccggccatctactcttagaaggttcaatgagagagacagaggataagatagtgccacgagaaatcgatgctgatgactccgatgtggagcctaaaagcgatgacgagagcgatgaagatgatgatgacgacgacactgaagctctaatggcagagcttgagaggattaagaaagaaagagccgaggagaagcttagaaaggagcggcaacaagcagaagaggaggccaagatgaaagaggctgaactgatgcggggaaacccgttgattaatatcaacaatgctggctccttcagtgttaagagaaggtgggacgacgacgtggtattcaagaatcaagcacgaggagagaccaagacaccgaaacggttcatcaacgacaccatcaggagtgatttccaccgtaaatttcttc

SEQ ID NO: 49491 - DNA, 323 bp, Zea mays
  Clone ID: LIB3067-057-Q1-K1-E2
cacactttctctccaaggctgtaccaaatgatgcatccaagctaattgagttccaagatgtcgtgcaaagtacaactgaattcgagaacaaacttaagagcatgatgtttcttttgcctgatagaaaggatggcaagctgacccaatttgttgatgatgttgaagttcattttgctgtacggaagagaagtgaaatcttggtgaaagcaaggaacattcttgtacaatatgattatgatagtcctctggaatctggtgaccaaagtgattctgttgttgatctactttttcagccagagaagtgttttacatctaaatcagca

SEQ ID NO: 49492 - DNA, 134 bp, Zea mays
  Clone ID: LIB3067-057-Q1-K1-E3
gtttgacatcaactgggcgccaattgtagatttgtaagtctgtggtcggtatctgatttcatgaattattattgttgcatacagactagtacttgcgtgcatcgctgaggcaatatatcttccattctgttttc

SEQ ID NO: 49493 - DNA, 514 bp, Zea mays
  unsure at all n locations
  Clone ID: LIB3067-057-Q1-K1-E4
ggtccgtgaattcctcgtggtcgactccacgtcgtctcgctttcatnntcctgttggagggggtccttactcaaacttcatgtatnncagaaaaactctttgcannttcggtgcgtgcgagcaagtattggtgccatctctgcaaccagggtaccctcagtggtcagaaaatctttgtctgagggctccannagatatgcttctgtgatattcggacatnncttaggaaatcgagttcctgcagaatatatgccctcggaaattcgcaaaactaccagtccatcaatgccttgcatnggagatacatctgtggcctcaagnagaggaaacgctcaacgatccccttcttccttttcggattagcccgttgataatccaacctcgaataatgtaaggcataccaaacatttcttcgaaagcctntttcaagtggtgccgagatgtgatgtggcgaaggattttcttggctcgaccctttcatttcgtcgatctcatactattcttattctacatg

SEQ ID NO: 49494 - DNA, 157 bp, Zea mays
  Clone ID: LIB3067-057-Q1-K1-E5
tcgcacttaaaaaaaaaaaataaaaaaaattataaaaaaaaaaaaaaaaataaaaaaaaaaagataaaatttaaaaaaaaataaataaaatacctataaaaaaaacaaaatactacattaatcctccattatatagactaaaattaataaatttaaa

SEQ ID NO: 49495 - DNA, 381 bp, Zea mays
  Clone ID: LIB3067-057-Q1-K1-E7
cggggccgacctttttttttttttttaaatgtgtaatacattgaaagttacatgtcacagggcagttaaaattccttctcatctaagaaaaacttgagcataatgcattgcaaggtacatttaaaatttaaagacctaatacctctgtggttcgtatgaaacaacgacagtatcttagcaagcacataaacaatccactaacaactctatcacatcaaccaacagactgtatcctaatttaaggccaaagcattcctttacctaacttttccattttagagataagcagggctgctgaggaatggcagtgcagcgagagacatgagcgtatccgatgaagcgtcaccctttctggcgtgcttttgcctctcgagctgtatt

SEQ ID NO: 49496 - DNA, 413 bp, Zea mays
  Clone ID: LIB3067-057-Q1-K1-E9
gctaggttcttctgcagagccttaatatcactcttgaaagccagaagatgccagtgcacatgggtcagcataataaaaggatgagctgccccgccatggcacagctcctctccaataccctgtactacaagcgattcttcccatattacgccttcaatgagctcggtgggcttgacagctaggggaaaggatgcgttttcacctatgatgcagtaggttcctatgagagaaccggttacagtgctcagggaactggatctactttgatcatgccagtcctggacaatcaactaaaatcaccaagtcctctattactccctgtcagggatgctgtcacaccattgtcggagtcagaagccatcgatctagttaaggacgtgtttcgatctgcaactgacagagacatctacact

SEQ ID NO: 49497 - DNA, 184 bp, Zea mays
  Clone ID: LIB3067-057-Q1-K1-F1
cccacgcgtccgcccacgcgtccgcctagattggtttctatcttacgataaggacaatgctgagacagttggttaccttaatctttatggacagatgctatgtgttgcttctgtggcacttttgtttaagctaagttttgcggagacaagatacttatatatgttccggatgaaattatggttc

SEQ ID NO: 49498 - DNA, 383 bp, Zea mays
  Clone ID: LIB3067-057-Q1-K1-D10
atgatgaccttgacgttgttggtgttgtgactctgcttgttgcgatctcatgctttattggggagccgaccctttattgcgacaactatttggcttcagcgatggagaagcttgaggggaaaggagtcagatcagtggagaaaatttgagcttttctgtagcgtgaatgttgataataacaggtcagtatgtgaggaaggtttatttggttggaacggtgcattcgtgtcgtgttaatccagcaaatcctgtgtaggttaagtaacaaggcttctgtgctgttaaaaatattttactatgtcatttctttggacggttttctgaactaatgtgtggttaccattatgccttgttcgggttaaaaaaataaaaatagggctgtc

SEQ ID NO: 49499 - DNA, 406 bp, Zea mays
  Clone ID: LIB3067-057-Q1-K1-F10
gcgtccacgcgtccggccatctactcttagaaggttcaattagagagacagaggataagatagggccacgagaaatcgatgctgatgactgcgatgtggagcctaaaagcgatgactagagcgatgaagatgatgatgacgacgacactgaagctctaatggcagagcttgagaggattaagaaagaaagagccgaggagaagcttagaaaggagcggcaacaagcagaagaggaggccaagatgaaggaggctgaactgatgcggggaaacccgttgattaatatcaacaatgctggctccttcaatgttaagagaaggtgggacgacgacgtggtattcaagaatcaagcacgaggagagaccaagacaccgaaacggttcatcaacgacaccatcaagagtga

SEQ ID NO: 49500 - DNA, 457 bp, Zea mays
  unsure at all n locations
  Clone ID: LIB3067-057-Q1-K1-B4
cccacgcgtccgcccacgcgtccgagacctttcaaacttggtaaacgaagctgctctgttggcgtgggcgattaaataaagaaatagtggaaaaggttgacttcatccgtgcggttgagcgatctatagcagggatagagaaaaagcatgcaaaattgaagggtaatgaaaaagctgttgttgcgcggcatgaagtaggtcatgcactcgtgggaactgctgtagcaaacctccttcctggacagccacgtgtggagaaattgagtatattgccaagatctggaggtgcattaggcttcacgtacacccctnccgtcacagaggatagatatttactctttgttgatgaactacgtggccgtttagtaacactactgggtgggagggcagcagaggaagttgttttagcatgactggtttcgactggtgcacttgatgacataagacgtgctactga

SEQ ID NO: 49501 - DNA, 453 bp, Zea mays
  Clone ID: LIB3067-057-Q1-K1-B5
cccacgcgtccgcccacgcgtccgagaacctctacatcatctccgtcaagggcatcaaggggcgcctcaatcgcctcccgtccgcctgcgttggcgacatggtcatggccaccgtcaagaaggggaagcccgacctcaggaagaaggtgatgcccgccgtcatcgtccgccagcgcaagccgtggcgccgcaaggacggggtctacatgtacttcgaagataatgctggagtgattgtgaatcccaagggtgagatgaaaggttccgctatcactggacctatcggcaaggagtgtgctgatctttggcctaggattgctagcgcagcaaacgctatcgtttgagagcttgttggaatatgttcagacttctatatgatcatcttattatcaggtgctaaaagggctattgggcttaatgggccctttatgtttgttcactcaattttggagt

SEQ ID NO: 49502 - DNA, 406 bp, Zea mays
  unsure at all n locations
  Clone ID: LIB3067-057-Q1-K1-B6
cggacgcgtgggcaactgagggatcgtgtggttacagggcttctgcaagcatgcctggatggcttccttcgtgtgatactggatggaggttctactcgtgtcttctctccaaatgatgcagctttattggaggaagatcttgaaaccctgaaggaattttttgtttctggtggagatggactgcctcgtggaactgttgaaaacttggtctcgcgtgtacgtcctgtaataaatctgatcaagcaagagacccgcgtgctcattgatgacctacgagaagttactcaaggtggcaagaagcaatttggagcggacttcaaaaccctncttagggtcctgtgtcacagaaatgattcagaggcatcacattacgtgaagaagccattcaaggatcccaacttaactt

SEQ ID NO: 49503 - DNA, 349 bp, Zea mays
  Clone ID: LIB3067-057-Q1-K1-B9
cccacgcgtccgattatgtgggctcgggatgtgcgaaagagagggtgatgtgatgtgtgacgtcctgcctttggagctctcagcgagatgcagtctctgcaatgctttaagcccgtccgtgctgtgcttagtttcttgtgcacgtgagttgaatgcctcaagggctggtgactttgtagtgtaagttatgcaacgatgacatagattagctattataaatcctaaatgaggtatgtatgcgcatgctgtattgtagtgctgtagattcggacttcgcaattgcaactgatgctacacttttggtcagtgatgatgcctttcgctgcaaaaaaaaacattttataaaatc

SEQ ID NO: 49504 - DNA, 452 bp, Zea mays
  Clone ID: LIB3067-057-Q1-K1-C1
cgaaaactattgagtttaaagacataattaaaattggacgtacacatacccaagatgccacgccattgactcttggccaagaattcagtggctacactacacaggtcaaatatggaattgaccgcattaattgtacattacctcggatgtaccagcttgctcaaggtggaactgcagttggaactggcttgaacaccaagaaaggatttgatgccaaaatagctgctgcagtggctgaggaaacaaacctaccctttgtgacagcagagaacaagtttgaagctttggcagcacatgacgcttttgttgagagcagtggtgccgtaaatacaatttctgcatctcttatgaagatagcaaacgacatacgtttgctaggaagtggtcctcggtgtggtcttggtgaactaatcctaccagaaaatgagcctgggagcagcattatgcctggg

SEQ ID NO: 49505 - DNA, 431 bp, Zea mays
  Clone ID: LIB3067-057-Q1-K1-C10
aagctaaccaatctccccctcgcaagcgacctcggagagatcgaaaccgtgaaaaggcaccctcctcaaacaagactgaagtattgcaacaagagatctggagagattttcctgaagatctttttgaaactgtcattgcaaggcttccagttgctgcaatttttcgattccgcactgtctgccgaaagtggtcttctcttttgggctcagacagtttctctcatcagtactctgaagctccacgtgggctaccatggttctatacaatcacccatgagaacgcgaacaacaatgttgcaatgtatgatccttcgctgaagaaatggcaccacccatccgttcctctcactcctacaaagatagttattccagtggcatctgtgggtggccttgtatgtttattggatctgagccacatgaatttctacatt

SEQ ID NO: 49506 - DNA, 377 bp, Zea mays
  Clone ID: LIB3067-057-Q1-K1-C11
acgaccactcgtacggctagcgcctgctgcgatttgtctgtgatcatgtcttgcagcgggaacgggcgcaactgaagatgcagctgttactgatgcagctcatacaactgcatgtgacatgtcatatagacctgcctttgatgattatctgacgcacgatgctagctactctggcaaagaatgacagtgaaaggagtacctatacgtgctcatacagcagcctcatggtcttaatgatcctgaccacagtgcacaaattgaagatggagttcagctacaccaacatcatcaaagatctcaagatagatgactgctgcaatgggacattagttcatgacccagaacttggtacaggtcattcagatacatagtgatca

SEQ ID NO: 49507 - DNA, 429 bp, Zea mays
  Clone ID: LIB3067-057-Q1-K1-C12
gccagccgccagcacaaggcgatcgagagtggtgaccaccagtaaactgcaaagtgcaaacgaaacaccgtccacgagaaagcggaggagggagcaatggcggagccgagccagcagcagcagctgcggtcgttcgtggaggtgccggcgggctcccacttccccatccagaacctgcccttcggggtcttccgccggcggggggtgcaggcgcaggctccgcgccccgcggtggccatcggtgacttcgcgctcgacctcgccggcgtcgccgacgcggggctcttcgacgggcccgcgctctccggctccccgtgctgtcaccaggagacgctcaacatgttcttggggatgggccggccgtcgtggagggaggcgcgcgccacgctacagaaaatcctatcagccgacgagcccgtcttgcgtgac

SEQ ID NO: 49508 - DNA, 453 bp, Zea mays
  Clone ID: LIB3067-057-Q1-K1-C2
cccacgcgtccgcccacgcgtccgcccacgcttccgcccacgcgtccgagaagatttgattgggttccccaaatccggtgactccattcctgttgttcttcacgtcgaccccgggaacctcccagaaggctctagcgaccccggcgctctgagtgctgtgctgccggcggcgagatccaggagctgcctgccatggtgaaggacagcgcctactacgacgtcctaggggtcagcgtcgacgcgtcctccgccgagatcaagaaggcgtattacatcaaggcgaagctggtgcatccggacaagaatcccgggaaccctgacgccgcactcaagttccaggaacttggataggcctatcaagtttctagtgatcctgggaaaaaggaggcttatgattagtattggaaggagggttttccctaagataacatggtggatcctgcttctgtcttt

SEQ ID NO: 49509 - DNA, 260 bp, Zea mays
  Clone ID: LIB3067-057-Q1-K1-C3
gtttgagcctgagctaccgaaagagaagctttttgcaatcgccgaccttggcgtcggtatggggaacaagatagctctcaagttcgacactgtgttttggcccgacgttgaagtgataggtagggtggccccgacgtcaaacgcctggggctactttctaaaccttaacaaagccacaggaaacccggttctggtgtgcatggtggccggaaggttcgcgtacgagatcgagaagctgtcggacgaagagtccgtgaact

SEQ ID NO: 49510 - DNA, 210 bp, Zea mays
  unsure at all n locations
  Clone ID: LIB3067-057-Q1-K1-C4
ctaaaaacctctgaaaagtcgagttctgattcttcngagccccgaaggactacttctgattcgggtgaacctagacgatctaacaggcgaattcaaccaacttcaaggttactagagggcttgcaaagttccctcgtaatctcgaaagttcctggcgagaaggttcctaggagcaattacaaaagtgcattctcaagagggagaactcaa

SEQ ID NO: 49511 - DNA, 330 bp, Zea mays
  Clone ID: LIB3067-057-Q1-K1-C5
aagatagctctcaagtgtcgacactgtgttttggcccgacgttgaagtgataggtagggtggccccgacgtcaaacgcctgtggctactttctcaaccttaacaaagccacaggaaacccggttctggtgtgcatggtggccggaaggttcgcgtacgagatcgagaagctgtcggacgaagagtccgtgaacttcgtcatgtcccagctcatgaacatgctgccgcatgcaactgacccggttcagtatctggtctcgcgctggggtagtgaccccaactcacttggctcctactcatgcgatctggttgggagaccagctgacctgta

SEQ ID NO: 49512 - DNA, 404 bp, Zea mays
  unsure at all n locations
  Clone ID: LIB3067-057-Q1-K1-C6
ccactcttgtcctcgaccttgattctgacattttggctgcattctctgctgcatacgcagaacttgaatctgtactttctggattgaatgtgcttgttgagacttactttgctgatgttcctgctgagtcctacaagaccctaacatctctgagcagtgtgactgcctatggttttgatcttgtccgtggaacccaaactcttgggcttgtcacgagtgctggtttccctgctggaaagtacctctntgctggtgttgtggatggacgcaacatcttggctgatgatcttgctacatctctcagcactctccagtctcttgaggcttgtgttgggaaggacatgcttgtcgtatcaacttcctgctcgctcatgcacaccgctgtggatcttgtgaacgagact

SEQ ID NO: 49513 - DNA, 298 bp, Zea mays
  Clone ID: LIB3067-057-Q1-K1-C7
ggtgagttcacgtctggcgcaactcgtgtgctaataactacagatgttcgggctcgaggactggacgttcagcatgtttcacttgtcataaattatgatctaccaaataatcgtgagctttacatccatcgcattggtcgctctggtcgtcttgggcgcaagggtgtggcgatcaatttcgtgcgcaaggatgacattcgtatactgagagatatagagcagtactacagcacacaaattgacgagatgccaatgaatgttgctgatcttatttgagcacctagaggatcaggcaggg

SEQ ID NO: 49514 - DNA, 196 bp, Zea mays
  Clone ID: LIB3067-057-Q1-K1-C8
gccaagaggtgccatccataatgatatctcaggaaattgctaggcagcaagagtgacattagaactgaagccaacaaaaagatacataagagctatatacattgagacttatgactaactgtaaaaaattcttaccagctaaatgctgacatgatgaactgtaatgaaccctagagcacctttcaatggactggtt

SEQ ID NO: 49515 - DNA, 433 bp, Zea mays
  Clone ID: LIB3067-057-Q1-K1-C9
ccacgcgtccgggctgtgatagcaaagagtctttgagaggattcaccgcagcaatgttgctggcatgggaatcatccctctatgcttcaaagcaggggaggatgcagacaccctgggcctaaccggccatgagcgctacacggtccaccttccaaccaatgtgagtgagataaagcctggccaagatgttaccgtgacaactgataatgggaagtcgttcacttgcacactcagattcgacactgaggtggagcttgcttactacgaccatggtggcattctaccatatgtcatcagaaagattgcggaacaatagattgtacaatttgagatgattgcgatgcggtggatcgtaattggtgtaaacgacccatttttgagtacatataataacctttgagtttctcagagtgagctgtctggaacttttagt

SEQ ID NO: 49516 - DNA, 360 bp, Zea mays
  Clone ID: LIB3067-057-Q1-K1-D1
atgtgagccggcatcttcctaaacatacgctctgttttctcgttcaccaggttctccgtagggcgaactcgatagctatcaaatccaaatctctgctttggatctacagttcagctacttcttcggctgcctcgacttgacaaccctctaccaattttttcaaaacgaacttagcacctacaaacacgtacttgattcccatattatcctcaatcttcacacacaaaattcacaagacttctgattaagaaccttctaaactgatgatgtcatacctaacgcacatgctggcataaacagctaacatcttgaatgacctaacatcactctcaactagttacactaactcagttggcttct

SEQ ID NO: 49517 - DNA, 273 bp, Zea mays
  Clone ID: LIB3067-057-Q1-K1-B3
ctcactcatgagcacactcgtataccaactctagtatatcaacacttgcaatgacatccagggcgcttttaaaagcctttagaaaccctaaatataatacatgggcattatcaactctaataatagtgaatccccactctaagaaaaaagtgattccccccgtcattgtactacaactcaagccgagacgccacaaggacagagtctacatgtacttctaatataatgcttgattgattgttaatcccaaaggtgagattaaaagttcctcta

SEQ ID NO: 49518 - DNA, 426 bp, Zea mays
  Clone ID: LIB3067-056-Q1-K1-H5
aatacccgggctgccttgcagctttctgcagggagctgcgccaacgatgggcgtcttccaggacaccggcgtcggtggcggcgccggcagccgcacgtgcaggagggttttccagtaccagaagctggactgctgctgggacgatggaaccactttcaggtggcggtgtccaccagccgcgaatggtaagaaggctgaagccccctgtttgttcagtgtcaggcggctcaagtggagcaaggtcacctcggttctgataccgaagaaagtcgccgagttgtctgcaaagatctgccacgccggcgccaggacggaagccgtcgtctgcccggccgtcgtcttcatgtcggcgtggggcctacctgtgctcttccgcccgctcttggtcggccacaacacttgcaggtattaccgtcgaagagacac

SEQ ID NO: 49519 - DNA, 350 bp, Zea mays
  Clone ID: LIB3067-056-Q1-K1-H7
cggacgcgtgggtgaaccctgccttcaccattctgattggtggcatacttgcgttcggagcagtcttcatcgagctcttcttcatcctgacgtcgatctggcttcaccagttctactacatctttggcttcctgttcctggtgttcattatcctcatcatcacctgtgcggagatcacgatcgtgctgtgctatttccaactgtgcagtgaggactacctgtggtggtggaggtcctttctgacctcaggatcatcagcaatctacctcttcctgtacgccgggttctacttcttcactaagctacagatcactaaagttgtgtcaagcatggctgactttggctacatg

SEQ ID NO: 49520 - DNA, 318 bp, Zea mays
  unsure at all n locations
  Clone ID: LIB3067-056-Q1-K1-H8
cccacgcgtccgaggagttataaatacctttaaccaggacccagcaaatgctgcttccggtttccagatcagtgttggtcttgctggaactaccaataaaactgttaaggtgccgaagaacttcactcttaagactccaggccctgggtacacatgtgggcgtgctattgttggcaggccaacaaagtttttcactgcggatgggcgcagggtaacccaagctctaatgacatggaatgtgacctgcacatattcccaatttcttgctcagaagactccgtnctgctgtgtatctctctcatcattttaataatgaca

SEQ ID NO: 49521 - DNA, 302 bp, Zea mays
  Clone ID: LIB3067-056-Q1-K1-H9
atgacaacgagaaatcgcagctgggatgggcgcgtggggcatgcactaggagcgccaagggtattctgtcttcctttccctgagctcagttctatgtacttctgatagagtttaagaaaatcactatatcaaacctcctcgcaatgcatgaatttcctaactgaagagggagggagagagagagagagaatgttcctgtttatgtagagatggagtccaaaatttgtgtgcctgatgagttcttccccatatgatattaactgaaatagtatatcaattgaatgtattacattttaagtttt

SEQ ID NO: 49522 - DNA, 449 bp, Zea mays
  unsure at all n locations
  Clone ID: LIB3067-057-Q1-K1-A1
agcggaggaggaagagggagccaagcggtcaagccggctcggccgctcgcctcccaccaaaatccccccgaatccccacccccaagcaacacccagaaaaggcgacaggtgccgaggtcgggggagcgatggttgtgcggcggctgggcggcacggggcgcgcgctgctcacgctccccaacatccggaggcgggcgtccaactcctgggccgccgtctgcgacaccttcttctctaccaagcaagtgttcgagagccaccgcatcgtcttcaccgtcggcacctcaatcgccttcgtcctcacggcttgggccggttattcacttcgccatgtgcaacaattaaagattgaaaggaagcttgagtcaattgaatcatctctgaaggataaccacaaagttgaacatgaagagataaaaaagatcgtcacttncagcaatattagcgct

SEQ ID NO: 49523 - DNA, 374 bp, Zea mays
  Clone ID: LIB3067-057-Q1-K1-A10
gaatgttcctgttgttggaggccatgcgggtattactattctgccactcttctcgcaggcgactcctgcaagcaattcgttgtcccaagaagacattgaggccctcaccaagaggacacaagatggtgggacagaggtggttgaagcaaaggcgggaaaaggctctgcaacgttgtccatggcatatgctggtgctgtttttgcagatgcatgtttgaagggtctgaatggagttccagacattgtagagtgctcttttgtgcaatcaactgtgacagagttgccattctttgcctctaaggttcggctcggcaagaatggagtggaagaagtgcttggtctgggtgagctcaacgagttcgagaagaggggct

SEQ ID NO: 49524 - DNA, 441 bp, Zea mays
  Clone ID: LIB3067-057-Q1-K1-A11
gatagttcattgtgcatttttatttgaaactaaatttaaatactagatatgctggtatttgaggacggagggagtacattgcacccatgagattaccctctactgtctaacaactgaaggagcaagccccagccctagatacacgacacatacaaggtaaatgccaaaagccaagttgcctacacctaatactgcgtacagcccaagcctaccagcgacattacacaatcagtagcaaatcggtatgaagactggatatcgtggcatatgttgagcttaatatcaagagtcgtccagaactcgagatgctcagtaaatgccaggaatgactctgtatggtactttgttgcatgaaatcttgcagtacttgccgtactttgatgagcaccggtcatcatccctctttgctcggtcaaacaataatatagtcagaaagatcac

SEQ ID NO: 49525 - DNA, 404 bp, Zea mays
  Clone ID: LIB3067-057-Q1-K1-A12
gagatccggagcagccgcagtcccaccgaccccgccgccggtcgccctccatctcgtcgccgctgcctctcgtttctcttttcaataatcaagatgagccgtggtggtagtgccggtggtggtcaaagctctctgggttatctctttggaagcggtgagccccccataccagcagtggcaccagctgcaagtgctccacctgttgagaaaccatctgctgcaaagactgatgcggccaagcaggttgctgctggggttaccagccataccaataactaccacagggctgatggtcagaacactggcaacttacttacggaccgtccttcaaccaaagtccacgctgctcctggcggtggctcttccctgggctacctgttcggtggcaactgatgcccgtgctg

SEQ ID NO: 49526 - DNA, 313 bp, Zea mays
  Clone ID: LIB3067-057-Q1-K1-A2
atcgagctcggaggggaacggagcgaagcttttgagcggagatgcagatccgagtgcaatgggcgtgcagagagtcatcgtgcccggaatgggccgtagtggagctgcacggcgtggtgcagacgcaggcctccttcgccggcgacattcggggactccacatcggtcgcctctgctcctccccttgcccagcctccgtctcgtccaaggcagggttcaccttcacggtggggtaccacgagctcgtcggcgcaaaagtgacgctcaagaagcctctgctggtgctcaggaagaagaatgttaatgctggtgc

SEQ ID NO: 49527 - DNA, 394 bp, Zea mays
  Clone ID: LIB3067-057-Q1-K1-A5
cggacgcgtgggcggacgcgtgggcggactcttgggtttctcttggcacatgctactgcggttgcaagataccgtacgaaatatcagggtctatatatgcttggaagttggaacaatggctgctcagaagggtaaggtcggaatagtcctggacttcaactgtgacgaggctcttacaaactcacctgatgaccaagcatcatcccaaagagcctgggacttctacattggctggaatgttgatccattgataaacggactctattcacagataatgcaagatctcgtgtaggagatgctgcctaggttcacttctgagcttgctaatctggtgaatggctcggcagactacatcgttatcaacgagtacacatccatctacgttaaggggcag

SEQ ID NO: 49528 - DNA, 298 bp, Zea mays
  Clone ID: LIB3067-057-Q1-K1-A6
cggactcgtgggtcttaactcaaaaaaatttataaaaaaaaaaaaaaaaaaaaaaaaaaaaaaaaaaataaaaaaaaaggcaacccctttaaaaaaatccacaccttacttacccatccattcaacatcataacattttctataattttacctaaatttaatttacttgccttacttttacaacatcttaacttgtaaaacccttacattacccaacttaaatacctttcataacatccccctttttccagcttgcctaatatccaaaattcccaaacctatcgtcctttccaacaat

SEQ ID NO: 49529 - DNA, 306 bp, Zea mays
  Clone ID: LIB3067-057-Q1-K1-A9
cggacgcgtgggcggacgcgtggtcggacgtttgggcggacgcgtgggcggacggggtcgcggactcgtgggcggacacgtgggccgacgcatgagcggacacgtgggtgactaaggagctggtacctagttcacacgaaatgtggactgttaggaaaggacgctatctgggtaggctgctgcgcaacacattgcgcaagaccgcacagagtctgagctatcacaaagcagctagtaacgctgaatatgaagacgacctgattggacatgctgttcgttagaggtagaggaagaccgagatttctg

SEQ ID NO: 49530 - DNA, 424 bp, Zea mays
  Clone ID: LIB3067-057-Q1-K1-B10
cccacgcgtccgacaggatcctttgagcagggcagggcgagaggccagcagcagtgttgctgtcctacctgcaccgcatcaccgacagttcttgcacagctacagctctgtagagggatagtagaggattcttatcatgcgttttgtattctgacctttgcttgttgtgagacccagtccacatgaagatgttttttttatttgttattgatactttcacgacgttgaagcatacaattatatgcatcaaggttgtcaaagaaaggtccagcatgagaaagctgaccaaatgttgcgccaaaaaaaaatatatataacaaaaataagaaaaaaaaattaataaatagaaaatgctatatacaaatgcctaaaaccaactcatcaatattgaggaatattaaaaaaaaaagggctgcctttttag

SEQ ID NO: 49531 - DNA, 399 bp, Zea mays
  Clone ID: LIB3067-057-Q1-K1-B11
caaacgccggcggagtcgtcagtcgtgcgttcccgtcccgttctgcccccacctggcctggggcgactccgtcactcttcctcttccgttccatttcaagatccctgcagccgtccgttcatccatccatccatccatccgttaagaggagaggggaagccggccggccggccggccggtggagcggagatgagggggcagacagagacaggcctgtggcgaggaggcgacggcgctgcggcgtggtgggtggccgtggtggccctgcagctgggccattcactgagccgcgcgcgggctgggctgctggagtccaacccgggcctggcctacaacttctaccagagcagctgccccagcgcggagtccatcgtccggagcgtcacctgggcgcaagtc

SEQ ID NO: 49532 - DNA, 340 bp, Zea mays
  Clone ID: LIB3067-056-Q1-K1-H4
caaagctctgcaaggtgataaatcgggggaagttgagtacttccagtctcttgatgaaacaattaatgggatgaaggggattttggatcctgtcaaatgccaatgtggactggagtacaacttaaaacttgatggtgaagccatggatataagctaagcaagaacgaccacatacacagatgcccatctccaccagatttcgtgcattttagatctgtacagtgtgagagatggattattctttggaaggtacagaatcttctcgcatgtataccggtggatgctttgggcagaacttgacagcgtcatcgcgaataatatagattctgaatgtagacct

SEQ ID NO: 49533 - DNA, 330 bp, Zea mays
  Clone ID: LIB3067-057-Q1-K1-B12
cggacgcgtgggcggactcgtgggctgactcttgggttcagtatcatgtttgaagactgctgctgatgctgcatgttcaatgtatactttgtctctaaatcgagaagctacaccaaatcttattgtgtcatctgagagatcagtcaagtcaatgactgaacagcagttagatgaaaacagtgaaaagcatgaagaaaatagtggaaggcttgaagaacatggtggaaatcctgttcaaacttcctatgatcaaattgttaatggctgcagtggaagagggaatagaaaattctgcagtggaagaaggaaaggaaaaggaaaatgataagg

SEQ ID NO: 49534 - DNA, 428 bp, Zea mays
  Clone ID: LIB3067-057-Q1-K1-B2
ctagggttttgctgctctccgaccccgagctccgaaggccgcagcatcaggcgaggcccccgtcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacatggcatatggacctgtgcagggtctgtgaaaac

SEQ ID NO: 49535 - DNA, 305 bp, Zea mays
  Clone ID: LIB3067-058-Q1-K1-G6
cccacgcgtccgtccacgcgtccgcccacgcgtccgaaaaaaattataaaaaaaaaaagggagaaataaaaaaaaaaaaaaaaaaaaaaaaaaaaaaaaaaaaaaaaaaaaaaaaaaaaaaaaaaaaaaaatgggcggactgtttaaaggatcctattttactttcgcttgcttgcaattaatttgtttttttttagggttatttaaatttaattaactggccttttttttacaacttgctgattgaaaaaaccttggattttcttattttaattggcttgaaataaatctttttttagctggtt

SEQ ID NO: 49536 - DNA, 264 bp, Zea mays
  Clone ID: LIB3067-058-Q1-K1-G7
cccacgcgtccgcttacttgtttatgtctagtctcttcattttaattccatttggagggggtgcaattgaattctggaacgtgggacatgcagtgcagtattttagattagtaatttggtgcaacctcaaacatttagatcttccctgcctccctgggtaacttgatcaaaaattttttaagctccagagaatagccttacattggcaaatcatttgcccatagattgtaagaaataaaagaggaaagaaatgtctttgtggac

SEQ ID NO: 49537 - DNA, 343 bp, Zea mays
  Clone ID: LIB3067-058-Q1-K1-G9
tcgcccactcgttcgcccacgcgtccgttcactcgtccgccaaatattaactttgagagtctaggcaaaataaaatataacttatactttgagtggtagaaagtaattatttaagagtaaataaattctaatagttatgtgtatatcatctattgatttgtctaccttcattaattacagtgtgtactttctttgctaagctaaaattttcttgtcaacatgaatattaagtagtttacttgattgaagagttaaattatttttgaattgcataaattaatatcagaaattattaagtcatttggcagactttttctgagatcaacaaggctatgatatttcc

SEQ ID NO: 49538 - DNA, 434 bp, Zea mays
  Clone ID: LIB3067-058-Q1-K1-H1
gaaactgccaagaacagctcctcagttgaaaagagctatgagctacctgatggccaagtggtgaccattggtgcagagagattcagatgccctgaggtcctcttccagccatccatgattggtatggaggctgccggaatccatgagacaacatacaattcaatcatgaagtgcgacgtggatatcaggaaggacctctacggcaacattgtgctcagtggaggttcgactatgttcccgggaatcgctgatcggatgagcaaggagatcacttcccttgcaccaagcagcatgaagatcaaggtcgttgcaccgtctgagaggaagtatagtgtctggataggagggtccatcctagcctcgctgagcacttttcaacagatgtggatatctaaggaggaatacgatgagtctggcccggcaatcgttcacag

SEQ ID NO: 49539 - DNA, 428 bp, Zea mays
  Clone ID: LIB3067-058-Q1-K1-H11
cccacgcgtccgaccagttttgccacaaagttcttcttctttctatatctggcatgcatatggaatagtttggtgttgttctcttaaatagtgatgcgctaccattgttgtgttgctgataacttgatttttgaaatgtcctgcattgaaacaggaaactggcattgccaacgtttgcagcactcccattgctaatggcatatgctggtggcacttccatcatcattccaaagcccttaactccttatgttggactaacggttttggagctaggtttattttacaagctattcatgctcttgttagcagtcttttgtacaaactcgataaatatacatgctggtctaaatggacttgaagttgggcagactattgttatatctgctgcggttttgatacataatgtaatgcgcatagcatcttctaca

SEQ ID NO: 49540 - DNA, 381 bp, Zea mays
  Clone ID: LIB3067-058-Q1-K1-H12
aatacccggtccgacccactcgtgccgcccgctcttccgaccagttttgccacaattttcttcttctttctatatctggcgtgcatggtgaatagtttggtgttgttctcttaaatagtgatgcgctaccattgttgagatgctgataacttgatttttgaaatgtactgcattgaaacatgaaactggctttgccaacgtttgcagcaatcccattgctaataacatatgctgatggcacttccatcataattccaaagcccttaactccttatgttggactaacggttttggagctatggttattttacaagctattcatgctctttgtagcaatcttttgtacaaactccatggatatacattctcacctaaatggac

SEQ ID NO: 49541 - DNA, 240 bp, Zea mays
  Clone ID: LIB3067-058-Q1-K1-H2
cccacgcgtccgcggacgcgtgggcggacgctttggggcagtagagactgtcagaggcaggcgcccttattcaactaatctggactgggctccctgcttatatcactacaatattatactactagtattggtgcttgatatcagtgtgtggctgtgctaataccagtgtaatactggttctactataatacagtcgtatcaggcatggcgtgcatcaagactggttgtgatagtagcaac

SEQ ID NO: 49542 - DNA, 451 bp, Zea mays
  Clone ID: LIB3067-058-Q1-K1-H4
gcactcgacaccagcgtccaacgggatggcgagcctgaccatgccgccgatgccggcgtggccgcggcaggacgccatcgacctccacaaagcattcagagggttcggttgcgacagcacgacggtgaccaacatcctggcgcaccgcgacgcgacacagcgcgcgctgatccagcaggagtaccgggccgtgtttaaccaggacctggcccggcgcatcgcgtccgagctgagcggccaccacaagcgggcgatgctgctgtggatcctggacccggccacccgcgacgccaccatcctgaagcaggcgctcacgggcgacatcaccaacctgcgggcggccacggagatcgtctgctcccggacgccgtcgcagctgcagatcatgcgccagacgtaccgcgccaggttcggctgctacgtcgagcacgaacgtaccgaacgcacgttc

SEQ ID NO: 49543 - DNA, 463 bp, Zea mays
  Clone ID: LIB3067-058-Q1-K1-H5
gacaccgcgtgcgaaccaagcagaccacaacaagaagaagcgtagtcgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaacatggtggtggagaggctcggcgattacctgattgagcagg

SEQ ID NO: 49544 - DNA, 445 bp, Zea mays
  Clone ID: LIB3067-058-Q1-K1-H6
aaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatcaatttcgatgattattagtagatc

SEQ ID NO: 49545 - DNA, 249 bp, Zea mays
  Clone ID: LIB3067-058-Q1-K1-H7
cccacgcgtccgcccacgcgtccgcccacgcgtccgcccacgcgtccggattctaaatttgggaaaaattaaaaaaatataaaaaaaaaaaaaaaaaaaaaaaaaggaaagaagataataaaggtctgggcgttctttcggttccttgcttgctttctggctgcttgcataggtgttatctattttttattgagtggtcgtttttttttattgtctggtcttttataaccttgggattgcctaatttat

SEQ ID NO: 49546 - DNA, 406 bp, Zea mays
  Clone ID: LIB3067-058-Q1-K1-H8
gggtatggcactgaatgaagacaagttgcatcttaccaccgagtcacaagtaaaacttggcaaaatgctggcagaagcgtacattttgaacttctctacatcaacttgttaggtgaatacaagtgtctcaagatcttcaatccacaacaagtatatttgataaggtcgcctagtgacaagattactatgtgctcaagcacttaatcaatcgaagacattgtatctatcttatgtccgagaatacgctaaagtgcctcaattcttgtatagcatttcaaactcgcttcataacatttctttcatattgtaataatggttgcagcctaaaataaagtaagacactataaataatttgttaaagaaatatgtaataaatttatataatattccaaaaaaaaaagggcgg

SEQ ID NO: 49547 - DNA, 287 bp, Zea mays
  Clone ID: LIB3067-059-Q1-K1-A1
attgctcccatctcccaagacctcctcagaccctgtaagcgcagctgcggccatggacgccacgggcactggagctggagggaaggcgaagaagggagcggccggtcgcaaggccggcgggccgaggaagaagtcggtgacgaggtccgtgaaggccgggcttcagttccccgtcggccgcatcgggcgctacctcaagaagggccgttacgcgcagcgcgtctgcagcggtgcccctcgttacctcgcggccggtctggagtacctcgccgctgaggtcctggagc

SEQ ID NO: 49548 - DNA, 414 bp, Zea mays
  Clone ID: LIB3067-059-Q1-K1-A10
gaggattgcagatcgcaaaataaagctcgatgtctcgcctggagccattgaattcttgggaagcctcgggtatgacccgaattatggcgcgaggcctgtgaagagagtgattcaacagtatgtggagaacgaactcgcaaagggcatcctcagaggtgattttaaggactaggacagcatcttcgtggacacccaggttacggtgccctccaatggccagcttccgatgcgaaagctagttcttcagaaagtgtgtgagcaatctaagcctgctgctgaaggcgagaagatcttgcctactgtctgattggagctctgttgcagttttgcaaatatggtgcaacataatgtacatatgaaggttgctgattctaagagtatatcctctggcttataagagcattgcatccacat

SEQ ID NO: 49549 - DNA, 430 bp, Zea mays
  Clone ID: LIB3067-059-Q1-K1-A2
atcgaacaagattaagaaggggacaaaaggagatgtttctgtactgaatcctactcttatgatttcagttcctgcaattttggatcgtatcagagatgcagtgtttaagaaagttggtgagaaaggtggcctgacaaaaaagctgtttgattttgcatataagcggaatcttgcatcaattgaggggagttggtttggatcctgggcaccggagaggatgatatgggataccattatttataaaccaatacgggcaatgcttggaggacgtgtaagatttgttctttgtggtggtgcacctttatcaggtgacacacaaagattcatgaatatatgtctaggtgtcccagtgggtcaaggctatggtttgacttgaacctgtgctggagcagctttcactgaatgggatgacacaagtgttggtcgtgtt

SEQ ID NO: 49550 - DNA, 417 bp, Zea mays
  Clone ID: LIB3067-059-Q1-K1-A4
ccgtcgcttaaccgtctccatgagagcgactctcatatttgcatgttaagctgatcaggggtcacctttgatttgcctaaaaaatgacatggcttactccgttcgcgtgatcaatctgtgatgcttccactttgagaactttcgactgaggacatgcatcacgaactttgcatcttgctaatatgttctatttcaccaatgtctacgcctcatcctacaggctctgtatataagtcctttgtccaaagctcggtgctcatagctagatgtggacatcatactatcattgtccatgggactttcaacaacactgtgcttatttcattgcacacagtgatatctgcatttgctgacagctggaacccttacatcatcgtggcacgtaaaattctattggaatcatgcctattatagttc

SEQ ID NO: 49551 - DNA, 422 bp, Zea mays
  Clone ID: LIB3067-058-Q1-K1-G5
caggagcacatcgaccttggtatcaagtacgatccttcaacaggcatctacggaatgggcttctacgtcgtgctggagcgtgcgggctaccgtgtggcacgccgcaggaggtgcaagtcccgcgtcgggattcagcacagggtgaccaaggaggactccatgaagtggttccaggtcaagtacgaaggcgtcatcctcaacaaggctcaggccaacacgttgtaaacctcacctgtgggcaaaacagctctctggtctcttctcctcctccgtgtcaacgcaagaccaccacccacctcgccaggcttttttgggtttaatttgtgttctcagccctgatgtttagtctgctagcactctgtgggtgctgttgtcgcaagatcaccaccatgtcaattatttccgtgcccttgtcgcaaaaa

SEQ ID NO: 49552 - DNA, 441 bp, Zea mays
  Clone ID: LIB3067-058-Q1-K1-F1
cattgacgagcatggaaaatggatcggggggctctagctttgataggctgtcttcaagaagggaaagggaaattatcatacgaggagttctttcagtaacagcgatatctggggaggatctgcctgcgatggatatgaatggaaaatctgacccatatgtcatactttctctcaagaagacacagacaaagtacaagacaagggttgtgaccgaaagcttgaacccagtatggaatcaaacttttgattttgtcgttgaagatggtttacatgacatgcttatgttggaagtatatgatcatgacactttccgtagagattacatggggcggtgcatgctgaccttgacaaaagttttgctggaggaagagtacaaggaaagcttcaacctggagggagcgaagagcgtgaagctgaacttgcatctgaagtggtcggcac

SEQ ID NO: 49553 - DNA, 213 bp, Zea mays
  Clone ID: LIB3067-058-Q1-K1-F10
aaccgcgtaaacatgttaaccttaggccatgtattaattactccgctctaatgtttgtgtgtgtattgtcaaacttgcagaaccagttgcatgcatgaaaaataataagtgtctgggtatctatgggtgcggggtacccatctccgcaccagcgcacccagccagaaacagcagtttgtttggatctaatcagaacccgatgctatttgctgg

SEQ ID NO: 49554 - DNA, 429 bp, Zea mays
  Clone ID: LIB3067-058-Q1-K1-F11
cccacgcgtccggctacacacaacctgcatcaattccggcagcaccagtgccagcagtgggaccagcacctacaccggcgtcagcttaccctcagcaacctgcggcagctcctcaaccttattatggaacaacctactactgacaagtagagtaatcttcgatggcgatctgacgagcctgttaatcagcaggtttgtcgatacgaggtcaaaggcatcgcaaaaccctctgtactgccattgtttagccccccttcagacagatgccgtcgacgagatgatcgcttgagaacaaatttgagattggtatagtctgcatttttgtcgttagcatgtgtcgctagggattgctattgtttttcttgtaatagcataatctttactgtagaagaggcagctggtgctaaccaatcctatgaacatataatt

SEQ ID NO: 49555 - DNA, 415 bp, Zea mays
  Clone ID: LIB3067-058-Q1-K1-F12
cccacgcgtccgattcgcacacacccacgccgtcggatcctcctgccctccccacgtccagctctctccgccgaagaatcggcggcggcggcggcggcgagcgccttcccttgtcaaaatccacccggcggcagagcagagcctcgttgctgaggaggggagatggcaggcatgaccgatatgccgatgaggccggcgcggccgggcccgccgatgcagcaccggggccctccgccgatggcgcgcctccgccccgaaccaatcgaccgcgagaagacctgccctctgctgctcagggttttcacaagggttgctggtcaccaccaaaatgaagagttttctgtgagagggaaagaaccaaaggatgaagttcagatttacacatggaaggatgccactctccgtgagcttactg

SEQ ID NO: 49556 - DNA, 392 bp, Zea mays
  Clone ID: LIB3067-058-Q1-K1-F2
cccacgcgtccgctccaagctcactggcacgcagtacgcgtcgtcactggacttgctccggctcttcgcctacggtaccctgaatgactacaagagtaattctggattccttccagcactgttgcctgaccaggtccgaaagctaaagcagctcagcgtgctaactctggcagagtcaactaagatactaccgtatgatcagctcatgcaagagttagacgtttcaaatgtaagagaactcgaagatttcctaatcaatgagtgcatgtattcgggtatcgttagaggcaaactggatcagctgagaaggtgctttgaggtacaatttgcagctggaagagatcttacacctgatcagctaaagaacatgatagagactttgtctgattggt

SEQ ID NO: 49557 - DNA, 404 bp, Zea mays
  Clone ID: LIB3067-058-Q1-K1-F3
tccgcgtgcgcaaccgcatcgcttccctcccggcacaagaagaagattcggttgggttgtttgtctcttgcaaactggaatggctgctgctgccactgctattgctactccgtccgtggcgccggaggccggcgaccggaaggcggtggcaccgccagtcgacgcggtggatctggagctggagctggagctggaggagaagcacgtgctggcggtggacgacagctccgtggaccgcgcggtgatcgccaagatcctgcgcagctccaagtacagagtgacgaccgtggattcggcgacgcgcgcgctggagctgctggcgctggggctggtccccgacgtgaacatgatcatcacggactactggatgcccgggatgaccgggtacgagctgctgaagcacg

SEQ ID NO: 49558 - DNA, 169 bp, Zea mays
  Clone ID: LIB3067-058-Q1-K1-F4
acgcccacgcgttcgctcacggctcagtatcactctatgctcgtggtcaatgtacttggtacgggggtgtgactactgtacccagaatgactgctacagtgattgtggattccttccaccactgttgcctgaccaggtccaaaggcttaagcacctcatatcgctaact

SEQ ID NO: 49559 - DNA, 421 bp, Zea mays
  Clone ID: LIB3067-058-Q1-K1-F7
cggacgcgtgggcgaactggcgcctataaactgggtcgcctctggtttccaaaagacatgtggtgacttcagggttgggagatatcaggtgagcgaaacggtgaacatattttcacatagagtgaggtggactaaaggtccccgtggcatcatcaggatcgttccccagaaaggggacacgtgggccttgtaccgtaactggtcccccgactggaacgagctgacgcctgatgacgtgatatacaagtacgagatagtggaagtcgctgatgatttcactgaggagcgagggctgactgtcatcccgttgctgaaggttgccggattcaaagccgtcttccacagacacgtggatcccgaagaggtgaggaggataccaaaagaagagctgttccggttctcgcaccgggttccttctcgt

SEQ ID NO: 49560 - DNA, 446 bp, Zea mays
  Clone ID: LIB3067-058-Q1-K1-F8
gggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggctacggcggtggcgggcgccgtgatggcggcggcggctacggcggtggcggctgcggctacggtggcggcggtggctacggtggtggtggtggcggc

SEQ ID NO: 49561 - DNA, 427 bp, Zea mays
  Clone ID: LIB3067-058-Q1-K1-F9
cccacgcgtccgggaggccaagcgcacatcgttctgctgcctgccgccgtcggtgggctgggacgtggcgcgcacggaggccgcacggttcctccgcgcgcgcgggcccttagacctgacggccccgcagctactgcggctggcctcgctgagccgggcagggcccatccggcttgggctcgacattggcggcggcacgggcacgctggcggcgcggctcaagaagctcgtcaacgccacggtgctgacgacaaccatgaatctgggcgctccctactcggaggcggcggcggcacgcggggtggtgccgctacacgtgccgctgcagcagcggttcccggtgggggatgggaccatggacgtggtgcgggcggggcacgccgtgaaccgttggatcccggaggtggcgctggagttcctgtggtac

SEQ ID NO: 49562 - DNA, 425 bp, Zea mays
  unsure at all n locations
  Clone ID: LIB3067-058-Q1-K1-G10
aatctctggaagacagctatcagcacaccaaatatcacaagcaaacaaagaaccagtgggcccgtgatgatcctgcatttgttgttattctgattcttttcctcgtgtttgcaacatcagcttactgtgcagcatatggagagagtgcctcacatgctgctctaacaatcacttcggttgtgtttctccatttcttgtttgctgggatagttttggccacactttgctggttccttacaaattcttacttgagagaggaacctaacagccatgttgttgagcaacgcgtggagtggctctatgcatttgacgttcattgtaactcgttctttcctgcgtttgtcatcctatatgtggtgcagtattttctgtcgcctctattggtcgcgcatggcttctttccagctttgntatctaatctactc

SEQ ID NO: 49563 - DNA, 424 bp, Zea mays
  unsure at all n locations
  Clone ID: LIB3067-058-Q1-K1-G11
gcagcagccacctctccggccactcggtagtgcctctggtgatggggcctctctgataatgaaatctgtgctggatagagcgaccgagctactggcggatccccattccgcagccaactacagcagatcagcacgttcgctttggcatgcgtcgtttgatgctttctttggactgctgacgaagtactgtgacagcaagtatgaaagtatcgtgcagaggtttgccatgcagggatccaactccatgggaggacctgaaaccaccaaagcagtcagcagggagatgcccgttgagctgttacgtgcgagtcttcctcatactaatgagcagcatcgtcagacactgctagattntgctcggaaatctacgcatctgcctggtttcagccctactgctaaccgtggacttgtcaattctgaatca

SEQ ID NO: 49564 - DNA, 427 bp, Zea mays
  Clone ID: LIB3067-058-Q1-K1-G12
ggttcagtaacggaggatattctgactgggtttaaaatgcatgcaaggggctggcaatgaatctactgcatgccaccacgaccttgtttcaagggttctgcaccaatcaatctttccgatcgtcttaatcaggtgctccgttgggctcttgggtcagtggaaattctgcttagtagacattgtcctatctggtatggttacaatggacgattgaagcttttggagaggctggcttacatcaacactattgtatatccaatcacatccattccgcttattgcctattgtgtgcttcccgctatctgcctccttaccaataaatttatcattcctgagattagcaattatgctgggatgttcttcattcttcttttcgcctccatttttgccactggtatattggagctcagatggagtggtgttggca

SEQ ID NO: 49565 - DNA, 383 bp, Zea mays
  Clone ID: LIB3067-058-Q1-K1-G2
cggacgcgtgggtgcctgcccagcatgcagctctaactcaccccgtgcagtagacgccgaggggtggcaagtagctaggaaggagagccggagggaagggcaggccatggcgctggaagcggtggtgttcccgaaggagcacctagcgggcactgccaaggcgcgctcggcgtcgtcactggcctgcggcttccgcaccgaggaggtcgaggacaacggcggtgtggttctgcaaggagaggccggcgcggccaccacgtgagagtactgggacgcggcgctctgcccgtgctccactgcacctgctggtgccgtggaggagtgctggtacgtgcggcaccggctttccgcgtccccaccggcgacggcgcccttcgccgtcg

SEQ ID NO: 49566 - DNA, 321 bp, Zea mays
  Clone ID: LIB3067-058-Q1-K1-G3
gtggccccggacatggatcccccctcgccgagggtgtccggctgcgccttatgagccgtcgggcgcgggggctctggcggtactggccgcagggcacaggcacgccgtcggtccaagcccaggaagaagtgacggcgtagcaacacgtacgtacgtgcggtacgttgttggttgtgccatctgtaaagtccgggccatggttgttcgtgcgtgtacatgtttactatactaaatactatgggcatatatagatgagcttgctactcggtgatcggtatacgtacgccattatttaaggcaggatagttcctccttttttgg

SEQ ID NO: 49567 - DNA, 344 bp, Zea mays
  Clone ID: LIB3067-058-Q1-K1-G4
agcgtcaagagcgtcaacatgggcaccgtcgccaccatccccggcaagtgcggcgtctccgggggattccccatcagcatgtccaccgactgcaacaagatcagctaagttacgacgaccaagctaataagcctaccgaacgtacacgtacgtcccgcgcgctgcacgagtgatgaagccagggaagaaataaaataaagctagctgtattgccaggagcagcatgcagtatcgatctatatatatactgtactgtagtactctattatatatgtatgtgtggcctgcagtgcgagttgcttcgatccacctacttgttcagacagttgaaaaaaaatctaaat

SEQ ID NO: 49568 - DNA, 407 bp, Zea mays
  Clone ID: LIB3067-058-Q1-K1-E9
gcaatatctttgccatatcatggggtttcagaccataccagtcgtaccagaccttgtggtggataagagtgaggttgaaacctcacaagttgcgggctctgattcaatagtcatagaaagggtggaaacaaatctgagcaaggaaccctttctgctagttcccttggaaaataaggaagagaaagagtcccttggtataatttgttatcttgaaaataacaaggttgatgttcctgaggccttctctccaaggagagatatacttgaattgtcaatctctagcaagtctactgatgatagtctttcattgggttgtgagacaccacgtgaaagcatctttgatccatttgctccaggacctgatgaggcagcctgtgcaccaaagaagaaagtgactagaggtgctc

SEQ ID NO: 49569 - DNA, 312 bp, Zea mays
  Clone ID: LIB3067-058-Q1-K1-D11
atttccgggtcgaggcccgagtcacgcgggcaacctcacgagactacaattaatgtttctttcacaaatttagcaactactgcatgaacagggttcgtcttccaggcagccgtgccaaagttcatccagtttcgtttggacccagctagcagcagcactcttcctgccagtggaaatgtgtcagtctcacaaagcctcaatgtcactaacaaccagcattggcagaaaccacttgcaatgcggattctgatgtggtacaaagtgcaagtggtgaaaacaggctggagcaagggcaaatcagcaacttttctt

SEQ ID NO: 49570 - DNA, 426 bp, Zea mays
  Clone ID: LIB3067-058-Q1-K1-D12
ggggaggtgatgccagggcagtgacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcatggccgacgacgaagaagcagtgctggtgcggcgagtgcaccagctggtcgggcgtgtggacctgcgacgacctcctcaccaagtgcgccgtcacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgt

SEQ ID NO: 49571 - DNA, 451 bp, Zea mays
  unsure at all n locations
  Clone ID: LIB3067-058-Q1-K1-D2
aatgccttgagaaactgagcactctgttaagttgcttgaagcttcctctaacatcctcaaagcgtaccattcgtgatttctgcattgaaagcgcgtccatagttttctgtactgtatctagctccacaaaagtaaccgctaacaaaaagctagagttgcttgtggttgatgaggctgcccagctgaaagaatgtgaaacactgatccctttgcgtctgtggaccttaaagcatgctgttctaattggagatgagtgccaattaccagcaacagtcaaaagcaagatgcattatttggaagaagcctcttcgaaaggttgagttcacttgggcacgaaaagcatctactcaatacgcaatacagaatgcatncatccattagtattttcccgaacactagctnttatgaaaggaaggatctcggatgcatctaatgtcatggaaaaagaacc

SEQ ID NO: 49572 - DNA, 393 bp, Zea mays
  Clone ID: LIB3067-058-Q1-K1-D3
cccacgcgtccgcccacgcgtccgtccacgcgtccgagcgaccaaagcggtggagagcacggtgtgccggacagcccattcgcatcccctacgaaatctgctgcgcttttgcatgacagtttcactgccacggagaccgagaacaccgtcgcgtcccgtgttggcgtggatgccggtgtcgggagcaagatcgacggtgggagcaaccatctccgcccccccgcgttggaaatcccttcgcccagctcctacttcttccccatgcacaggctgtcctccgatcacggagccatggggatgtaaagttcaccattgtaggcgagttataccctccaacctagtcatagaatactagaagccaagaaaagcgatggtggaatatatagggaaaaa

SEQ ID NO: 49573 - DNA, 422 bp, Zea mays
  Clone ID: LIB3067-058-Q1-K1-D4
cgctgccgcacttctacccggacggggacttccagatcgcgtgcgaccacttcacgggcgaggggagcgacctgaacaacgcgcccaacggcgggttcgcgtacgtgcggtccagcgcggagacggccgagttctacaggttctggtacgcggcgcgggagcgccacccggggctgcacgaccaggacgtgctcaacgccatcaagcgcgacccctacgtgggcgagctcggcgtccggatcaggttcctcagcaccgagctcttcggcggcctctgcgagcccagccggaacctgagcagggtctgcaccatgcacgccaactgctgcatcggcctgcgccgcaagatcggcgacctcaacgccatgctccaggactggaggcggtacagggcgctgccgcgcgaggagaagcgcgaggtg

SEQ ID NO: 49574 - DNA, 416 bp, Zea mays
  Clone ID: LIB3067-058-Q1-K1-D6
agctggaggaggacgccgacaaggtgaacctgtggttcgaggtgcctgggcagtccaagggggacctcaccgtggagatcgacgaagacgtgctcgtcatcaagaagaggaaggagctggtgggccagcggagccctggcagtggcgtcgcagagtacggctcccagtcccagcagcagagcaggaggtgcaccgcagatggcaaggacccgctgccggcggcacagcagggccagggcggcgaggtggtctatgcccggatgctcctcccggcggggtacagcaggtatggcgtgcaggctgagctcaagtccggcgtgctcatggtcacttgtcgcaaggtcacggagcgagcgcgcaggatgatcgtcgtctgtattcaagtcaagtagatatgcttgtatgtgtatgcacat

SEQ ID NO: 49575 - DNA, 367 bp, Zea mays
  Clone ID: LIB3067-058-Q1-K1-D7
cccacgcgtccgcccacgcgtccgagcagatccccagaacagcagccccagcacgagtccgcatatgccaatgacgcctgagaatctttagctgctcaaagatgctggaaaatgctaaggggcccagcatgttttgcccatgcgcgtcggtacaactgcaattctataggatccagtctgagattttgctcgtgttttgggtttcccttggacacaccgctgctgataccattgtagagggaggagcataacgtttccgtttcgagtattgactttgggcacttatagctgtcaagacatgacctggttcttgttagattgtatcactagattgcttttgaattcgaacgaagtgttaatcgtgggc

SEQ ID NO: 49576 - DNA, 474 bp, Zea mays
  Clone ID: LIB3067-058-Q1-K1-D8
cccacgcgtccgcccacgcgtccgcccacgcgtccgcccacgcgtccgcccatgcctcagggtgttgtgctgccgcctcgcccgcacagccaacgggcttgccgtcgcgcgatggagctttgttggtcgcagtcgttccacgccaagattgcgatccgtttctgagcttcgagggatcaaagatcaagcgttggcgaccaagtgatccagttcttcgagttccacgagattaaagaccctaagcatctctttggtgaaggttgcctttggtgcaatctatgctcaggtaaagaaggaggcgtcgaggtggttctccaggagttccaggacttcgacgagttcgaggattaggctagcgacctcccccagtcagctgcttgtggtgggtttatttacgttggctacgtttctattctgtgtactttgattatattatgtaaatgactctagtctttcatattattacttactctt

SEQ ID NO: 49577 - DNA, 421 bp, Zea mays
  unsure at all n locations
  Clone ID: LIB3067-058-Q1-K1-E1
cccacgcgtccgcccacgcgtccgggttggtgagtacaagaaggccatcactgactgctcgggggtgctggatcaagataaggataatgtctcagtgctagtgcagcgtgctctcctttatgaaagcacagagaaatataggcttggtgccgaggacctgcgtttggttctgaagattgatcctacaaataggctggccaggagtacaattcaccgcctgaacaagttggctgactagggatgtctttctagcgccctgatgtaatattgtactaccactgtactgcatacttctcacatgagatctgtgagttatttgaactctntagtctttattactatacttggggctttgggggaatagtttgcaattgtgttgntattaagtatgaaatacgaatttacatacaatatattattt

SEQ ID NO: 49578 - DNA, 324 bp, Zea mays
  Clone ID: LIB3067-058-Q1-K1-E10
gaagtgttccttttccatatcttttctggcaaagacgcagttatcacagatggaaaatatttaatactacgactgctacagaggaaacaagatacctgtaccgatggaatatgattcgtgtattattccttgggaacttgaacttatcatatggagttgtaaattattttgtcatttcgacttatgttcacttcatcattgccttgtatgatcatgtaattcagagaccgcagagcaaaggtgggctggggcttagggcgtatttggaaacaaagtattttaaaactatagttttagaataatatagttttaagatgttacgac

SEQ ID NO: 49579 - DNA, 431 bp, Zea mays
  Clone ID: LIB3067-058-Q1-K1-E11
cccggaaccacgaaggggatccatggcggcggcgggttggctccgacgtgcggcggcgggatcgctgccccgcctgccttccggacttcccctcataccgcctcctccttccggccctctcaccgaggcgcagtcgctcgtggtccccggcctcggcgccgccgccgggccagccatggagctcatggccgtccctaagaagaaggtctccaagtacaagaaaggtttgaggaatggacccaaagctttgaagcctgtgccggtgattgttcgttgcaggtgctgcggccgagtgaagctaccccacttctattgctgcagtggagaaagaggaaacccaagcgagtcgaactcataaatgttttgttttcctactttgctcactatgctacgtctgaaatctggacatcgtaataccaatgaaataaatt

SEQ ID NO: 49580 - DNA, 417 bp, Zea mays
  Clone ID: LIB3067-058-Q1-K1-E12
ggaaaactctggatattcaagtatggacattcagcgatctgtagacaaacgagatggctgtggtatattctataaacctaaaagtgcagaactggtgcagaatgaagtaatactgtacaatgatttagtacaaaaatatgttcctagtgataatgtaaatagtgctctggaaaataattcttcaacagaagaagacaagaatgcagagccagataatagcaagcgtggagatccaaatgatccacgcgttagattgaagcgggactgtgttggtttactcgcggctttcaagcttaatgatccttgagatcaaagtttgattgtggcaaacacacatatttattgggacccacaatggatcgatgtaaagccggctcaggcaaaatatcttctttcgagagtatctcagcttgagca

SEQ ID NO: 49581 - DNA, 237 bp, Zea mays
  unsure at all n locations
  Clone ID: LIB3067-058-Q1-K1-E3
cggacgcgtgggcaaaactccaagctgaaagagaggaagctgntaggaagctggatgagtggggatctgtttgatgcctttgctagaacatatttgtggttagaactttgtcagaactacgtgcaatctgtttgaatgcttcaaacctttgtggtggaacctttgtatgtttgaacctctattgtggaagaactagtgtgctggaatgatgtatgacttgtgatgagaatgttgtgt

SEQ ID NO: 49582 - DNA, 242 bp, Zea mays
  Clone ID: LIB3067-058-Q1-K1-E6
cccacgcgtccgcccacgcgttcgcccacgcgtccgcccacgcgtacgcggacgcgtgggataaattccgtgaccagaagctaaaaaaaaaaaaaaaaaaaaaaaaaaaaaaaaaaaaaaaaaaaaaaaaaaaaaaaaaaaaaaaaaaaaaaaaaaaaaaaaaaaataaaaattaaaaaattaaagtaaaacaaaaatgaaaaaaatgaacttttttatacagccacctaaactggaaaaac

SEQ ID NO: 49583 - DNA, 290 bp, Zea mays
  Clone ID: LIB3067-058-Q1-K1-E7
gttccacgcagcagatcagagagtctgcaggtacgctagcgatctagctgccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggcggtggaggatctggtggtggtggtggtggaagcggtgggggtgggagtggagggggtggatcggttggtgtgagtggaggcggaggatctggtg

SEQ ID NO: 49584 - DNA, 474 bp, Zea mays
  Clone ID: LIB3067-058-Q1-K1-E8
ccttctctccggtccgggaatcggaagctcagggcagaagtttagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgctaaattggcgaagaaggagagccaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagtgctacttttcgatagcgtgctacttacaccataaatacaagtcaaccaagtcgaagacttacacaaagaaatggagaatctttg

SEQ ID NO: 49585 - DNA, 395 bp, Zea mays
  Clone ID: LIB3067-058-Q1-K1-D10
cccacgcgtccgcacgcagcagatcagagagtctgcaggtacgctagcgatctagctgccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggcggtggaggatctggtggtggtggtggtggaagcggtgggggtgggagtggagggggtggatcgggtggtgggagtggaggcggaggatctggtggaggcgtgagcagcggtggaggcggcggatctggtggtggtggaagcggtggcggcagcggatctggctgaggtccgacgagcggtcgtttggccgt

SEQ ID NO: 49586 - DNA, 176 bp, Zea mays
  Clone ID: LIB3067-059-Q1-K1-E12
cccacgcgtccgcccacgcgtccgctagaactagtgctgagggaatagctcgcttgttgaatcccagtgttttagtccggtttagccttagccatgaatgtaaaaatgttgtaaaattgtcagcctgccttacaactccttccatcaaggcaaaacgagtgcaatttcttcacgac

SEQ ID NO: 49587 - DNA, 430 bp, Zea mays
  Clone ID: LIB3067-059-Q1-K1-E3
atccaagggcatctccctcaaccctatcacctcgctctactacgtcgcgccgtgctgccgctgcttcctcgtcgtgccctgggtcttcgtcgagctgcccaggctacgcgccgtaggcaccttccaaccggatttcttcgtctttgggaccaactcactctgcgcctttgcgctcaaccttgctgtgttcctgctagtgggcaagacctcggcgttgaccatgaacgtcgcgggagtagtcaaggattggctgttgattgcattctcgtggtccgttatccgggacaccgtcaccccgatcaacctgttcggatatgggatcgcgtttttaggggtggcctactacaatcatgtcaagctgcaagcgctcaaggctaaggaggcccaaaagaaagccgcacaggctgatgaggaggttggatcgctcttg

SEQ ID NO: 49588 - DNA, 78 bp, Zea mays
  Clone ID: LIB3067-059-Q1-K1-E4
ataccctacccgacccactcctcctaccccacttcctctcactcaaccttatattcttcctctacaacaacactaaac

SEQ ID NO: 49589 - DNA, 367 bp, Zea mays
  Clone ID: LIB3067-059-Q1-K1-E5
cggactcatggtgcgggagtatcggtgaaacacgagctgtattatgagagcatcagatgcgaagacctgctcttttggaactgactgatctttggatattcacaggatggccttactgaacattgcctatacttgctaatagaaatgaacgggcatataatacctgatgcgacatccttgctaggtatgctctcataattccggcatgcattcatcgaggcagacggcccaccgtgcttaaaggcaatgattgaacatggagttgtaccagagatagatcactacttacgtatagtgcatcatctagggcatacatggctgctagatgaagcatgcgatcttattcagacgatacccatgacttcaa

SEQ ID NO: 49590 - DNA, 400 bp, Zea mays
  Clone ID: LIB3067-059-Q1-K1-E7
ggataaagtgctaaactttaccatattaaatgcatacttgagtagagccgccattctcgcggtacgaggagcaaagctatcgaaggtggttggccgagcgtgaggaggggagagagtaaaaatagttgtcaatggtggggaggagacagaaaggagtttggtgaccaattttagcacagtttaacatctttggtgaagctaaagtgccgatgggtactaaactttagcacaacacttttagtcgccctgttgtttctttaatagctaaactttagtaaaaatgtttggtgctaaactttagcaaaggggaataaatgggtcttaggctgatgatttagctgggtgaaagctgaagacaattgcatgtcacgtaaaccaagcttggtagctcatataatgc

SEQ ID NO: 49591 - DNA, 355 bp, Zea mays
  Clone ID: LIB3067-059-Q1-K1-E9
ctctatacatctcagaggaagtccagtttaagattcggcatggaaacactcttttgaaccgttgaagggatctgttcctctgagatgtatgagagtaatttgtagttatacaagattgcaatgacatgctggaagattaacatagacatgtacggatataacgaaagattaacatgtgctggaagcagtttcatacatacttgtgttgcagctgtatttaagagaatgagagatacaaaatcttttgagctaaattccatgacacaagtaacataagccccccggaacctaaaactttacctggattagggttcttcccctttaataaaaagatggtcacccttttgaacttgcc

SEQ ID NO: 49592 - DNA, 325 bp, Zea mays
  Clone ID: LIB3067-059-Q1-K1-F1
gttatagatcgcgagcgccgtccttttcatgaacctgtagaaagtttgtgtgtatttggtaaaggtagccaaggataagcatctgatggttaagctgcctgtcgggatccctactaatgttctccacatgaccacccgcaaatctcgaagcagtttatgaacaaacacatgggaccggtacgagttacgtatacataagacggtgatcgacctgatcagctaccaagacaattttaagcagatcagctctattaccattgacccacttgaagaacaaaacgtgactgtcaactacatgtaatgacgatctatatattcttaccgc

SEQ ID NO: 49593 - DNA, 399 bp, Zea mays
  Clone ID: LIB3067-059-Q1-K1-F10
cggacgcgtgggtccaaacaatccatatggcaaaacaaagctcgttgttgaggatatttgccgggatatctaccgttcagatcctgaatggaagatcattttacttaggtacttcaatccagttggtgctcatcctagtggatatcttggcgaggacccacgagaatttccaaccatcttatgccctatggtcaacaagttgcggttggtaggaagcccagttctgacagttttaggaaatgactatgcaccaggaaacggacactggggtccgagatcacatccatgtggtgaaccttgttgacggacatatcgttgtattgcaaaatcttttagagaactctcgcatagggtgtgaagcgcacacccttgaacccgaaagaggcacatgtgctctgg

SEQ ID NO: 49594 - DNA, 224 bp, Zea mays
  Clone ID: LIB3067-059-Q1-K1-F11
aaaaaaaaaaaaaaaaaaaaaaaaaaaaaatttaaaaaaaaaaaaaaaaaaaaaaaaaaagggaaaaaaaaagaaaaaaaaataataaagaatactgattattataagagtacatgataaaaaaatagattatataaagtgagaataaaaaaataaaaggggggccggcttttaagaaccccaatgttttttaaatatgttgggattggtaatttttttttttt

SEQ ID NO: 49595 - DNA, 241 bp, Zea mays
  Clone ID: LIB3067-059-Q1-K1-F2
tctgaagtacaccacggatgcttcatttgttaagcatattgaacagtctggagaaatagttgattcgatggtaatgtaggatatgcacacatttcatccactgggctttggctttattacatactctgaccctgctattgttgataaagtgatatatgacaatcattgttatcaatggatagcatgtttaaatttagagatccatacctaaaatgtttggtgcaatttatctttaatgatt

SEQ ID NO: 49596 - DNA, 185 bp, Zea mays
  Clone ID: LIB3067-059-Q1-K1-F3
ccgactcgacccactcgtccgatcgcacatcatgaccaaacaccctacattactcgcacacaaacttacataacactcagggcatcctttcacatataacactcgcacacatattcagcaacctcaatccacacccaacaataactgctcaaaaaaaaacttataaacattaacactaactcacc

SEQ ID NO: 49597 - DNA, 399 bp, Zea mays
  Clone ID: LIB3067-059-Q1-K1-F4
cccacgcgtccggtgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctgactttgtgaaagttgattgggacaaatgggttgatgaagatgatgatggtgctgatatcaacatggatgggatggacttctcgaatttcggtggcatgggtggtatgggcggcatgggtggcatgggtgatatggctggtatgggtggtcttggtggcatgggtggtatgggtggtcttggtggcatgggcggtatgggaatggatgatttcgaagatgagagtg

SEQ ID NO: 49598 - DNA, 234 bp, Zea mays
  Clone ID: LIB3067-059-Q1-K1-F5
ctaaatctgacagtctgatttttttcccccgtcacacctgtgacctgtgtagctgacactgagctgtccttgatggagaagatgctgcatgtattgagctgatgttgtagccaaaaaaaaaaaaaaaaaaaaaaaaaaaaaaaaaaaaaaaaaaaaaaaaaaaaaaaaaaaaaaaaaaaaaaaaaaaaagtgaaaaaacaaaaaaaaagccacattaaataaatctattaataa

SEQ ID NO: 49599 - DNA, 446 bp, Zea mays
  Clone ID: LIB3067-059-Q1-K1-F6
cggacgcgtgggcggacgcgtgggcggacgcgtgggtccggacgcgtgggccaactccgaagcccctaccggcaaccctagcgaggcgatggggaaggcggaggcgaggtcaagggggcgcggcggcggcggcggcggcggaggcgccagcggcaatccggggaagatcttcgtcggagggctcccgcgggacaccacggatgctacatttgtgaggcattttggacagtatggagaaatagttgattcggtgataatgaaggataggcacacatctcagccacggggttttggcttcattacatactctgaccctgctgttgttgataaagtgatagaggacaatcatgttatcaatggaaagcaagttgaaattaagagaaccataccaaaaggttcggggcaatctagctctaaggatttcaagactaaaaagatatttgttg

SEQ ID NO: 49600 - DNA, 275 bp, Zea mays
  Clone ID: LIB3067-059-Q1-K1-F8
aaaaaacgacacatacaaagctagtacaatccattattaataagaaactagatctgaatgacaagataaacattgaggctagcaaaataagtgtgggggtcaggtccatattctgtatcgtagaaaaagctgtagccaaatggtggaagaaactcgttcgagatgatcaaagggcacctcactttgtgaaagttgattgggacaaatgggttgattaagatgatgatggtgctgatatcaacatggatgggatggacttctcgaatttccgtggc

SEQ ID NO: 49601 - DNA, 323 bp, Zea mays
  Clone ID: LIB3067-059-Q1-K1-F9
tcgcccacgcgtccgtttgttttttgtttttagcttcttcttcttctggtgtttcaggcttagggagctgctagtgagatggaagaactgatgtcagatcagacgtggtgatgactagccatgaaagtgaactttactgataccgtactgagccatcaactggtgggggtaattagctagctagctaactgctggggttatggttaatgcatgaactgctattagttaccagatgtaagtgtaaatctggagtcctgctcttgctactgtatgtgaactgactgtttcactccactactatgtaagaatcacagcattaattt

SEQ ID NO: 49602 - DNA, 277 bp, Zea mays
  Clone ID: LIB3067-059-Q1-K1-E11
ttcccgggcatgtcgacccacgcctccggttcaactcatggtccaaaccttaattttttctagctaaagaccttcagcataggagcaatgaaaggagttagcttggttctccatggatcatctggtctatctcatgaactctctaaagaatgcatatacattttgctcgagaaaatttaatgtgaacactcatgttcttaacaactacctggctgttcctcataaagccccaaaaagactttattcaagtgatggcgtctgctaaatatgcatttaa

SEQ ID NO: 49603 - DNA, 408 bp, Zea mays
  Clone ID: LIB3067-059-Q1-K1-G1
acagaactttcacctccacacaattttatgtacagctaccatcatttatgcttcagtatgaagtccaataatcaaaagccatctgcttcttattcagcttatcacagtcaagtgatgtatccatgactcctttaacataattcaaataccccaaaacattgcaaatttactctggatggtcgttgttagctaaaccgcttaccggttttaacctctgacccaatgactagctgatcattatatgctttacctcaattccaacactacagcttgaactgcactgtgccaggaatacctgtccaattgtttttatcgagataatctgcaatttaacctatcatatgcaaattgttcctgtagacacttatgtcattcatttctcatgcaaaaaaatattttggcactaat

SEQ ID NO: 49604 - DNA, 162 bp, Zea mays
  Clone ID: LIB3067-059-Q1-K1-G10
catcagagccatgccgttcaagagcaagttcttagctgccctggccgtgccgagacatgcgcagctcctagaaccggcgtattcctgtgaagtattgttgtctggccacgcctagtttctatgtcgattcctattaggcggctcttcatggctggtgctcac

SEQ ID NO: 49605 - DNA, 393 bp, Zea mays
  Clone ID: LIB3067-059-Q1-K1-G11
cttaatctccgcttccgccaccagagcgccacccttggctgcgccatgactttctccatctacctgcccccgtccccggcgtccaaccttcccgtgctgtactggctctcgggtctcacctgcaccgacgagaatttcatcataaagtccggcgcccagcgcgccgacgctgcccacggcatcgccctcgtggcacctgacacctccccacgtgggtaaatattgaaggagagtcagacagctatgattttggtgtgggtgccgggttttatatgaatgccacaaatgaaaagtggaaaaactggcgcatgtatgactacattgtgaagggaccttccaaaagttttaagggataactttgaacaactaaacccgtaacaggcttaaattttg

SEQ ID NO: 49606 - DNA, 333 bp, Zea mays
  Clone ID: LIB3067-059-Q1-K1-C2
cctgccgccgggcgccgcgctggtgcagatcgtgccgtggggcgggctgcagtggatggcgcggtccgactacggctaccccgcggaggccatgggcctaaagtacatccagtacgagatcggtgtcgccgagagcacgcttaaggacaagttccccagcggtctcaagatcttgaccaactcgactgcgctacacaagatggggttcatgttcatcacgcatacactcatggaccgacaggacatcagcgtcgacgtaggccgattcaaggaggtgctgcttcaggtgctcaacatggctcgcacagtattacagctgcatgctcactgctt

SEQ ID NO: 49607 - DNA, 321 bp, Zea mays
  Clone ID: LIB3067-059-Q1-K1-C3
gttacatgaagccatagaaccaaaagtgtcactcggatatcaaatcgagcaatatctgaaggatgaaaatcaatggcagctttctgatttggactgccaagctctgggtgctggcaagagccatatacaacgcggttatgggcacattcgggtatgtggctcccggtatgccaatacaggtctgttaaatgagaagagcgatgtctacagtcttggggtgctactactggaagcagcgactgctagggatccagttgactatggtcggcctgctaatgaggttcatcttgtggagtggctgaaaatgatggttggcactag

SEQ ID NO: 49608 - DNA, 349 bp, Zea mays
  Clone ID: LIB3067-059-Q1-K1-C5
gtcccacaacgtctcctggcggagatttcagcatccaggttttgcagaagcgctggaggtttgggacctgcagtatcccccttgattccactgcagggtcgtccaatttgaccctgacaggaggttgctttcatttgccaccttcagacactggtttagcatcatgaaggtgaatgggagtggcataacttcaatagtctgacccagctcctgagcacctgtcatagttttacctctcacttcattgacaccctgaagcttcaggctggagtatctttgcagtcagaggcaattgtcaaaggagtgccctatggaactgaaggctctaacagttttgtgcaatggctta

SEQ ID NO: 49609 - DNA, 400 bp, Zea mays
  Clone ID: LIB3067-059-Q1-K1-C6
caatcactgttcaatgcttagtctagtcctgtattgtgagaacccacataattcgtgagagatggagatctatgacggattgaaagcatgacgatctagaacaacactagccggccagtcaacttctataagcaccgcaatgggctcctcaagaatgcgtacgaactcttcgtcctctgcgactcttaagttgccctcatcatcttctctagccgtggtcgcctctacgagtattccaacaacagtgtcaaggctactgttgagaggtacaagaaggcacacaccgttggctcttcctctgggcccccgctcctagagcacaatgcccagcaattctaccagcaagaattatcaaaactgcgcaaccagatccagatgctgcaaaacactaacaggcact

SEQ ID NO: 49610 - DNA, 394 bp, Zea mays
  Clone ID: LIB3067-059-Q1-K1-C7
gaagtacaaggcagaggacgaggaggtcaagaagaaggtggatgccaagaacgcgctcgagaattatgcctacaacatgaggaacaccatcaaggatgacaagatcgcctccaagctcccggctgaggacaagaagaagatcgaagatgccgttgacggcgccatcagctggctggacagcaaccagctggctgaagtggaggagttcgaagacaagatgaaggagcttgaggggatctgcaaccccatcatcgcgaagatgtaccaaggcgagggcgcgggcatgggcgctgctgctggcatggatgaagatgccccgtctggtgggagcggtgctggtcccaagatcgaagaagtggattaaattggttagtgttcgaggtttggtttggtg

SEQ ID NO: 49611 - DNA, 369 bp, Zea mays
  Clone ID: LIB3067-059-Q1-K1-C8
cggacgcgtgggctgggcgatgcgcaggctgagttcaaggctcttcgcttgtcggaccgcgcgcgcgagaaggccgtacaggatcttaccgaagaattggcaaaggtggatgggaagctgaagctcacagagtctctccttgaaagcaaaaaccttgaagcaaagaaaatcaacgtctaaaaaaaagcagcgcttgccgcacagtttgcagctgaggcaacactacgaaaggttcatgcggcacataaggatgatgacatgcctactattgaggccatacttgcaccactggaagctgatctgaaactggtccgtcaagagattgcaaaattacaagatgacaacagggcattggatcgtcttacaaag

SEQ ID NO: 49612 - DNA, 416 bp, Zea mays
  Clone ID: LIB3067-059-Q1-K1-D1
ctgttaagctctgctgcggcgtgccctgttgtttgggtagcgtcaacgtcgagcgccagttgcggatgtgcctctgcctgctatcagcggcagcaaaaattgcaagctctcgagacttatgtcccttttgggcaccattaaactgattattctaaagtctggccacattattttaaaagacagaaaccaactagctgaagaagaagagatcaaagacaagatgaaagaacttgaaagggatctgcaaccccatcatcgcgaaaatgtaccaaaacaaggggcgccgtcataggcgctcctactttcatgcatcatgatgccccgtctgatgtgagctatgctggtaccaaaatccaatgaagtggctctaattttacaacgttcgaacttggaaaacccgaggtgtccccaaccta

SEQ ID NO: 49613 - DNA, 425 bp, Zea mays
  Clone ID: LIB3067-059-Q1-K1-D12
cccacgcgtccggtctgctcatgcaaaactttttttagaaaaaatgttgagagaagactgggcaatcagtcacaatacatatacttatttaatgataggtttatgcgaagaaaggaacatatcacggttttggtaatgtcggaatcttgcaacaaagtgcagatggtcacctgatagctaggatatgatgggcctgatcagttacttgtgcaaatggtgagtgattgaggaagccctaaaacttatgaactctctatttgactgctaccatgatctgtttcttagtgcatattgtgcacttctcaaacagttgcgcaggacaggtcataccagcattggatgctcactgttggaggatgtcaaagaacagggtgtggctgttcatcgatcattattcttgtatgtgatggatggctttctaaagg

SEQ ID NO: 49614 - DNA, 315 bp, Zea mays
  Clone ID: LIB3067-059-Q1-K1-D4
caaaatatgcaccctgatattgtctccacctacactcaatgaaatatcccacgaaaattgggaagccatttttatattaaaccactgcacacctttttcccacaacaaataccctatgtcttctatatacccacttttaattttcacctcacaaatactctctgtgtctgctattctttcaaaaataactccacatttttatacaccacaaccccaaattcaactcaaaatgtacacatatcaaatatcttattcacaactctatataaacacacattctacaatatatatacactcattccagtttcatcccaa

SEQ ID NO: 49615 - DNA, 456 bp, Zea mays
  unsure at all n locations
  Clone ID: LIB3067-059-Q1-K1-D5
gggagcggcggcggcatggctacgccgcactgcttctccccaggctggagatcatggtcgtcgtcctggcgatgccgtgcgtcgcccaagcggcggcggcgctcatcaggggcgggaccacgtgcggcctggtggtcgggatcgtgctcaccgccgtcctgacgtcggtcctggtggccctgctgctgttcctgtctctgggcatcaccatgggcaagctgctgcagtacagggaggtgcaccatgaggaggggcaggaggagtaccactggtaccaggatctggcccgccgcgccgnctgcctgcccaggcttggcccgctcttcgaggacctgcgcggcccgcccaagtacatgcgtggcggtggaggcggcaagcgccgcgccgaaggcggcggaccagagcggcgggtcatcgcgtcggaggacgagaacgaggggtcgagggcgcccttgg

SEQ ID NO: 49616 - DNA, 444 bp, Zea mays
  Clone ID: LIB3067-059-Q1-K1-D6
aaaatatgcactgagattttgtcttcacctacacataatgaaatagctagggaattttgggtaacattggtttggtttaaactttgcacggtttggcccacaacaaatgccatgggttttctatttgcccagagaaaactttcagcgcacaagtactcttggtttctgctttgcttccaattagaactgcagtgtttgagacgacagtaccataatttcaactaaagtgtacatcttcaatcttctttgcaaggctatatataaacacatgtaccatcatatatagattcggttggtggttgcatccaaagtagcacttctcatcctatgagtagtattccggtgtacaaccaacaggattggttcaccttggaaattatctcgagacaatttagaattgtgttgcactatagttattacatatgttgctttaaaattacaagc

SEQ ID NO: 49617 - DNA, 432 bp, Zea mays
  unsure at all n locations
  Clone ID: LIB3067-059-Q1-K1-D7
cccatgctggtggcaaggacggagcaaatggcgacaaggctatgctgtcatcaagagatgcgagcgagagaccactgaaagctgagtggagacgctgaggtggcgaatcaaaaccccaaaccctccatttggttagtgcaactatttgggtcggtggatggcgtctgcagtttgctcaacttatttacagggttttgggtcatgccttttgtgatgtatagctgaagtattttcccggtttgttttgtttcccagacccccagacttacccctttcctttttcttnttctctccttcttctttctttcttttttttcttctttttcttttttttttctttttttcttttctctttttcattttttttttttttttttcttttcttccccttttcttttttttttcttttctcctttctttttttttcttttt

SEQ ID NO: 49618 - DNA, 221 bp, Zea mays
  Clone ID: LIB3067-059-Q1-K1-D8
ttacaactgaattcgagaacaaacttatgagcatgatgtttcttttgcctgatttaaatgattgttattttacccatttatttaatcatttttaagttcattttgctgtacataataaaattgaaatcttttataaatcaatgaacaattttaaacaatatgattattataattctttttaattattttaccaaagatattctttttataatctacttttt

SEQ ID NO: 49619 - DNA, 318 bp, Zea mays
  Clone ID: LIB3067-059-Q1-K1-D9
cccccctcccactccgggcagcagccagcatccagcaggcatggggatacccgtggtgggtggcgtcgcggcggcctactcgtgctcctcctccctcgccgcgccaccgagggccgccgccgccgcggcgagggcgccgagccgcgcgcacgtcgcggcggccgggatgtcctccagggcgtcctccttcgtcggtttctgctgatgcgacctttctgcggtggccgctattgttgcttgtctgtccattaagactggcttccatgaaatttgataggttctggtgttccaaaccgaaggatgaatcattgtttgtcc

SEQ ID NO: 49620 - DNA, 374 bp, Zea mays
  Clone ID: LIB3067-059-Q1-K1-E1
aggcgttcgggacgcatggtgcgggagcatcggtgaagcacgcgccgtatgtcagagcagcagatgcgaaggcctgctctttcggaactgagtgatctctggatatgcacagcatggcctgacggaacattgcctatacttgccaagagaaatgaacgggcatataagccctgatgcgacatccatgctaggtgtgctctcataatgccgggatgcattcatcgaggcagaggtcccacggtgcttcaaggcaatgactgaacatggagtagtaccagagatagatcactacttacgtatggtgcatcatctagggcatgcatggctgctagatgaagcacgcgatcttattcagacgataccgatgccttcaa

SEQ ID NO: 49621 - DNA, 420 bp, Zea mays
  Clone ID: LIB3067-059-Q1-K1-E10
cggacgcgtgggcaaggccacacacacactcacaccactagtaggctagcctagccttgtagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcccgggttcagcatgcccggcagcggcagcagcctacccgggttcagcttgcccggcagcggcagcatgcccctc

SEQ ID NO: 49622 - DNA, 351 bp, Zea mays
  Clone ID: LIB3067-059-Q1-K1-C12
ggcttgtttgattggggaggggacatggctgatggggtgaaagagatgctagatgagtcgatcctcatggacgatgaagatacttatcaaagtactggcgtatgcaaattacgtaccatatgcgcataacttaaagtccgcactgacaagccagagtccctactgccacatgatgcccgggatctgaaactctatcaccagcacttcggcaaaatgttgatcgattgactaaatgctctgtccaaagaactcactatttgactgctacgatcatctgggcaccagcgcatattcagcacttttaagataattcccgacgacaggttataccaggatttgatggcgattgac

SEQ ID NO: 49623 - DNA, 417 bp, Zea mays
  Clone ID: LIB3067-059-Q1-K1-A6
acctgtctgaagcaaacccaagcgctgacatggatgagatggtgaaggcaattgtgtccagggtgactgatgtgatgccaaaagctgcatcttttacttcttcccagatggcaacctcaagcaatggattcgactcctcggttatgtctacagcagcgacaaccggaagctctggaagcaccgtgactgaccttggggttgtaggcagaggcgtcaaacgagctagcatcaagccgatctctgctgaacctgctgctaatacctgcacttgattcaccatctcaacaaggtgacagcagcatcaactctgaggttgttcctgcaacgcagactggagacgagtcagtatctaagtaaattacaatttcattagccctactgtaatgttaacttgctggaacatattaactgctatgt

SEQ ID NO: 49624 - DNA, 442 bp, Zea mays
  Clone ID: LIB3067-059-Q1-K1-A7
ccttccctccacccgtgccgtcgcctcgtttatccgatctgccacctcctcccgtgtcgcgacgttccttcccaactccgcagcgtagcctctccgcggcgcgatccagatccaggtttttcagcatgggcctggtgaaggaaggcatcgacatggaggagggaacccttgagatcggcatggagtacaggactgtatctggtgttgctgggcctctggtcatattggataaagtaaagggcccaaagtaccaagaaattgtaaacatccgacttggagatggcaccaatcgccgtggtcaagtcctggaagttgatggcgaaaaagctgttgtgcaggtctttgaaggaacttctggaatagacaacaaatacacaaccgtgcagtttacaggcgaggttttgaaaactcctgtcttacttgatattcttgggcgcatttt

SEQ ID NO: 49625 - DNA, 429 bp, Zea mays
  Clone ID: LIB3067-059-Q1-K1-A8
cccacgcgtccgaaaagggtcaaaagtctctctcactggagacttctattggaatgtggcagttgctatttgctgaaaggaactggcctcttctggatcattggtgtcagtttttacaggtcagacacaataaagccatatctagagacacatggtcccagctgctggaatttgtgaagacgaccgatccacagttatccaactacgacgacgaaggtgcctggccctacctcatagacgaatttgtggaatatctgactgagaacggactcgtccagcgtaaaagatgaacaacggggagatgcatctccaaacaatggttgggctgtacaaacatgatttatctcggtcagctcgacgcccaaggcctgatattggcactcctgctcaattcattcaccaaactggtggcatatcattgaatttgct

SEQ ID NO: 49626 - DNA, 448 bp, Zea mays
  Clone ID: LIB3067-059-Q1-K1-B1
gaattcccgactcacgcgtccgaagatctgcagcacatagtgtgattcatgttaattatcctgtgatgcatagcgaaggtgccgaggtcatacagcatatgattgaccaatttattctatagtaaaagccctggtctttggaaacagacctggaccaggatacgtgatttgctaactgcgggctgagtcaccagcctggtgagcacgtttatggaaatcccaggtataagacttagtctctgaatggtggatcaggtatatagttatagagggtggaaacacgtgcgcatgcctgatggttcatttagtcatatgtgatcatatacatgttgtacggtgcatgtaactttagtactatccttgtcattgtaaatgctcatttatttatagtattggtctcttacaccgttattttgtgagaatattattagaaaaaaccggatgcttt

SEQ ID NO: 49627 - DNA, 311 bp, Zea mays
  Clone ID: LIB3067-059-Q1-K1-B11
cccacgcgtccgagctcgaggcacaggactctttttataatttatccatccatggcttggtggaattccaatagcagcagcaacccgctggaagccatgggcgccttcttctcgaagcaggtggaccggcggaagttggtgaccaccgagaagcgggcgctggccacgcggctggcctccttcttcgtcacgttctctgggtctgagcaccggccttcgtaccttaagctgttttctgctgatctgggcgcctacttgtagtactcttatcatgtgtgacatctttttctctcaattttttttttattttt

SEQ ID NO: 49628 - DNA, 86 bp, Zea mays
  Clone ID: LIB3067-059-Q1-K1-B12
cggacgcatgagctgaggagggccattactaatacagatgacgagcgactgaaaaagccggcactagccggcctgctgaattaagc

SEQ ID NO: 49629 - DNA, 209 bp, Zea mays
  Clone ID: LIB3067-059-Q1-K1-B2
tacccgacccaactcatctcgtcagacctctcaaaaccgtcaacagtctttttttttttatacttctattttaatattatgattgctatttcttcaaatgaacctgaccttttccggatcattgttgtcacattttacaatatcctacacaattaaaccatatccatatacacattgtaccagctgctggaatttgcaagaccacctat

SEQ ID NO: 49630 - DNA, 380 bp, Zea mays
  Clone ID: LIB3067-059-Q1-K1-B3
tcgcccacgcgttcgcccacgcgtccgcggactcgtgggttttttttttttttttttttttgttttgtttttttttttttttttttttttttttttttttttttttttttttttttttttttttttttttttttttttttttttttttttttttttttttttttttttttttttttttttttttttttttttttttttttttttttttttttttttttttttttaataaaaaaaaaaaatattaaataaaataaaaataataatataaaaaagatatataataaatatttttatataaatattatttttttatataatttttatattatatattattttttttttttttaaaatttatttatatttttattttttttaaa

SEQ ID NO: 49631 - DNA, 220 bp, Zea mays
  Clone ID: LIB3067-059-Q1-K1-B4
agaattgttgatagcctgttttggggatttgagggcaactgcaaaaaagagctgtatggcaacgcttgcagtagaatcttggatctgggtaaaatgagatgtccatgtaagcatttgatattagttttttcagttatattgactaggaggatgtccatgtaagcatttgatattagttttttcgttaatctcgagaatgttactggtgccttttactgtt

SEQ ID NO: 49632 - DNA, 442 bp, Zea mays
  Clone ID: LIB3067-059-Q1-K1-B5
gctgccagaagtttggatgtcaacaattcagcaaagaaggctaacttgggtacttcatgtggatcatcagcctatgaggaaatttctggcttttcacaacacacactgcagtcatttacagtggagagattgcgtgcacttctacgacaaagtggtcgatcgaccaaaggcaaaaaggatgaactgattgctcgcttacgggagtcgcagggttgacatgaatctggtacttgtttagtcaatcaaaccccttcaggcaggggttacacgaccaaatgagtaccaggctgtacttgtcaatggctgctctgcctagattgaatacaatgtaatggcatatgtaggttgagactttgccggaccttattatactcagaatttgttaactagctgttacctgtcagtagtcatgaattcactgttttctcatacccggttggtt

SEQ ID NO: 49633 - DNA, 437 bp, Zea mays
  Clone ID: LIB3067-059-Q1-K1-B6
gctagatcgcagaggactaatgttcctgtgtatgaagcatcgtccaccacgtgggtattgtgcagaccatggctacccttatagatcatacggggcaccgtatttccccccatatggttatgggagggctcctagattccgtcgccctatgcgctacagaccttacttctgaagtacggggtagggtaatgaagttcaatgcaaaaccagcccatggtcactggtcagtcccgggaataatcaactgtatcgtttgcactgttgcggctcaatgctcctgtatcagctgccttttctgacctttgtttcaagtgccgccataagcgacggacatgttgtattggcttgtaatacaggacgtaataagtgcacacactttcttgaagcgtgctttcccactttccaaggttactaactgtatgcaatttctggagttt

SEQ ID NO: 49634 - DNA, 330 bp, Zea mays
  Clone ID: LIB3067-059-Q1-K1-B7
cccacgcgtccgttttttttttttttttttttttttttttttttttttttttttttttggtttttttttatttatttattttttttttttttttttttttttttatttttttttttattttttttaaattttttaaaaaaaaaataaaaaaaaaaaaaaaaaaaaaaaaaaaaaaaaataaaatttttaaggagaaaaaaaaaaaaaaaaaaaaaaaaaaaaaaaaaaaaaaatttaaataatttacaaaaaaaaaatattataaaaaaaaaaaataaatttataaacaaaaaaaaataaaaaatttaaataaaaaaaaaaagtatttat

SEQ ID NO: 49635 - DNA, 112 bp, Zea mays
  Clone ID: LIB3067-059-Q1-K1-B8
ggccgccctttttttttttttttttttttttttttttttttttaggagcaggcagctccggtagttctatgttggaaaatgttcttttcaaaattaaaagatgatttaactt

SEQ ID NO: 49636 - DNA, 431 bp, Zea mays
  Clone ID: LIB3067-059-Q1-K1-B9
gatacactggttatgcaaatgctacttttgatccacagcggagcacctcttatctgacaaagatgataattttgcatgactacccacttcacattgctcaacagtcatcctttattaattttattgagagtctgcagcctcgtttcagagttgtagatgtggagacaatggaaggagaggtgtatgctgttttccagaaagcaaaaggaaacctgttgcaagcattcagcactatgccaggaaggatcagcctcactataggactctggacaaccagtcagactcttggctatgtttctcttgctgggcagtttattgactccgattggaaagtgcaccgaagaatgctcaacttcatgatggtgtcttctccccattcagagaatgcacttagtgaagctattagctcaagcctttctgagtggaatatg

SEQ ID NO: 49637 - DNA, 456 bp, Zea mays
  Clone ID: LIB3067-059-Q1-K1-C1
gccatgacctcggactacacctcctcggtcttcgctccggcgtcttactcttacatgcaaggcggagcgccgaagagaatgaggagcagctacggcggcgcgccgcccagcctcgcacatgacgcggccatgcctggctttggccttgataaagtgagctaccaccactaccaggcgttgcctccttattacgtcgggagcagcaacgcgtcggtgggcaacctcggtcttctgcagcaggctgatgatgctccagctccacaggatggggcgagcgccggggatatctggagcctcgacgagctgctcatgctggcagcagctggtgcttattgagaaccgcaagaaaaaaaaatgtgttggcgctgctagctggagacgagacgagggcgagaggcagttgcatcattcgccattcgctatcggtttggctctcctatatctagtatatatatg

SEQ ID NO: 49638 - DNA, 423 bp, Zea mays
  Clone ID: LIB3067-059-Q1-K1-C10
ccacaaaatgcacgggaggacccagggcgccgccgtcggcgacatgacccagcgccttgtgctcgccctctcgctcatcgcatcagcgaccgccgtgcccgctgtcatccgcacggtcccggacgaccccaccgcgggctcctctggcgcggcagacgccgcggacgcgctcttctgtgacagctggaggctgtcggtggagacggccaacgcgggcccctggagcgccgtgccctcgcgctgtggggctttcgtgcgggactacatggagggacctcgctacgcgtctgactccgccgtcgccgacgccgacgccctagccttcgccttcgaagccctggccgccgccgagtggggcggctcggcgagcgcgaggcctgcgtgggtgttcgacgtcgacgagacgctgctctctaacgcgcc

SEQ ID NO: 49639 - DNA, 431 bp, Zea mays
  Clone ID: LIB3067-059-Q1-K1-C11
gaacagggccatgttcatcatcatgagcatagccatggaagttctattactgtcacaacacatgaccaccaccactcaggcactggacaacaccatgacgctgaggagccactgatcaagcacgaggccgactgtgagggcacccaatctgctgctaagaagcctcgacgcaatataaacgtacacagcgcttaccttcatgtgcttggggactccatccagagcatcggggtgatgatcggcggggctatcatctggtacaagcccgagtggaaaatcatcgatctgatctgcaccctcatcttctcggtggtcgtgctgttcaccacgatcaggatgctgcgcaacatcctcgaggtcctgatggagagcacgccccgtgagatcgacgccaccaggctggagagggggctctgcgagatggaaggcgt

SEQ ID NO: 49640 - DNA, 439 bp, Zea mays
  Clone ID: LIB3067-059-Q1-K1-A5
ccggctcgttcgcccacgcgtccgttcactcttccgcccacgcgtgcactgtccggtcagattctttcaccctatacagtgactctatgaacatcttccgtaagaaggaattcacctgatctcatatttcaaaagtagtcagtgcttgatgaataatggtcttgcaatgcacgactcgatggtactaatgaaaacaatgcgcttgtattccttgaaggaactatctctttgtcagcacctcataatttgtccacttcaaacaatctgatgcttgaatatacctgcttctgaattcacatctaggcttactgacatcaattgaacctcttgaaatatatttaattatattctatcctgagagtttgtattttaaacaaccttttcctcaattaattacaaatatttaacccatttcttaattcaaattaatttatttaaa

SEQ ID NO: 49641 - DNA, 317 bp, Zea mays
  Clone ID: LIB3067-060-Q1-K1-B8
ctcacgcgtgcgcgtatgtggcccataacttttgctgatggctgattactaacaatgcgggaatgatcttccttcttaagacactaccgtcgatactaccactaccagctgacctacacgcagaagcgaccaaatgactaatatatagatcaatggcatattaatgcagtattcaactcttataccaatacatctatactaccacccatgatacctattcaggagacaatagcatcaacagcaaatatcaaactgactcttagtagatcaccctacccgaaacttgcatcattgcaagcagatgaggattcatagtt

SEQ ID NO: 49642 - DNA, 144 bp, Zea mays
  Clone ID: LIB3067-060-Q1-K1-B9
accacacctaagctgaagcctctcattattattactaataacacacgtataatactacggggatattattacctctatacaaacttcagatcgttcaacaatatatcttataatcttcatattgaagggattcaatatctcttt

SEQ ID NO: 49643 - DNA, 427 bp, Zea mays
  Clone ID: LIB3067-060-Q1-K1-C10
cggacgcgtgggtcccgagcgctccggcgagcccttccggcgctctcctcgccggcggcgggtcttccccgtcgcgccccgcacccactacctcctccgcccgctcctcgtcggttcctggacccgatcgggctccgctccttctccggcgccgccgacaccgcgtcgcacgcgccgtccatgggggccaccctgttcggcgggctcatggacacccggttcccgaagcgccggtcgggcttcgccaaccgccggaagagggctagcttgcgccccaaaggtccgtactactgggtgaagtgcaagcctgacgagcccataccagttagtcagccgaaccaagggagcgtacgagggaggaaggtgaagaagcggatcaagcaacgcaaggactttatcatggctgagaagaagaagcgcagagctc

SEQ ID NO: 49644 - DNA, 346 bp, Zea mays
  Clone ID: LIB3067-060-Q1-K1-C11
cccacgcgtccgcagagagtgattcaaactggaatttctatgtgaaaatagtcgataagatggagaagcaaatagttgatcaagtggaaacgaaaatagttgatgaagtggagaggtccttaggttaataggaacaaaggttcaatcaagagaaagttctgtatttgtttgtgttgcttagcaggtgttttgcattgcgccagtgctatcatgtgtaatctaatttagtaattgttgtttcatagacaaaacatgatttgaagaatcttgataggttttgttgttccaaccgagggatgaatcattgtttgtcctgtatcgagtgttacaggctttctggtttgct

SEQ ID NO: 49645 - DNA, 132 bp, Zea mays
  Clone ID: LIB3067-060-Q1-K1-C12
tcccacgcgtcctcccactcgtccgaaaaatttttataaaaatcaaaataataaatataagggagaattaaaaataattttaaaccttaataaattaaaaaaaattttaaaaaaactctaacttaataaaaa

SEQ ID NO: 49646 - DNA, 393 bp, Zea mays
  Clone ID: LIB3067-060-Q1-K1-C3
attgcacggtggagttccccgactcgttttttccagagcagtgcaaggctctcgagacagtacttccaccaaggccttcatccaagctgacagacatggagatagatgaatgcgaggagacgactatgcatgatgtgaacaacatcgaggaagagatgcgcatgaagcaagctcacgctgcccaagaggcgtacgaggaggacgacgagatgccgggcggagcccagagagtgcagtgcgcgcaacagtaagcagactatcatcaaggcaattgtgaggggtggtgcccttaaagcatgggagtgatctctgtgtttgctgtcgtcgagctgtgaaaaatgaagctgaatcgacctctcatgcggcgaatgtatcccttttttgctgcaacat

SEQ ID NO: 49647 - DNA, 414 bp, Zea mays
  Clone ID: LIB3067-060-Q1-K1-C4
gtagaatgacgatgaggggtctctctgttgcggtcgctctggtcgtggtggtggccgcgggctgccttgccgcgccgcggggcgcggacggcgcgggcgagtgcggtgcgacgccgcctgacacggtggcgctgaggctggcgccgtgcgcgtcggcggctgatgaccccggatccgcgccgtccggatcctgctgcaacgcggtgcacgccatcgggaagcagagccccatgtgcctatgcgccgtaatgctgtccaacaccgacaggagcgcctggatcaaagcccatgtccacatcatcatacacaaacgctgcaaccatgtcaaacgacccgttggctacaagtgcggagattacaccctgccatgagcggcggtgagtacttcaggccggatttgctgcatggcatgcc

SEQ ID NO: 49648 - DNA, 434 bp, Zea mays
  Clone ID: LIB3067-060-Q1-K1-C5
attggaaggggaatgcaactcgacttaaaacctgtaatacacaatctgagcatctaatagtgaactctgatgggcctgaagaagtaaaggcaaacaaagagatcattttcacctatgatgttaactttgaggaaagcagtatccagtggtcatcccgctgggacacctacctccgcacgcctgacgatcattggttttccatcgtgaattctctgaccacggtcctcttcctgtctgtgatggttgccatgatcatgctccgaactctgtaccgcgatatttccaagtacaaccagctagaggaccaggaggaggcccaagaagagtctggatggaagcttctccatggcgatgtgttcaagccttctgccaatgccgacctgctgtgcgtgtacgtgggcacaggtgtacagttctttgggatgctgctggtc

SEQ ID NO: 49649 - DNA, 436 bp, Zea mays
  Clone ID: LIB3067-060-Q1-K1-C6
attcatttcgccgagaggcgaaagaactgcttcgcacctacgttactgctgaagatccagccggcacaccatcggcgaagaagaggccggagagaggatgatactggccgtgctcttcgccaactccgatggaaacatccttgtcgagcgattccatggggttcccgcggaggagaggctccactggcgctccttcctggtgaagctcggatccgagaacctcaaagggtccaagaacgaggagctccacgttgcctcccacaagtctgtgtctattgtttataccacggtcggggatgtctgcctctacattgttggcaaggatgaatatgatgagcttgctttggctgaggtgatctttgcaattacatcagcagtcaaggatgtttgtgcgaaacctcctaccgagcgcctctttcttgacaaatacgggagg

SEQ ID NO: 49650 - DNA, 434 bp, Zea mays
  Clone ID: LIB3067-060-Q1-K1-C7
atttcacggtggagttccccgactcgctggcaccagagcagtgcaaggctctcgagacaggacttccaccaaggccttcatccaagctgacagacatggagatagatgaatgcgaggagacgactatgcatgatgtgaacaacatcgaggaagagatgcgcaggaagcaagctcacgctgcccaggaggcgtacgaggaggacgacgagatgccgggcggagcccagagagtgcagtgcgcgcaacagtaagcagactatcatcaaggcaattgggaggggtggtgcccttaaagcatgggagtgatctctggttttgctgtcgccgagctgggaaataggaagctgaatcgacctcgcaagcggggaatgtatccttttttgctgcaacataaaaaatgctacccaagcatagctgggtaccttttaacttct

SEQ ID NO: 49651 - DNA, 428 bp, Zea mays
  Clone ID: LIB3067-060-Q1-K1-C8
accacgcgtccgcggcttttccgccgcagtttctccatggctgccgagggttccgccgagggcgtctattactctccacccccctgcacctacatgtcctcgaccccgcggcaacatctgccggacgagctgtaccgccccatcatgaatgtcgggcgcccaagcatcccgttatcccccgtcctggagcaatggaatcaagaaggccataccgccaagaagttcgtcatgcacgccatcgtcaagaagctcgtcggcctccgccgcttcgcccacgcactcgagctgtcgttctggatgaccgaccgcatgcacctccacctttcggtcggtgacgtcgcgtaccggctggacctaatcagcaaggtgcacggccttgagaaagccgtcgagtactacggcatggtaccgaagcagctgaagaagcc

SEQ ID NO: 49652 - DNA, 251 bp, Zea mays
  Clone ID: LIB3067-060-Q1-K1-C9
cacagacctacgcggtattggtccattttttttaagaccaacatttgtttaagaatacaggaatattaggaagactgaacattcttccggcattattcccataacctaacaaactatacaaagagtgccttcagctagaccagatatggtagctgatccactaatgtcacaccaaaacggtgacaccatagaccctcacaacacactaaggttgataatgagcttatgatatattccccaacaaattctac

SEQ ID NO: 49653 - DNA, 428 bp, Zea mays
  Clone ID: LIB3067-060-Q1-K1-D10
cccacgcgtccgcccacgcgtccgggcggtcggtcgcaaggcaggcggccccaggaagaagggggtgacgcggtccgtcaaggccgggctgcagttccccgtcggccggatcgggcgctacctcaagaagggccggtacgcgcagcgcgtgggcactggcgcccccgtgtacctcgccgccgttctggagtacctcgccgtcgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgttctccccaacattcactccgtgctcctgcccaagaaggcggctgataaggccgccagcggcggcagcaaggagcccaagtccccca

SEQ ID NO: 49654 - DNA, 424 bp, Zea mays
  Clone ID: LIB3067-060-Q1-K1-D11
atcttgaccagttcttacctaacgtgactagggcccatggctctttttgcttggtaatgtcactagggtatagtttctttagctcggcgctgcacatcatgtgagtagtaccttccaccatgcgcatttactctgctgtctatctgctgctggtttccttgtgcagttaaaccggtaaagggtgatgccctgctgttcttcagcctccatcctgatgcaacgacagactctgacagcttgcacggtagctgccccgtaatcgaaggccagaagtggtccgcaactaaatggatccatgtgaggtcatttgacctccctgtgaagcagccgggttcctctgacggatgcgaagacgacaatatcctctgcccccagtgggcagctgtgggtgagtgtgccaagaaccctaactacatggtgggga

SEQ ID NO: 49655 - DNA, 76 bp, Zea mays
  Clone ID: LIB3067-060-Q1-K1-D12
gccagaaagagcaaacagtagctccatcaatttcctttggcaagtaaaaccccctatagaagacattgcttgtcct

SEQ ID NO: 49656 - DNA, 296 bp, Zea mays
  Clone ID: LIB3067-060-Q1-K1-D2
cggacgcgtgggcagctttgaccgccgcctcttttcccctccgctactgctcctccccaggggagtccctcgcaggagcggcggcggcggccgcggcggcgaggtcgcaccccacatcggcgagcggcggcggcacctccggaggcaaaggctagatgttcgggcgcgctcctgacaagagcgacaacaccggagtctacgagatcctctcgttgccccagtacgcgttccaggacgatctcaaggaggactaccgcaaggctgatatgatgaaccacctcgacaagggcggtgac

SEQ ID NO: 49657 - DNA, 420 bp, Zea mays
  Clone ID: LIB3067-060-Q1-K1-B6
ctctgcaaggtgatttccgttcagtttggccagaagggcatcgggtacctgaacacctacgacggccgtaccatccgctaccccgacccgctcatcaaggccaacgacaccatcaagatcgatctggagaccaacaagatcatggacttgatcaagtttgacgtcggcaacgtggtcatggtgaccggcgggaggaacaccgggcgtgtaggagtgatcaagaacagggagaagcacaagggcggcttcgataccatccacgtctaggactccatgggccaccaattcgccacccgcatgggcaacgtgttcaccatctgcaagggcaacaagccttgggtgagcctgaccaaaggcctcggttttaagctcagcatcatctatgagcagtatatgcgcgactttgcttgccaagcttct

SEQ ID NO: 49658 - DNA, 444 bp, Zea mays
  Clone ID: LIB3067-060-Q1-K1-D4
cccaagatcaaggaggccatcaccgccaagttcaccgagtacctccgccgcgccgaggagatccgggcggtcctcgatgagggcggcgcagggcctggggccaacggtggcgacgcagctgtcgccacgcgccccaagaccaagggcaaggacggggacggaggcaacggaggggatgactccgagcagtccaagctgagggcggggctcaactccgccatcatcaccgagaagcccaacattaagtggaacgacgttgccggcctcgagagcgccaagcaggcactgcaggaggccgttatattgcccgtcaagttcccgcagttcttcacgggcaagcggaggccttggagggcgtttcttttgtatggccccccaggaacaggaaagtcttatttggcaaaagctgttgcaaccgaggctgattcaacgtttttcagtata

SEQ ID NO: 49659 - DNA, 149 bp, Zea mays
  Clone ID: LIB3067-060-Q1-K1-D5
accacacagagcaaacactaccaccattttttcccatatcaaagcaaaactctctatgcgagacattcaccaatcctcaaaatccatacttacatacatagatatagatgaatacaaaaaatacaacttatgcatgatctgaacaacat

SEQ ID NO: 49660 - DNA, 244 bp, Zea mays
  Clone ID: LIB3067-059-Q1-K1-H8
tcgcccacgcgtccgatgactgcgtcaacatttatgtgaaagaatggagagctagagagacgggctatatcagctggtaattcttgtgggtttttgcgtacgtgtcctccaaattacaagccccttttttgttgaaattgtcgtctggtagtcagtaaacccgaataaaaaatgtatatatggttttggaatttgggaagtgaacaaaaaccttttgttcaaaaaaaaaaacacctaaacaatt

SEQ ID NO: 49661 - DNA, 430 bp, Zea mays
  Clone ID: LIB3067-059-Q1-K1-H9
ctctacgacatcaacaccgaggagtccagcatcggcctgcgcaatgtgcggtcctttggaaccgaaggtcggaagaaagacggagtgcagattcctgctagcgacaaagtttacgagtatatcctcttccggggaactgatatcaaggatttgcaagttaagtcatcaccaccacagccgccaccaccacaagcagcttccctgcacaatgatcctgccataatacagtcacattattctcaacctgcatcaacgtcatcaagtttgccttcagctgggggtgcagttttaccagactttagctcccaggcagttcaatatgggcttcagaggccaacctttcagagtaaccttgctctctaccaaccagggaatactccgtggggctcttcagtggcacctccagcaggaaatgctccatggggctctt

SEQ ID NO: 49662 - DNA, 440 bp, Zea mays
  unsure at all n locations
  Clone ID: LIB3067-060-Q1-K1-A1
cgtctccgcggcgtcgcagtcgcaggccggcccgggcactcctcccacccttataccagggcgggtcccctccgacccccgcgctgctgtttctggtaacctgcctttcttcgaccgtgtcctctatccggactcgttcccgcttgagaccccgccctctaaggaggaggacgcggcagcgcgacagactgatgaggcggtggcaccggctgtccccttgagggaggagacggagacagagagggaggcgtggcgactgctgcggagggcggtcgtcagctactgcggcgagcccgtggggacggtggcagcggagaaccccgagtgcatggagatgctcaactacgaccaggtcttcatcagggacttcgtgccctncgtgctcgcctttctcatgcgcggtgagaccgagatcgttccgaaccttcttctttacaccc

SEQ ID NO: 49663 - DNA, 428 bp, Zea mays
  Clone ID: LIB3067-060-Q1-K1-A10
ctacagcaccgggcgaggcggctaggccctctcaccgtccaccggcgactgggccggccgtcgctgccgccctgcctctccaccgtcgccggcgacgagcaccactaggtgtttttgagtctgttgcgagtgttgtggccatgtccatgttcaataggatcttcgggaagcccaaggagcaggccaactccaatgctttggccactctggacaagttaaatgagacacttgatatgctggagaagaaagaaaaggtgctggagaaaaaagcaaacgctgagcttgagagagccaaggagttctcgaaagcaaagaataaaagagcggctatccaatccttgaagaggaaaaaactttatgagcaacaaattgagcagcttggaaattttcagttgagaatccatgatcagatgatcatgttagaagca

SEQ ID NO: 49664 - DNA, 411 bp, Zea mays
  Clone ID: LIB3067-060-Q1-K1-A11
cggacgcgtgggcggacgcgtgggcggacgcgtggggtgatttttgggcattgtactacgaatttgaacttcagcatggaaatgtggacacacagaaggatgttctgaaaagatgtgttgcagcagaaccaaagcatggtgaaaaatggcaagcaatatccaagtctgttgaaaactcacacctgcctgttgaggctcttctaaagaaagctgttgtggtgcttgatgtagaagaaaatgccaatctggcaggagcctagactcactctttttacaaggagtttggtgaatgtgatttgtactaccatgcttaatttctgatcacttcaatatgagggactttaccttttaatatttcatctttattggtgagttaatatgtgatcatcagtacttgaacttgcatagcat

SEQ ID NO: 49665 - DNA, 373 bp, Zea mays
  Clone ID: LIB3067-060-Q1-K1-A2
ctagttctagatcgcgagcggccccttttttttttttttttttttttttttttttgacacgcaaataccatacatgtacatatagaaagttgcaaggttttcacaacacagcacaatacaatgcactggagttcttaagctaaccattacaatcaggcagctaatcattggtgcagtttcagcacatatataattccgcttccgcataccgcaggaaactatatgcatgcatcgacattatttggggggcatcggaccggagcatctcatatccattcagaccgaccgtgctcgttagggttcgccatgtccttgttcagctggtccatgtaagcctcctgatggtaccgcgtcttcaaggaaagatcattgc

SEQ ID NO: 49666 - DNA, 365 bp, Zea mays
  Clone ID: LIB3067-060-Q1-K1-A3
cccacgcgtacgcccacgcgtccgcccactctttcgggcagagcaacgactagctgccaggggtgctagcaagagtgcaacaatggccaccgctctgtccttcaaggccttggcactggccgcgctcctctccgtggtcagcgtcacctctggcgctctcgccgagcaacaggtcaagcgcaacgccaccaccgactagcaggacatatccttgttgtcctacagcagtggctggctgccggccaaggccacctggtacggcgcccccaccggcgccggccctgtcgacaacagtagtgcataccggttcaagggcaccaaccagtacccgttctagtccatgacgtgctgtggctactagccca

SEQ ID NO: 49667 - DNA, 344 bp, Zea mays
  Clone ID: LIB3067-060-Q1-K1-A4
gtcgttctacatctcgagccggccctttttttttatgctgcccatctttttttagaggcggcaattccatccacgtacatatatacagtcccacaagctgtcagatacacctcaatacactccacctaacttcttacgctaaccttttcaatcagctatttaacgcatcccccaggacactccccaatacactcccctttacgcatacccaaagacactatatccatgcatcgacattattcctctcaataaaatcagagccaacaatctccgtccaaacctacacatctccataaaaaccttcataccctttaacaactgggccatacacgcctcctcatggt

SEQ ID NO: 49668 - DNA, 414 bp, Zea mays
  Clone ID: LIB3067-060-Q1-K1-A6
ctagttctagatcgcgagcggccccttttttttttttttttttttttttttttttgacacacaaataccatacatgtacatatagaaagttgcaaggttctcacaacacagcacaatacaatgcactggagttcttaagctaaccattacaatcaggcagctaatcattggtgcagtttcagcacatatatagttccgcttccgcataccgcaggaaactatatgcatgcatcgacattatttggggggcatcggaccggagcatctcatatccatccagaccgaccgtgctcgtcagggtccgccatgtcctcgttcagctggtccatgtaggcctgctgatggtaccgtgtctgcagggaaggatcattgccatggtactgaaggagtccctggaacggaccaagaacacta

SEQ ID NO: 49669 - DNA, 440 bp, Zea mays
  Clone ID: LIB3067-060-Q1-K1-A7
actcccacaccgaagccgccggccaccaagccgcccacctacactccgacgccgccggtgtctcacacccccagcccgccgccaccatactactagaaagcgatgcctaccataccacactgctgtcagtctctggagcatttaggtggtctggatcaatggaagggttgtgtcctagccagccggcaaagatgagctgctgatggtaatgatgatgataagaggccactgctaccctactacgtaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatgggattgcaactatattgggtgtaaaacc

SEQ ID NO: 49670 - DNA, 432 bp, Zea mays
  Clone ID: LIB3067-060-Q1-K1-A8
gcggaggatctggtggaggcggcagcagctgtggaggcggcggatctggtggtggtggaggcggtggcggcggcggatctggcggcgggccgacgagcgggcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcatgctcgtcaactactgcggcaggcgcgttccctcgggcttacagtgcttctgactatcacacgcccatcgatcgatcgatctggatgctaaataatttctccaagctgctagtatacgtacgtacg

SEQ ID NO: 49671 - DNA, 68 bp, Zea mays
  Clone ID: LIB3067-060-Q1-K1-A9
acgacacatcagttttatacgaccacttatattaccgatgactctcttttaaaaatggagagatatat

SEQ ID NO: 49672 - DNA, 337 bp, Zea mays
  Clone ID: LIB3067-060-Q1-K1-B1
ctctacgcgagcgggccgcttctgccatccattcgcgcgcggcgtactcggaaccggagagagggaggggaaggagcgcgagatggacaaggccaataagctgagcaccggagcgtgggagaaggctaccaagagcaggagccacgggttcacggcgctgatcgtagcggtggactacgcgttactgctcgtcttcgacggcttgctcgtctacctcgtcaggtcacggatcctctactccgccgccggctccgcctagaccgggccgcgttcgtggatctctctactatctttcacgttttttcggagtccatggctgctggagcaccgggatctt

SEQ ID NO: 49673 - DNA, 423 bp, Zea mays
  Clone ID: LIB3067-060-Q1-K1-B10
cccacgcgtccgcccacgcgtccgcccactcgtccgcccacgcgtccgcggacgcgtgggcttccaccccggcagggaggacaagcctcagccgccacctgagggccgtcttcctgatgccaccaagggttctgaccacctgaggcaagtctttggcaagcagatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggtcttcttcagctcccaagtgacaaagccctgctgagcgaccctgtcttccgccctcttgtggagaaatatgctgcagatgagaaagcattctttgatgacta

SEQ ID NO: 49674 - DNA, 344 bp, Zea mays
  Clone ID: LIB3067-060-Q1-K1-B11
gaggcggtggtgaagtgcccgcattgcctcagcgggttccttgacgagatggagaccgtgcgctgcacgcccgcggccgatgacggcgacggtgacggcgctgcggctcaagtgtaccccggctccgaccgtccgagctccatctgggcgcacgctattctcagcacggtcgacagctccgtccgacgccgtcgctaccggcggtagacggaggccggcggcgacgtctacgacgggaacgaccctgagttcgccctgcgccggcgttgcgtcaccgcgttcttgcggttcctgtacgagctccgggaccgacagctgcatcggctggaggctgctgccggggt

SEQ ID NO: 49675 - DNA, 434 bp, Zea mays
  Clone ID: LIB3067-060-Q1-K1-B2
cacagggcacacgcacggcacgcagatacatatagagagaggttagctatagcttgcacatggatttaactaactaactaactggctagctagctcgatcggcagagcaaagcgaaagcagcaagaagcaaagcaatggagaaccctgcgagtgtgctagttctaccagcgcagttcaccaaactcaccttccgaaacctgtacatccgccgggccgggccgggcagcagggagataaccgaggagggcaggtgcgacctggacaagagatacgtgagtgacttccccgtctacgacggccgcggccccgacgccagccttgtggcccgcgtgcaggggatcaccagcgaaatcgggaacgcgcaccaactgttcgtcgttgttttcgacaccgacaggctcaagggctccacgctcgtcaccaatggcgtgat

SEQ ID NO: 49676 - DNA, 394 bp, Zea mays
  Clone ID: LIB3067-060-Q1-K1-B3
cccacgcgtccggttctagatcgcaagctgtcgccctttttttttttttttttttttttgtttttttttttttttttttttttttttttttttttttttttttttttttttttttttttataaaaaatcttttttttttcggaaattcccaaaaaaaaaaaaaatttaaaaatttttgcaacttttttttataattcaggataaaaaaaatttgtgggtttttttttcttttaaaataaacttggctttttaaaaaaaaaagggggggcctttttaaagattccaatttttctaccccttcttttgaaataataactttttttttagggcacctaaaattaatttacttgtgccgttttttaaaaatcttgacttggaaaaaccttgggtttcc

SEQ ID NO: 49677 - DNA, 452 bp, Zea mays
  unsure at all n locations
  Clone ID: LIB3067-059-Q1-K1-G4
atagcaatgaccgtgaccgtgttgttgaagccagagatgagctgcacaggatgctgaaggaggatgagctacgtgatgctgtgctgcttgttttcgccaacaagcaagatcttcctaatgccatgaatgctgctgagatcactgacaagcttggattacactccctgcgccagcgacactggtacatccagagcacttgtgccacaactggcgagggtctgtacgagggcctggactggctgtccagcaacattgcgagcaaggcttgaatatcaaatgcgaactgactaggagctccggatgtatcatggaaacttaggacagaatcgcctcttcaacctgttaggtgtcttctaccggcacaatatattttttgcttggaatatgtaatgatgttacggttcaacgtttattctaccctactatactgntggatgttctttgngcctgtt

SEQ ID NO: 49678 - DNA, 383 bp, Zea mays
  unsure at all n locations
  Clone ID: LIB3067-059-Q1-K1-G5
actcggtctcggaattcctcggagtcgactccactgcgtctcgtcccacgtcgtctcggtatcgagngtgcgtcctttacaaatatcaacatcctgaggagtctctagcatcggcctgcgcaatgttgcggtcctttgggactcgaaggggtcggaagaaaggatgtgaatggcatgattcctgcttagcgactaaagtattacgagtatatctctctttcnggggaacctgatatcaagggatttgcaaggttaagtcatcaaccaccgaccgccgccaacctcaagcaagcttcctctgcacaaatgactcctgccattaatccagtcacacttattctcaaccaagcatcaatcatcgtcaaaatttgtccttccgctgg

SEQ ID NO: 49679 - DNA, 382 bp, Zea mays
  Clone ID: LIB3067-059-Q1-K1-G7
aggaggaggaccagtagcggctggccgcgtccagtagcggcatgccactcagtgcttgcaaccgtggctaggggattgaagaagcacttgaagaggctcaatgcgcccaagcattggatgctcgacaagcttggcggagcttttggtcccaagacatattctggacctaacaagtgcagggagtgccttcctatgatcctcatcatcaggaacaggctcaagtatgctctgaactacctagaggtcatttctatcctgatgcaaccccatgtactcagctgatggcaaggtcaggactgacaagacctaccctgctgaggccatggatgtcattttcattcctgagaccttggagcactacagggtgctttatgacaccaag

SEQ ID NO: 49680 - DNA, 426 bp, Zea mays
  Clone ID: LIB3067-059-Q1-K1-G8
cggacgcgtgggcgctcttgaagaagctcagatgtggcgctcggagctaggaaaagctagaggaaacgctgtaattctagaagcggctgttgtcagagccgtagagaaagctagggtctcagcagcagatgctgacatccgcataaaagaagccatgaaccgacttgagtctgtcaccaaagaagaggaggatctcctagcccttgtggatgctctacaatgccatatacaaaggccagagactagtacgatacaggtttgcgaagagagcttggaactctgctcgactgcctcgaagcacatggaagatgataacgttgacaaagcttgcgtaagcgatccggattcaggaccggttaccgagaacgttgttgagttggacgaccagggacttgacatgcctactgtcggggacaccttatggga

SEQ ID NO: 49681 - DNA, 427 bp, Zea mays
  Clone ID: LIB3067-059-Q1-K1-G9
gttcatgttgatgtcactgagacaggcccggaatgatgttcgtcatttgttgctgtcacttatgtgggctggtctttgtattggcatcacacattttgttagagccaatggtcgcacgttcactaaccaacctaggtttcacaagtcacgccattgatggttgcaagatgaccaatttgctcgtcaagcggcctcatagattatcatcatccatcaaacttgttgacacagattggtttacatgaagtgttgcgtttttttggcacggtatttacccttttgtaataaggtttcttccattttgtaacaagtttttgtttactcgtcgcctacttttgcttcatagtgttctgggcatcatggtctttgttagaatttacttgtaaaaaccaagtgaatattccttcagcacatattattgtattat

SEQ ID NO: 49682 - DNA, 449 bp, Zea mays
  Clone ID: LIB3067-059-Q1-K1-H1
cccacgcgtgcgcacacgcgtacgcccacgcgtccgaatgactgcaactggttggtcacgcaatggtggctcaaatgcttttccacgtactgtatctctatcatctgctggtaattacaacattaaccagtcgcttacaaggtcttccgttggttgcactgccaatggtgagcaaagtgttattactagcattgctccaagatttgaactcagtgcagcctgttgaagagcctgtgtccagttggacaagcagtggtgcacagcatgtaggtactgatcacaagcacacaggtgtaactttaccagatgttatgtctgaaccacttgtatatgcatcaatggttcaacgtttcagtcgcactgattattcgaaatgtctcaatgcacgagaaatgctgttagtgaatggactgaatactgttaacttaacttgaaatggctatttaaag

SEQ ID NO: 49683 - DNA, 355 bp, Zea mays
  Clone ID: LIB3067-059-Q1-K1-H10
cccacgcgtccgcccacgcgtccggatctgaggttccagtcctccgccgtcgcggcgctgcaggaggccgccgaggcgtacctggtggggctcttcgaggacaccaacctttgcgccatccacgccaagcgcgtcactatcatgcccaaggacatccagctcgcgcggcgcatcaggggcgagagggcttgagcgcccgtcgtgctgctcgtcgttgtagtgttactagaagtagatggtggctttcgtttcgtggcttcgttatcctgtaggagtaatgttctagatgtcttggcttcagtgcaatggactgtgattgctcatttctgaaatttatcaatggacttgttcttgc

SEQ ID NO: 49684 - DNA, 424 bp, Zea mays
  Clone ID: LIB3067-059-Q1-K1-H11
cgagaggtttgagaaggaggctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaggaagtctcatcctacctcaagaaa

SEQ ID NO: 49685 - DNA, 417 bp, Zea mays
  Clone ID: LIB3067-059-Q1-K1-H12
ctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggctgaggctgaggctgaggctgctgctcctgctgctcccgaggagcttccggcggccgagcagcaggcagccgccgagccggaggccgctgctcctgctggtgccgaggagcccgccgcggccgaaccggccgccgaggcggaggctgctgctcctgctggtcccgaggagactcccgc

SEQ ID NO: 49686 - DNA, 428 bp, Zea mays
  Clone ID: LIB3067-059-Q1-K1-H2
gcgaaaaatacgcaagcgcgaagagttctagcagccacagaagaggtaccgatcctgggacgtccacagataggaccagaacttgaggcgattgtgcgattctctcgtacaccgaaaggtgaagcacgagctcatgtacatgtggatagacctgctatccaagtgcgacgcgtcgctagagatgaagattgcaacctgactcaacatgaagacaaacatgtgatgcttgtgctgaataataatgaaaacacgcatgcatgtcatcgtcaggaacaagagaaataatacaagaccagcacgcatggtcatactctatattatagatggtcaaaaagcacgaagaccgtgagccctgcacgaagcccgatttttgggcccggtccgagcacggcacggtagaatacgcggacaggctggaacaggaaact

SEQ ID NO: 49687 - DNA, 431 bp, Zea mays
  Clone ID: LIB3067-059-Q1-K1-H3
gcttgggatcttgcatattctattggcagttgtgtgttcagcagtggttctgaccccaggggacaggatgagcgaagaaggctgtacttgtatagtgcattattcaatcccctccgaagtatgttctacttggacaaaagatctaagaaggctcctgtttctagctttattatcaaggactcgctaaagttgaaaaccagcgatgctgaaacggttgtcaacctacatgctgctagcgaaaagtttgctgaactgattcctctcctcgagtcaagcgctgacttgcatgctctcaaagagatgctggaagatgagtaccttgagataccaggagacaccgtgaagcgtgtttttgcagggcttatactccgagatataaaggagttttggcgggttgcgctgcttctatccattctcttttaccgagaaac

SEQ ID NO: 49688 - DNA, 333 bp, Zea mays
  Clone ID: LIB3067-059-Q1-K1-H4
cccacgcgtccgatgactgcgtcaacatctatgtgaaagaatggagagctagagagacgggctatatcagctggtaattcttgtgggtttttgcgtacgtgtcctccaaattacaagccccttttttgttgagattgtcgtctggtagtcagtaaacccgaataaaaaatgtatatattgttttggaatttgggaagtgaacaaaaaccttttgttcaaaaaaataacataccaaaccaaaaatttatatacacataacatgtagtacgttctatgaataataccaaaaataaaggactctatatattggatacttaataaaaggggttgcct

SEQ ID NO: 49689 - DNA, 432 bp, Zea mays
  Clone ID: LIB3067-059-Q1-K1-H5
gctgaaaaacaaactcaccaacaaagtgacctgttactgggagcaagcaaccgagggcgagagccatggcgaagcctcgcagcggcggcggcggcggcctcctggacttagaggggcactacgccttttacggcgcctaccacagcaaccccgtcaacgtgggcatccacgagctcttcgtgtggcccatcttcctcaccgcgctcatgctcctccacctcaccgccccctccacgcacgccgtcggcatcagcgccgcggtctacgcggcctactactttcttctcgaccgccgcgcgggcgcgctcgccgtcctgctctgctacctctgctgggccgccagcggcgccctctctgcccgcctcggtttctctgttggatggaaaggtgtattggtggcccaattgttctggtgggttatgcaattcattg

SEQ ID NO: 49690 - DNA, 333 bp, Zea mays
  Clone ID: LIB3067-059-Q1-K1-H6
cggacgcgtgggcggacgcgtgggagggtagctcctctgggttcctcaaaggatgtttggctgctctctgctgctgctgcgtgctggaggaatgctgcggctgcttctgagacgtgagatgtccgggaatccgatcgcaagttatcgtcgctagcattcgggagcaccccagttattatcatataatagtaactgtgcttgtaaataatctggagcagcagtgttcatgagctcccagccccgcatttatattctcataatttgtagtacgttctatgatttatccgaaaataaaggactctatatatgggattctaaataaggtatttgcat

SEQ ID NO: 49691 - DNA, 407 bp, Zea mays
  Clone ID: LIB3067-059-Q1-K1-G2
cagacagctcttcttgcgttgcctactactagtgatggccagcctcactgacctggtcgacctcgacctgagtgactgcacagacaggatcatcgccgagtacatctgggttggaggatccggcatagacctcaggagcaaagcaaggacggtgaaaggccccatcaccgatccgagccagctgccaaaatggaactacgacggctccagcaccgggcaggctcccggagaggacagcgaagtcatcctctaccctcaagccatgttcaaggacccgttcaggaagggtaacaacatccttgtgatgtgtgactgctacacgccacaaggcgagccaatccccagtaacaagaggtacaaagctgccacggtttgtagccaccccgatgttgcaactgacgtgccat

SEQ ID NO: 49692 - DNA, 370 bp, Zea mays
  Clone ID: LIB3067-056-Q1-K1-F9
accacgcgtccgctagttctagatcgcgagcggccgctcgcgatctagacgaaatgcttgggtgaccctagatatcaaccgatgcacgatccatctcgatcctgtgatcgaataccggcgtaggtactactaataaagtcaggccccgtcaaatgctttacatggtgattgaagtctggagcttctcagcaccaccatatattgtgttcagttcttgtgtttattgccatagctaccttttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 49693 - DNA, 444 bp, Zea mays
  Clone ID: LIB3067-056-Q1-K1-G1
tcgcccacgcgtccgcactggcataatagaaggcttgatttggtcccctaaagcaagtgattcagatgatagacatgatgattgggctttcgaggagggaccacactctgactttactgggccaaattgtgggagtacagcatgtgtagcattagtcagaaataggcaactcgttgtggcaaatgctggtgactcccgctgcgtcatctcaaggaatggccaggcatacaatttgtcaagagaccataaaccagagcttgaggcagagagagaaaggatacaaagtgccgggggttacattaaaatggggcgtgtaaatggaagtttaaatttgtcaagagctattggagacatggagcttaaacaaaacaagttcttgtcccctggatagcaaattttgacccgaaaccctgacataaacattgtcgagctatgtgacgacga

SEQ ID NO: 49694 - DNA, 373 bp, Zea mays
  Clone ID: LIB3067-056-Q1-K1-G10
cccgacctcaggaagaaggtgatgcccgccgtcatcgtccgccagcgcaagccgtggcgccgcaaggacggggtctacatgtacttcgaagataatgctggagtgattgtgaatcccaagggtgagatgaaaggttccgctatcactggacctatcggcaaggagtgtgctgatctttggcctaggattgctagcgcagcaaacgctatcgtttgagagcttgttggaatatgttcagacttctatatgatcatcttattatcagttgctaagagggctattgggcttaatgggccctttatgtttgttcactcaattttgtagtaaacagaatttggtataccaaggggatctatatatcaatgtatgccat

SEQ ID NO: 49695 - DNA, 298 bp, Zea mays
  unsure at all n locations
  Clone ID: LIB3067-056-Q1-K1-G11
cggacgcgtgggcaaaatcctccgaaccccgccgccgacgagcgagctatggcgctggcgcggcggctgctccgagatctccttcctcgataactccgccccgccaccgccaccaccgcctcctaagccattcaccattgaggaccgcccgggcgagcagtgggcccgcctgcgccgcgtgttccctgcggccgagggggaggaagaggaggtcagggtggacgccacgttggtcgacggcgcgctccctccctcccgctcgggcgcggacacgggcggtnccgcccagatgcatatc

SEQ ID NO: 49696 - DNA, 255 bp, Zea mays
  Clone ID: LIB3067-056-Q1-K1-G12
cccactcgtccgcggactcgtggaaaaaaaaaaaaaaaaaaaaaaaaaaaaaaaaaaaagggaaaaggaaaaaaaaaaaaaaaaaaaaaaaaaaaaaaaaaaaaaaaaaaaaaaaaaaaaaaaaaaaaaaaaaaaaaaaaagaaagaaaaaaaaaaatataaaaaaaaaaaaaaaaagtacttgcgagccaataaatatatataaaatggcctaaatgcaaaaaaacagcccctggtaaaacaagggcacaacag

SEQ ID NO: 49697 - DNA, 403 bp, Zea mays
  unsure at all n locations
  Clone ID: LIB3067-056-Q1-K1-G2
cggacgcgtgggcggacgcgtgggcgcagaccaggaattaatcgagttactcccgttcgtggagagcctcgtggactcagaggacgtgaggccaataatttcgaaggccttccatgacaaacctgagtagaaatagttctagaggcatacggatgtatcattcagtgaacctctcgctgaagttagcttcgctccacacggtgcaggccattcttgggaagttaggtataggatcaagattcaccatttatgttatgttagctgttacaaatagcaagcataaactgcggtcgtcgatgaaaatggctngtgtgtgtatgtcttttcggtgttccgtgtcacagatcattgtacagaaacgaacaatagtgctgaataaagtgatctgagtgcaattttgctc

SEQ ID NO: 49698 - DNA, 382 bp, Zea mays
  Clone ID: LIB3067-056-Q1-K1-G3
cccacgcgtccggagagacagagagagagactgccaacgaggcgaagcagccggccaatggagcatccgcgcgcggggtctgagagcagagcggcagggcgccatggcggcgtcggtggcgctgagcagcgggcaccggatgccggcggtggggctgggcgtgtggcggatggagaaggcggacatccgcggcctcatccacacagcgctccgcgtcggctaccgccacctggactgcgccgctgactaccagaacgaagctgaagttggtgacgcgctcgcagaggcattccagaccggactcgtcaagcgggaggacctgttcatcacaaccaagctgtggaactcagaccatggccatgtgcttgaagcctgcaaggac

SEQ ID NO: 49699 - DNA, 335 bp, Zea mays
  unsure at all n locations
  Clone ID: LIB3067-056-Q1-K1-G4
gttgagtacaagaacattagcttcactgtctgggatgtcgggggtcaggacaagattagacctctttggaggcattacttccagaacacccagggtcttatctttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatncagagcacttgtgccacaacttgcgaaggtctgta

SEQ ID NO: 49700 - DNA, 256 bp, Zea mays
  Clone ID: LIB3067-056-Q1-K1-G5
cccacgcgttcgcccacgcgttcgcccacgcgtccgtctgaatataacgaggaagataagcgaggataaccagagtgtgctggtttattgcttctcatgggttgtaattttcgttgttttactcgttatgaagaccgtgtgcgtgctgatcctgggctggatcctgtttgactcggtcctcaccgtgaagaacatacttgggatgctgctcgccgtgatgggcatggtggtctacagctgggccgtggaagcggag

SEQ ID NO: 49701 - DNA, 408 bp, Zea mays
  unsure at all n locations
  Clone ID: LIB3067-056-Q1-K1-G6
ggcttgtagacgttccgaggaggaggggaggtacccgccgccgcagccatggcgtcgagcaaggtccagcgtattatgacccagcccatcaacctcatcttccggttcctacagagcaaagcgcgcatccagatctggctattcgagcagaaggacctccggattgagggtcgcattatcggattcgatgagtacatgaacttggtcctcgaagacgctgaggaaatcaacgtcaagaaaaacactaggaaatcactgggccggatactcctcaaaggtgacaatataactttgatgatgaacagtggcaagtgaagattcttatggcaagaacgatgtctggtgctcgcttcgattatctgggacacaatgtacttcattccatcgtncagacttaaatgatgtatc

SEQ ID NO: 49702 - DNA, 372 bp, Zea mays
  Clone ID: LIB3067-056-Q1-K1-G7
ggaatacaaagaggtccctgtaaatcttgggatagatgagccaaagaaagggagaaatgcatggaatggcatgaggtaccatcacatggatgcacaacaactcgcatctggtggatggattgctgtaatggatggtgatcgagtcccttcaggtgattcaaccagacgctctctcattggttacttagctttcctgttggccagtgcccttgtcgtttttgtgggttttatgaaaggtgcaatcagttgttacgttcctcccagattatgggttcctctcacaaggagaacagaattatcccgtatcttctacgtgcaccgcttcaaccagaaagtccgcagatattctaacagcatcagcagatatatctc

SEQ ID NO: 49703 - DNA, 422 bp, Zea mays
  Clone ID: LIB3067-056-Q1-K1-G8
cccacgcgtccgcaagaaaaaagatgatgaacttatgaagaggataaagcaggatcctgatactgagtatgctgtaatagaatgctacgatacattattagatatcctttacagcattattgttgtacaaagtgataagaaagttgttgatagaatacgtgaaagcatcaaagatagcatccaccggaaatcactcgtgaaagaattccgattggatgaacttcctcaactaagtgctaagtttgataagttgctaaatctactgaaggaatatgatgagaacgatcctgtaaatagaaacacacatattgccaatctgttgcaggatataatggaaatcatcacacatgatattatgaaaaatggaaaaggtattttggaagacgagggccaaaaacaacaactgtttgcaaaattaaatc

SEQ ID NO: 49704 - DNA, 426 bp, Zea mays
  Clone ID: LIB3067-056-Q1-K1-H1
attggtttttgcttcttctcttcctactgctgtttcagaaacctagacctttgagacaatgagacttggagagagccttatcaacatctagaaagtgcaagaaggctgcaagttcatgactgcagtcacccttgtgggttcggccgacagattcataagacgatcaagtacagaacgcgatccttgagatatctaagctgatgtctcgaatagttgagagcagccagtcagaaccccaagagccttcttcaccttaatctaatccttttgctagatcgcgtgaaaattctacagcggagtaaacgccagcattacgtcgatacccttaaggtttcttacgcagcttgcagagaggttcagcgtatatatatatatgcattaattcgttttgcttggccaaggcgcacccggtttttttgaacttac

SEQ ID NO: 49705 - DNA, 246 bp, Zea mays
  Clone ID: LIB3067-056-Q1-K1-H10
cggacgcgtgggttgaatttgaagcctatggctgccaatatcttgtggaataagatatgtgtgtaatctggttgtggagatccaaaaatccacgcagatggaaaaaaaaaaaaaaaaaaaaaaaaaaaaaaaaaaaaaaaaaaaaaacaaaaaaagaaaaaaaaaaaaaaaaaaagaaaatagagagagagaattatctggtacatgtacacatgagcaacataacttgtgtaaatgatgaattat

SEQ ID NO: 49706 - DNA, 336 bp, Zea mays
  unsure at all n locations
  Clone ID: LIB3067-056-Q1-K1-H11
cggacgcgtgggagcgaattcacagcagcaaacagtgtgaatcctgcaatctccaaacccaagcccggcggcgagatccgcgcggcaggcggacggggccgctcgaccgccttcgtgccgtgcgcgccttcccacctcttccgttctccgctccccgcgcccgcgaaggcgaattgctgaattgagggtggtggctcgtgcttgattttgattttgggggtcggtttcagttccaattcatgacggtgcggccggggtgggtggtgaaggtggcgcatggctcggcggnngngtggcagcgcgtggcgtgctacccggagacgctnccggctgacc

SEQ ID NO: 49707 - DNA, 411 bp, Zea mays
  unsure at all n locations
  Clone ID: LIB3067-056-Q1-K1-H12
cccacgcgtccgtccagatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgtaaaaaagagaaaaaagatgtgacatcctagaggaggaggcctttgccatgatgggtgcgctcgcatggcaggccaggcaataataaaaagatgattattgcgtgccgggggaggagatcgcacggnggttgatgtttttggccccgggttcttcttcctcatcttgttccgtgttcctgtatgcg

SEQ ID NO: 49708 - DNA, 224 bp, Zea mays
  Clone ID: LIB3067-056-Q1-K1-H2
cccacgcgtccggtctgaacactatttgctcatgtttctggaaaaaaaaaaaaaaaaaagaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgacaaatcaaactaaaacaaatgaacataaatcaaaactaaacaaaataaaatcttagaaaa

SEQ ID NO: 49709 - DNA, 362 bp, Zea mays
  Clone ID: LIB3067-056-Q1-K1-H3
gggagatcttgtgctttcaaacaagttggttgtctatgacttggaaaatcaagtcatcgggtggactgactataactgttcgtcgagcattaaaattaaggacgacaagacaggcacaacctatactgtcgaatcacatgacatatcctccggatggaaattccactggcacaagtccctggttctgttgttggtaacaatggtgtggagctatttatagtacgctaactctattgtacaacacgaacacgcacttaccgaaattcatttgattcgtattcttttcacaaaaaagaatatctagggttttaacttgtgttctctgaccacggaaaacgatgaaaacaaaaacgttgtgtgcc

SEQ ID NO: 49710 - DNA, 326 bp, Zea mays
  Clone ID: LIB3067-056-Q1-K1-F8
ccacgcctccgcccacgcttacgaggactcgtgggcagagatctttgtgggttgaaagatctaagccttgaaattaagtacgcacctgatcacttagagcaagcatactcactttaccattgtcccagaattataattattcacttcaactttctgcgtctgctgagtaaggatgtaccagtgttggagctgggtcattatgggatttgagctcacttggtttctgcgtgaatgtcaactgctgcagtttttttggtcactggatgactgctgctgctggctggtcaggtttgatatcgagaaatatccattgcattctgcgtttg

SEQ ID NO: 49711 - DNA, 378 bp, Zea mays
  Clone ID: LIB3067-056-Q1-K1-E12
aattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccaaggcatcgcctggtccttcggggcatgatcttcgccctcgtctact

SEQ ID NO: 49712 - DNA, 290 bp, Zea mays
  Clone ID: LIB3067-056-Q1-K1-E2
cacagttccacgcagcagatcagagagtctgcaggtacgctagcgatctagctgccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggcggtggaggatctggtggtggtggtggtggaagcggtgggggtgggagtggagggggtggatcgggtggtgggagtggaagcggaggatct

SEQ ID NO: 49713 - DNA, 421 bp, Zea mays
  Clone ID: LIB3067-056-Q1-K1-E3
atcaaaattatgtaatgaagagtagcacttattattgctacatgacgaaggttgagcatgcatggaggcgagattatagacagacaccctgattttacacgacgaatcgcaagaagcgcatgcattggatatccttagccggagagggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacatcgacggtcaggccacccccaatcccgtagggcttgtcggtcttgatcttcttct

SEQ ID NO: 49714 - DNA, 242 bp, Zea mays
  Clone ID: LIB3067-056-Q1-K1-E4
ccgacgcgtgcgccgacggctgacaccgatgttgacactgtggtggatgacgttgacgagggcactagggagaacgtcatctaagatggggactttcctatggagattagtatgagagcatgagatatatcatgtgggccgtactacggatgctaccattcatgctattattcaaattctagttctactactagctctactatcgtctatgctatcttgtagttaattgcgttgtcagttgc

SEQ ID NO: 49715 - DNA, 418 bp, Zea mays
  Clone ID: LIB3067-056-Q1-K1-E5
tcggggcttcaaataaccagagatgaggaaagcgtttcaacgcgaagcgagatggaaacccagactcggataagaattctaacaaggctcggaaggttgaagctatcgcatgaggttaatttaggtaccttagctcgactaaagaagtaacatgttatgccagcatgatcgacttcagtactctccaagtttctagaatcgacttgttttttagctatcggtttcattttggtcgatttgccaccttattcgatgatcgttccttagctataatgcttttgtaatggctttactgtgatgcgaaggctcacccgatggcgtgtaatttgagcacaccaagcttatgctttcctttcgaaaaggtgggagcctttctattcaaaaaaaattgggatgtagggcctgaattttttttttt

SEQ ID NO: 49716 - DNA, 374 bp, Zea mays
  Clone ID: LIB3067-056-Q1-K1-E6
gaccagcttaaacttgaagcaaaagaactgggaatgcccatggacgacaactcaggaaccgacccacaagcatcatgaggatttgagatacagaggtggcaaggaagaagctacgcttcatttgagtctgggagctggacgtttcattagccattgtgattacctgtcctgcaattgtcatatgggacagtctgtttgatattgaaaacaatgtggagtgtgcctagcaatcccatgacctgtgctcctgaaagcacctcgcagaggaagaatctaaattcgtgtattgttgtccgttgaagtgccctaacttgtggcaagagaaatgcagctgatgtatgcagactctccagttgacattgagttcttacctg

SEQ ID NO: 49717 - DNA, 365 bp, Zea mays
  unsure at all n locations
  Clone ID: LIB3067-056-Q1-K1-E7
cccacgcgtccgctagttctagatcggcaatccggcttcgcctcgtcgcagtccaatccggactcaccgccgccctcccgcccctcacctgcccgcggcagtgtcggagtaaaccctaccggacctatcgtcacgcgactgcgggagttgcttgcttcttctgccgctctctcgctccgtcccttccgcccatggagacctcgctgcgcttgcgcagtggcggcggcctccgcattcacgccaaggagaagctgcccctcggccacagctcgctgctgcaggctcatgcggagctcgacctncacacaagccccgccggagttactaccccgagttatctcgctctctttgtcaggcacttctac

SEQ ID NO: 49718 - DNA, 410 bp, Zea mays
  Clone ID: LIB3067-056-Q1-K1-E8
cccacgcgtccggacgcggtccggttcacacggcggcagcgggacgcgatcgctaagctgtggaactcgatcaaggagcagcagatccggcggaagcaaggcaagtcggtgagcgggaagctggacgtgaacgccttcgagtacctccaggagaagtactcccgcgagaagatgagcatccggcacagcgtgggcggcggcggcgatcgtcgcgcgacgcagtggctgggctaggccgtgcgtgtgtgtgatggtttgtgcctttggcttcatcagcgacacggcgtgggagttgtttgtgcttgggttttcgtagaggagaggagagagttgacatgatctttcccgtagcatgtgatgggtggctcttggtgtaacgttacgtactagctgcactgaactcggtgcat

SEQ ID NO: 49719 - DNA, 427 bp, Zea mays
  unsure at all n locations
  Clone ID: LIB3067-056-Q1-K1-E9
ctggaaaacctcaggagactacaattaatgcttctttcacaaatttagcaactactgcattaacagatttcgtcttccaggcagccgtgccaaagttcatccagttgcgtttggacccagctagcagcagcactcttcctgccagtggaaatgtgtcagtcacacaaagcctcagtgtcactaacaaccagcatgggcagaaaccacttgcaatgcgtatccggatgtcttacaaagtgaatggtgaagacaggctggagcaagggcaaatcagcaactttccttctgggttgtagtgccacctgtgtctatggngttggggttgctctttcagcgtgctacaggcaaggcgtttgtattcttgttcttgaacattttcacttctgcttgcctgctaatgagttgtgtacactggtagttgggtttg

SEQ ID NO: 49720 - DNA, 381 bp, Zea mays
  unsure at all n locations
  Clone ID: LIB3067-056-Q1-K1-F1
cgcatatgttggtatggcaggtgttgggttcctacagttctgcaacctgaacagcttccgaacaaagttcatcctgngattctctttgtttatgggtctgtcggtgccacagtatttcaacgaatacacttccgtcgcgggctttggtccagtgcacacgcgtgcaagatggttcaacgatatgatcaatgtggtgttctcctcgaaggcgcttgttggcggggcggtggcgtattttctggacaacaccctgcacaggcgcgatggcgtcgtgaggaaggaccggggccaccatttctgggacaggttcaggtccttcaagaccgacccgcgcagcgaggagttctactccctcccgttcaaccctaacaaattctttcc

SEQ ID NO: 49721 - DNA, 431 bp, Zea mays
  Clone ID: LIB3067-056-Q1-K1-F11
gaatcctccccctcctccacgcagacgcagctccctctcctctcagcccccacccatcgagccgctagcgccggcgcccggcggcggtatggaggctggtggcgaggagttcgcgatcggcgtggtgctctccgcgaagaccaccctgggggaggagttcgagggccagatcgtcgccttcgatcgacccttcaacctcctcgttatccaggagggcgtggggagggcggagagcggagagcggcggaacgtgagggtgctgaaggcgaactacatccgggagttctctgtgctcagcaagggagacgaccctctcgatcctgccgggtgcatgctggaccttaaactcatttatgcccgggaggatgctgcactcaggcaagcagagattgaagctgagaaaattggtgttggtgtcaccccataagctc

SEQ ID NO: 49722 - DNA, 286 bp, Zea mays
  Clone ID: LIB3067-056-Q1-K1-F12
gcaatctctaccaccaaatcctgttccgatccaaaccccttgcccctttgtacctgtccggttggcccgaccaaaccaaccggcaagaaattcaattgccggaaagcccccaaggaaccacttgcccacaaagcgcggccccaatgttgcccgggacaccggcagattaaaaaacccaccgttttcgccccggcaccgtctcgctccgggagatacgcaagtaccagaagagcacggagctgctgatccgcaagctgccgttccagcgcctggtgcgtgagatcgc

SEQ ID NO: 49723 - DNA, 423 bp, Zea mays
  Clone ID: LIB3067-056-Q1-K1-F2
attgcaaattctgaaacctgctgagagaaaaaacaaatttatggggtccaacaaaatgtgatagtgaaagccattttgcttccagcagctctagcctcttaaggttctcctgtggatgcatcgagacaacagcatgctggcgccaagtttgagggcagcattgggctactatcagagaaaccaaataatcccatacctaactgttcatctggaagttactcatcatgacaagtgcctgaaatttttcctctttcctgttaccttgtgtcagaacattatgtagctgtagatatattgattatggaaagatgaagttgccaaattggcctgaggagattcctttctccagccaggaaaaattctgaacatcaaggagtttctggttgcaagtttcactatttaaaagcaggtatgttgcttgtg

SEQ ID NO: 49724 - DNA, 441 bp, Zea mays
  Clone ID: LIB3067-056-Q1-K1-F3
attgactgttggagggttgcaccaggtatgaagaagctatacatctgttggacacatggggcccttttatgtgtttccctgtggacatgccttccatgcaaattgcttgattggacatgtgactcgttgcagtaaccaggtgcaagctgagagaatattggaccttcagaaacggcttagcttgatggacaggaaagcagcaaaagacaatggggcaagtgttaatggcgaacctattacgagcacaaccccagttgataagctgagatcacagttggatgatgctgtagcgagcgagtgccccttctgcggtgatttgatgatcaaggagatttcacagccgttcattcttccccaaaaatcggatgaaaaggcatcatgggaaatcaaacctcaaccaacgcctcaaaagattcttccgatgaccatgtctatttgatg

SEQ ID NO: 49725 - DNA, 373 bp, Zea mays
  Clone ID: LIB3067-056-Q1-K1-F4
cggacgcgtgggtcaacacagcacaggctgctcgagagagagagagagagaaagatgtggtggttcgggcaccaccaccacaaccagccggctcccccagcgtctggccccaaccaggtgttcaagatcttctgccgcgccaacgagaactactgcctggccgtccgcgacggcgccgtcgtgctggccccggtcaaccccaaggacgaccaccatcactggtacaaggacatgcgcttcagcacccggttcaaggacgaggaaggcatgccggcgttcgcgctcgtcaacaaggccacggggctcgcaatcaagcactctctcggtcagtcccacccggtcaagctcgagcctttcaacccggaccaagaag

SEQ ID NO: 49726 - DNA, 411 bp, Zea mays
  unsure at all n locations
  Clone ID: LIB3067-056-Q1-K1-F6
cccacgcgtccggttccaacgcatgctataaaaacagaaattcaagttcgtgctcaagacaaaggttgttgggtgtgataccagtggagatggcgtaaagctgacactggagcctgcagctggtggtgagcagaccatccttgaagcagatgttgttcttgtctctgctggcagaagcccatttacttctgggattgggcttgaaactcttggtgttgagacagacaaggctggcaggatccttgttgataagcgcttcatgaccaatgtgaagggagtctatgcaatcggngatgccatccctggtcccatgcttgcccataaagctgaagaggatggtgtcgcatgcgtagaattcattgcttgaaaagaaggccatgttgactatggcacaagttctggtgtggtcta

SEQ ID NO: 49727 - DNA, 233 bp, Zea mays
  Clone ID: LIB3067-056-Q1-K1-F7
ctttttctccttccgtttggaggagtccttcttctccttcctcttggtgcgggactcttgcgatgaagtgctcccgtggcttgtagtgggctattcacccccccccccccctctaggcgactatcaattggtatcaaagcccggtgcttcattagagcctaaccgctcgaagtgatgtcgggagatcacgccaagaaggagatggagaccggcgaaaaggttctagatcgcga

SEQ ID NO: 49728 - DNA, 407 bp, Zea mays
  Clone ID: LIB3067-056-Q1-K1-E11
cccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgtcgtcgtcatcgcgcgcgactcggccgccgtgttcgcctggaagggggagaccctcgaggagtactggtggtgcaccgagcgc

SEQ ID NO: 49729 - DNA, 356 bp, Zea mays
  Clone ID: LIB3067-056-Q1-K1-C7
cctctgtcaagggtgcaaaagttgtgactgataaattgacaatgcgcacaaagggttatggatttgtgaaatttggtgatcctacagagcaagctcgtgcaatgactgaaatgaatggaatgccttgttcttccaggcctatgcgtattggtcctgcagcaagtaggaaaaatacaggaggtgttgttcaagagagagtaccaaattctcaaggagctcagtctgagaatgatcctaacaataccactatatttgttggtgggcttgaccccaatgtcactgaagataccctaaaacaagttttttctccttacggtgaagtcgtccatgttaagatccctgttgggaagagatgt

SEQ ID NO: 49730 - DNA, 434 bp, Zea mays
  Clone ID: LIB3067-056-Q1-K1-C8
cttccccagcgcagcccctcccccctgtagcctgtatccgccccccacactctgcgtctgcagtcttctttctcgcgtcggcagtcagcttggcagggccgaaccaatggcggtcgacccgcggcaggtggtggcgggcttcctcaccctctccatgttcgtcatgctcggcaacatgatcaagcacgaccacttctctcccgtcgccgaggagctgggcttggaggcaacaggtgtggtgtcgaacacaaggaagcttgacaacaatgctgaaatgagcagcgtcgatacggctggagtggaagacctgatggacgctgtcgaggaagttaaaccttgctggaccaaaccaagttcaaaaaaaatcagccgtctaatggttttgttacattctccttgactatgggccctgagtatcacatctctcagatcac

SEQ ID NO: 49731 - DNA, 425 bp, Zea mays
  Clone ID: LIB3067-056-Q1-K1-C9
gactagttctagaagtattacaggataggaagtacgtgacagcaaaaagtcgagttctacaccctgagttccgtggtcgaatggtctcggcattccttttgcaccatttctctgaggttgctgattacagctttacagctaacatggagacagagctagataatgtctctgctgggctaactgaatggaagggtcttctaaaaggctactgggaacgattcagcaaatattgtgcagatgcgagtaatctggatggcagaaaggtagagagaatgctcgaagaaaaatttggtcctatcctcttccctaatgttgacacagacaatagaatttgccctagttgttctgaaggaaccttgagattcaaagttagtaggtatggtgaaggctattttataggctgtgatcgacatccaaaatgcaag

SEQ ID NO: 49732 - DNA, 293 bp, Zea mays
  unsure at all n locations
  Clone ID: LIB3067-056-Q1-K1-D1
ggatagaagtgattaagtgaagcgttcaatgttcagtgaagtggctgaaaacaccagacgaactgaactgataactacatgaccttcgaaggtcgtttattactgttgtctaagcgggcctgacatcttagtatattacacgagtaaaggaacaaaggagtgcgggaagtgggccagataagcaaacaattcttttgaatccatgtatcatcacgcagacatcttagacgctaggaccgagncttgcctcaaatgaaagccgatgaagaaaatggacaggaacagaccataat

SEQ ID NO: 49733 - DNA, 437 bp, Zea mays
  unsure at all n locations
  Clone ID: LIB3067-056-Q1-K1-D11
gaaggcgagaacgtactccgtccctcccctcccctcccctccccttcccctcgaggctcgaggaccgtctcctcgcctgctcatccgccgctgcttcccttctctgggctcggagaaccggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaaatttgggcctttgggataccgctgggcaggaagattacaaccgnctgaggcctctaagctaccgaggtgcagatgttttcgtgcttgcattctcacttgtgagccgagctagctatgaagatatcatg

SEQ ID NO: 49734 - DNA, 422 bp, Zea mays
  Clone ID: LIB3067-056-Q1-K1-D12
agatcgtccccgtcgacctcaccaccggcgcccacaagcagcccgacttcctcgccctcaaccctttcggccagatcccggctctcgtcgacggagacgaagtcctcttcgagtcccgtgcgatcaaccggtacatcgccagcaagtacgcgtcggagggcacggacctgctccccgcgacggcgtcggcggcgaagctggaggtgtggctggaggtggagtcgcaccacttccacccgaacgcgtcgccgctggtgttccagctgctcgtgaggccgctcctgggcggcgcccccgacgcggcggtggtggagaagcacgcggagcagctcgccaaggtgctcgacgtgtacgaggcgcacctggcccgcaacaagtacctcgccggggacgagttcacgctcgccgacgccaaccacgcg

SEQ ID NO: 49735 - DNA, 435 bp, Zea mays
  Clone ID: LIB3067-056-Q1-K1-D3
ggagactcggagtcgggggcgccagcgtctcgcctcgccgtcagcagcagcagcagctgcacctccattccacggcttccgtcgtgcgcttcgtctgcacccacaaaggcgacggcgacggcagggggaggagatgaagctgaagcagctggagggcctcttgggtggcctgacccagttctccgaccccaagctggagctggagcagtatgcgacgggccctcacatcgcgtcgcggatgctctacatgacatgttcttggtattgatattgacccacagtcacttgaacttgctcaagaaaatgctgctgatctggagctggacatcgatttagtttggtctgacataaagaacttaaatctgaaagggaagagcaagtgggaagttttgtccttagctgaccaaacaagttcggcaacatatacctcttttg

SEQ ID NO: 49736 - DNA, 342 bp, Zea mays
  unsure at all n locations
  Clone ID: LIB3067-056-Q1-K1-D4
cccacgcgtccgaacgaaacggtcaggtttaaaccagacacaacggacttcacaaggtaatacatgagttcaacagggcacaatggtcctcaaaagtccattcatacttgtgacttgactggttatttaggtgataacgatttggggtccggcacattcaccagtttggccagcttttagccttgcttctagcccatggcatacttctgtgtccaggagcgtgcggtggactcatacttggccctgtcggtcttgtacatgtgagcaatctcagggacaagaggatcatcanggtttgggtccgtgagcagtgaacagattgacagggagaccttttgagat

SEQ ID NO: 49737 - DNA, 348 bp, Zea mays
  Clone ID: LIB3067-056-Q1-K1-D5
cggacgcgtgggcggacgcgtgggcggactcgtgggttcgcgcggtggttggtacctggggaagacgaataattcccggctggggctcctccagtccactccacccatgcttttgtgtcaggcggagcggaggtagagcatagggagtgaataaccgctaccttatttcatttctatgatgtatctatctaatttggtccttccctgataatgcacgacccgtagtgttaaaaaaaaaaagaacatgaaattgaaatagaaattgacccaaagataattgaacattgcataagaaaatgctaattaaactggaacttgacataaaaattaaaaaagggggggcccctt

SEQ ID NO: 49738 - DNA, 380 bp, Zea mays
  Clone ID: LIB3067-056-Q1-K1-D7
cttatttttggtaaaaggtctcatagttctgttggaaagctcagcaaatctgcttcattgggttcagtggaagaaatattcgaggagggatctgcaatgttggaagaaaggttgggaagtaattttccaccaaaagcaaatctgcctccatttcgctgtgcaatctgccaagtggaccaagagccattcgaaggtttaatgacggacaatgtaggtggctgctgctcaaccccatcaacaccatggggtggtccttatctttgctcacgctgtaagaaaaagaaggacgcgatggaaggtaaacgatcgaatcgttcaacgacgtgcaagtgaaagttctgataggaatcactgggactgggtcctgtgatcctgtcatg

SEQ ID NO: 49739 - DNA, 314 bp, Zea mays
  Clone ID: LIB3067-056-Q1-K1-D8
cgcgccgccgcaccctgctcaaggtcatcatcctcggcgatagtggggttgggaagacggccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaaggtttcagagtctcggcgttgcattctaccggggagcagattgttgtgtcctagtctatgatgttaattctatgaaatcatttgacaacctgaataactggcaagaagagtttcta

SEQ ID NO: 49740 - DNA, 434 bp, Zea mays
  unsure at all n locations
  Clone ID: LIB3067-056-Q1-K1-D9
actagttctagatcgccgcctgctctctacctctgcactccaatcagatcatcagatagagcactggccccgtgctgattaccgcgcttcccatctgagcagccagcctcccaggctacagggagagacgcagaggagacagctgctgcctggctgagacgatggccggaggcggcgaccactcccagacgaacggaggccacgtcgaccagagggccttggaggagggcaggaaggaggagttcgctgaccagggctgcgccgccatggtcgtctccgtcccatttatccagaagatcatcgcggagatcttcggcacctacttcctgatgttcgcggggtgcggcgcggtgacgatcaacgcgagcaagaacgggcagatcacgttcccgggcgtggcgatcgtgtgggggctagcngtgatggtgatggtg

SEQ ID NO: 49741 - DNA, 354 bp, Zea mays
  Clone ID: LIB3067-056-Q1-K1-E1
ctctaggaaggcaaaaaagagagcctttttcatcttggtttgctaaaccagtttaatgatgaggttttggacttaccatgctttctgatacatgtaattccaattgagaatcatgatccgacaaattccttcgcattccatgcaccaccttcatgttccccacatcaaaatctgggtgaaattccgagatccatcacatatcagtacataatatgatgatcccacagctggagattagacagagatctttcgaagatgctagctgcaagctccaactgctatgatatggacaatgccaaagggacaaataaaatgcaacacgaaggaaaagatgaacagtactgggtacacccc

SEQ ID NO: 49742 - DNA, 424 bp, Zea mays
  Clone ID: LIB3067-056-Q1-K1-E10
agaatatggctcgcttaagcacgaacagtcaactaacagttctgttgccccaatggtgcggggtccaccaccccagatgacagctagtgttccggtctccttcccagatcacaccactacttttcacaacataaactctacactgccgcctccacctgttctgaatcgtctgcctcctccagctattccttcagcagttaccatcaatccaccagcaagttcaagtcaagcaattagctttccaactggccgaaccagcggcttgaactattaccagaccctgatccatcagcatggaggggagaggcatgagccacagccacttcaacagcatggaatgcactttccaatgcatcatcgcactgtcgcttcccagtctagcgccactgatattgtcagcagtggtactatgccagctagggat

SEQ ID NO: 49743 - DNA, 299 bp, Zea mays
  Clone ID: LIB3067-056-Q1-K1-C5
aggagggccttcttcctgggtttcagccagtccccagtggagttcatcaatgctctgatagcttctcagagcaaagatttaaagctggttgctggcgaggcgaataggaacattgagaaagaaagacgtgccgacttctataaccaaccatgggttgaagacgccgttataagatacttgaaccgcaaaccggctaacgagggcctaggtggtggtgctggtggttcttgaagcgtggatttctcctagctattttagtgtataaacaaattatctgttctgtattggcagtaaatttc

SEQ ID NO: 49744 - DNA, 395 bp, Zea mays
  unsure at all n locations
  Clone ID: LIB3067-055-Q1-K1-B7
cccacgactccaccgcgaccgggagagggtcagagggagacgcccgcctccagatcggccggcggggatgacggcgtcggtctttccagcgctgctgctggccgtagcggcggtgcttctcctaccggcggcagaggccgtgtggctcgagctcccgccgtcggggaccaagtgcgtctccgaggagatccagcccaacgtcgtagtgctcgccgactacgctatcatgtacgagtcccaccccagctcgcatcccaccgtcgccgtcaaggttacatcaccctatggcaatactgtgcatcataatgaaaatgctacaacgggccagttngcattcaccacttcagaagctggaaactaccttgcatgtttctggatagacagcgtggagaaag

SEQ ID NO: 49745 - DNA, 394 bp, Zea mays
  unsure at all n locations
  Clone ID: LIB3067-055-Q1-K1-B8
cccacgcgtncgctggaagaccggcaaggggctcggcaagaacgagcaaggtatactggagccaataagagctgacatgagagatgcaaaattaggtgttgggaagcaagaggaagatgacttcttcacatctgaagagaatgtgcaacgaaagaaattgaatattgaacttgaggagactgaggaacatataaagaaacgggaggtatgcaatctaacacctggtgctagtttctctacattcatgcagttttttccctgggctgatgcttgacatgctggaacctagatataatagttgtaagacctctataggctagaagtagctgtactttcgtgatgtgaggatagctagcatcaaccattaaagagtcttcagcattttgtgcgcttt

SEQ ID NO: 49746 - DNA, 340 bp, Zea mays
  unsure at all n locations
  Clone ID: LIB3067-055-Q1-K1-B9
tcggtcaagccacccaagtcagggcagctttatcctttgcattctgcttcaacttgcattccgaattagttcaaaagattgaaagggaaaaaagaatttcttcttattaagcaacgaattgtgaaaatccaagctcatgtgcgaagtcaacaagtgaagaagcattatcggaaaatagtttggtctgttggcatcgtggagaaagttatattgcgttggaggcgtagaggggctggcttacgtgggtttcggtctacagaaagttcagtggagagcagcaatggcggaacgagtagcagttcaatccaagataaagcctctgnggatgattatgattttc

SEQ ID NO: 49747 - DNA, 295 bp, Zea mays
  Clone ID: LIB3067-055-Q1-K1-C1
gtctccaccaggtgctccggtgggctactggatcagtggagatcttcttctcccgagcaacgcgctgctggcgagccgcagaatgaagttcttgcagaggatcgcgtacctgaacgtgggtatctacccgttcacgtccatcttcctgatcgtctactgcttcctgccggcgctgtcgctgttctcggggcagttcatcgtgaagacgctgaacgtgacgttcctgacgtacctgctggtgatcacgctgacgctgtgcctgctggcggtgctggagatcaagtggtcggggatc

SEQ ID NO: 49748 - DNA, 292 bp, Zea mays
  Clone ID: LIB3067-055-Q1-K1-C10
aatccccgctcgacccacgccttcgaccacacatacgcttatcctgataaactaaacgcacataacacataccaaaaaaacttgcaaattttaaaccaatctatcccctccacacttccaaccccatctttccccctcatctctctactccaacgttccttacctacaattcaaagccctgtcttactatagatcaaccctgaaaaaaatctacctttcccaaacataattctcatcctagacaaacaccttcatccacctctattaaaagcgataaaaaccactcctattt

SEQ ID NO: 49749 - DNA, 288 bp, Zea mays
  unsure at all n locations
  Clone ID: LIB3067-055-Q1-K1-C12
tgccttaagccaagctggcgcangcccaagggtattgactcccgcgtcaggcgtaagttcaagggatgcaccttgatgcccaacatcggatatggctccgacaagaagaccaggcactaccttcccaacaagttcaaaaagtttgttgttcacaatgtctccgagctggagctgctgctgatgcacaacaggacttactgcgctgagattgcccacaacgtgtccacccgcaagcgcaaggagattgtcgagcgtgctgcgcaacttgacatcgtggtcaccaacaag

SEQ ID NO: 49750 - DNA, 385 bp, Zea mays
  Clone ID: LIB3067-055-Q1-K1-C2
gcgacccgtccgcagcgcccgatcattttaacggaaactgccaaaatctagtgccaggcgattgattgactatggtagtgcaccataccatcaccaggattgcatactcactgtgtgtaccacacactattgcgccattgaagacatttagggacatcgatcgatatatacatgtgatatctggagtgctgcttgcatacttgttgagctttgctcgtgtgatacactgcatcatactcacgataccttggaacagcttgcactgatggatataggtctaggtcctcttccactgtacatgctggaaagagccgaccaacatgcggcgaagtacgtaagaataggaggattgaactggccgccagcaataacaacagtagagagc

SEQ ID NO: 49751 - DNA, 351 bp, Zea mays
  Clone ID: LIB3067-055-Q1-K1-C3
gcatgttgtctctcgctctcgctctcatcaaaatgaagggtacgacataccgcggggggggaaaatcctgccggttctagcggcggtgcacctggactcgtcgctgtacgaggatcccagccggttcaacccttggagatggaagagcaacaacgcgccaagcagcttcatgccgtacggcggcgggccgcggctgtgcgccgggtcggagctggccaagctggagatggccatcttcctgcaccacctggtgctcaacttccggtgggagctggcggagccggaccaggccttcgtctaccctttcgtcgacttccccaagggcctcccgatcagggtccagcgggtcgc

SEQ ID NO: 49752 - DNA, 350 bp, Zea mays
  Clone ID: LIB3067-055-Q1-K1-C4
cggcgcgtgggcttagctggtgaagataaaagctggccttgctgatcatatgcacaggcaaagactgatgggatccttggacttaacagtgcggcgataagctttcccagtcagcttgctagtcacgggattattgccaacgtttttggccattgtatcactaaagagcaaggtggtggaggatatatgtttctgggagatgattatgtacctagatggggagtaacatggacttctattcgaagtggtccagataacttatatcacacacaagcccaccatgtaaaatatggggatcagcaactccggaggcctgaacaggcaggaagcactgttcaagtaatttttga

SEQ ID NO: 49753 - DNA, 328 bp, Zea mays
  Clone ID: LIB3067-055-Q1-K1-C5
gggaatcatccaacaacgccttattttttaagctgcccttttccatctctacaattcgtctataactgctgctggttggctcctaattgaacctaatatcgcctgcaattgcttccgtccaaggaaatcgaagcaggagattataaatttcctcacgcctctcgactatacctgccactcttagctttagttcggtaatggtacatgtaggactgcgtcggtacacttcgactggtcgattaattttatttaataaatgtggcgcatggatcggacagtgtgtaactcagaatatggagcatgcaattgccgtgtatggtttctagac

SEQ ID NO: 49754 - DNA, 363 bp, Zea mays
  Clone ID: LIB3067-055-Q1-K1-C6
attatggctagtatctgttatctgcgatgtctggtttgccttgtcttggcttctaggtcagttcccaaaatggtatccaatcaaccgtgagacatatcttgacaggcttgcattgaggtatgatagagagggagagccatcacagctggctcccattgatgtcttcgtcagtacagtggatccattgaaggaacctccactgatcacagccaacactgttttgtccattctttctgtggattaccctgttgacaaagtgtcatgctatgtttctgatgatggttcagctatgctgacttttgagtctctctcagaaaccgcagaatttgctagaaagtgggttcccttttgtaagaagcacaa

SEQ ID NO: 49755 - DNA, 309 bp, Zea mays
  Clone ID: LIB3067-055-Q1-K1-C7
gctacccgatcccaaggacggatcattttaaaggaaactgccaaaatcaagtgccgtgcgattgattgactttggtagtgcagcataccatcaccaggatcgcagtttcattgtgtgtaccacacactattgcgcccttgaagatatttagggacatggatggagctatacatgtgatatctggagtgctgggtgcatactcgttgagctttgctcgggcgagacactgcatcatactcacgataacttggcacaccttgcaatgatggatagaggtctaggtcctcttgcactgtacatgctggaaag

SEQ ID NO: 49756 - DNA, 309 bp, Zea mays
  unsure at all n locations
  Clone ID: LIB3067-055-Q1-K1-C8
acaacctcgccggcgccgngcgcgccccgncttcaccccgcgcggcgccggcaaatttctagggttcgtgtccaaacagccagttcacccgttccttatcttccgtcgttcagctggcgtcctctctctctcttgtggcgacgactgggtgacctccccgcccccgccgctctacgccaggtgcccaggtcttcctcgggcccttcgccgaagagcagccaacaggtaagcatggctcagaaaatggcaactgttgagcgagtagaagagcttctcgagaagctgcgtgctgcttcctgggatcatgct

SEQ ID NO: 49757 - DNA, 365 bp, Zea mays
  Clone ID: LIB3067-055-Q1-K1-C9
gcggcaagtcgctcgcgccggtcccgcttgggtggttctactcccacgcccctcgaggggctcagtgctacgagaaccccaagcacaagggcaccgctgtccccgccgacgaagaagagatctgcggtgccactttcaaggtggtggaagggtctactgtcctgacggcgctgcactgatctatcatcatcaggcggaggcgatgcgatgatgatgcagaactttgtacatgcgttggtggatggtggtgtaacatagtggctgccaacaagtcatgctcatgcaaaccgatgaatctatctctgtatcatcgatctcggttgcttgctagtccagactccagacatggctatatatatatagct

SEQ ID NO: 49758 - DNA, 191 bp, Zea mays
  Clone ID: LIB3067-055-Q1-K1-D1
cccacgcgtccgcttccatccaagattcatgtcggtgtcttctcagctaccatgccgggggaggcccttgagatcacgcgcaagttcatgaacaaacctgtgaggattctcgtcaagagagatgagctcacccttgagggtatcaagcaattctatgtcaatatcgacaaggaagattggaagctcgacac

SEQ ID NO: 49759 - DNA, 400 bp, Zea mays
  unsure at all n locations
  Clone ID: LIB3067-055-Q1-K1-D10
gtttttaagagagatgtttcgttagatcttctaaagtcacggtatgctgaactgcatgactttggttctgaaattctgcccaaggctttgcatgagcacaatgtacaggcatatgttttcactgactactgggaggacattggaacaatcagatctttctttgatgcaaacatggccctctgcgagcagcctccaaagttcgagttttacgatccgaaaacaccattcttcacttcccctcggtacttgccaccaacgaagtcggataagtgcaggattaaagacgcgatcatttcacacggctgcttcttgcgtgagtgtgccatcgagcactctatntgtggtgttcgctcacgcctaaactctggatgcgagctcaagaataccatgatgatgggtg

SEQ ID NO: 49760 - DNA, 321 bp, Zea mays
  Clone ID: LIB3067-055-Q1-K1-D11
gtgcaagtggcgcaacggccatgttctatatgtaaaattcgtcctctaatacagagttgtcgtattgtatgttagtgtaggatgcgctgctcgcattgcactgttattgtgcttctgtttggtggaaataaagattggtcgaaatctgagggccaaatcaaaaaataaaaatataaacataatggaagaagacacaatatctcgagtataacgatacaaaatacaagataattcagttccggtaaacagctatgcctccattgaacctaaataagtcttgatgggggggcgccctctttaaagaccccaggttacctgccc

SEQ ID NO: 49761 - DNA, 364 bp, Zea mays
  Clone ID: LIB3067-055-Q1-K1-B6
cccacgcgtccgcagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtccgcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatga

SEQ ID NO: 49762 - DNA, 332 bp, Zea mays
  unsure at all n locations
  Clone ID: LIB3067-055-Q1-K1-D12
cccacgcgtccgcggacgcgtncgcccactgcgtncgcccacgcagtccgccacgcgtgcggacaaggagattgcttggtgggaggagtatgcgaggagaggtctcgaacatggagaaccttgctctgctttggggcatcatcggcccgggcgtgtacgagtccatctaccgtgccggatggcggctctggggggacgcggtcgattgcagctgcgtccatgtcttcttactccactaccttccagggatctgcgcttcgctggcggcgctcatgttcaattgcgtgtacaaggatcagatcggatatcactattacgcaccctacgtggac

SEQ ID NO: 49763 - DNA, 367 bp, Zea mays
  Clone ID: LIB3067-054-Q1-K1-H9
atgtaaacgaagccggggaacagtcgacggctaaggcccaaaaggcaggcagccatcacgatggctcttgcccacctccccttcgtcctcctcttggtgtcgtccgtcgccgctttcgccgccgccgaccacggcctcacgcacatccacctgtacgtgcacgagacgtacaccggggcgaacgccacggccgccgccgtgctgcagtccccgctgggcgcctactcgtcgttcgggagcatgggcgtggtggacgacgagatacgcgtgggcccggaccggtcgtcgcatctcgtcggccggtaccagggcgtattcttcggcacgagcgtgcatcttggcgccggcttcctgtcgtccatcacgc

SEQ ID NO: 49764 - DNA, 359 bp, Zea mays
  Clone ID: LIB3067-055-Q1-K1-A10
cacaaatggttagagggacctccagtttgtggaaaaaaaggaacggatatactgcgaggactgcaggacatctattgttgacttccacagaacctgcaataaatgtaactatgatctctgtctccagtgctgccaggagcttcgtcgaggccttgtttctggtaatgatgccaaggttgatggtggaggcaagcaagattttctatcgggagttagtcatgataaaatcataagcgaagggccatccgatggacagaatgacatgttgatagatagcgtagttcctggtgaaaacaacacttctagcttgagacagtggagtgtgaataaaagatgaaccataccttgcccaccaaatg

SEQ ID NO: 49765 - DNA, 374 bp, Zea mays
  Clone ID: LIB3067-055-Q1-K1-A11
gaaccctgcagagttattagaatgccacttcacagggttgaaggctctggagaatgagtatggttctggtgaaactgttaagcagggaacagaaatagttcagagagctgtcaccaaatcattccagtccctacatgaagcatacaaaggaaaaattgttgggctggtaatatccacaaatgaggctccatcatccttaggatccataattgacgcaccatcttcactgcacatttcaagacggctagaagaagcaagcaagactacagatatagcctccgtggtactcgttcggaagagcttggcatggattacagggatcatcctgcttgtttcaactctcataggggtttgcttgcttatgaacatgccac

SEQ ID NO: 49766 - DNA, 293 bp, Zea mays
  Clone ID: LIB3067-055-Q1-K1-A12
ccggttcggaatattcccggtgtcgaccacaccgtccgcgctacgcatgcgcgtgctgcgctcttgttcgtgactcgctcggtcggcggaagaaggggcgcatcgatctgggcgctgctagctgcgagagcccaatatgcatccgaccatacaatcgactgaccgctctctctcggcagcgtctgaatctgcactcgggcgaccactcctctggcgtcaagtcactgcaccctatcggcctgcgtcgcatatttaactaaacgcctgcgcccataccaaacggagatctattg

SEQ ID NO: 49767 - DNA, 242 bp, Zea mays
  unsure at all n locations
  Clone ID: LIB3067-055-Q1-K1-A2
nccacgcttttttataagcgancgattattagcccaagtgcgaaagcaatatgtgagggtgacaagaaaggcgctaaaggtgttaccctcagactccttaaccaggcacataacctcaacagaaatggagaactttatcttcataagtgcccaaatgttggagtcagactcatagatggcaccagcttagctgatgcagtatttgtgaatagtgttcctcaaggcacagatcaagttgttct

SEQ ID NO: 49768 - DNA, 317 bp, Zea mays
  unsure at all n locations
  Clone ID: LIB3067-055-Q1-K1-A3
cgtagncattgagcccgaaggaggaggttctgcgccccggaaaaaaagcagcagcagcggcatgaaaggccacacgactcgccgccgcaacaggatcttcttagtatctagaagcgcagctgcgagagttggtcgtactgatggtacttggtagcatccctgcctgccctgttctttgagtgaagcgttggaacgtggcgtgtgtgtagtgtaactgtgtatgcaggcggtgatttatatgcatgcttcctttaagtagattgccagtagtatctgcgtatggtgagctggtcngtccttaatgtctgtccccatgt

SEQ ID NO: 49769 - DNA, 323 bp, Zea mays
  Clone ID: LIB3067-055-Q1-K1-A5
gagccctggtgagaggtcacaatgccacttcacagggttgaaggctctggagaatgagtatggttctggtgaaactgttaagcagggaacagaaatagttcagagagctgtcaccaaatcattccagtccctacatgaagcatacaaaggaaaaattgttgggctggtaatatccacaaatgaggctccatcatccttaggatccataattgacgcaccatcttcactgcacatttcaagacggctagaagacgcaagcaagactacagatatagcctacgtggtactcgttcggaagagctttgcatggattacagggatca

SEQ ID NO: 49770 - DNA, 398 bp, Zea mays
  Clone ID: LIB3067-055-Q1-K1-A6
gagaccgaaagcactgctgcaagctctatcgacactcgctagagcggcggaagaagggattccatcgagcggaacggtgctacctgcaacagaacaatatgactcggaccttaaaaaatcataccagtccctacatgaagcatacagaatgaaaaatgggtcgactcgcaatatccacaaatgaggctccatcatccttaggatccataattgacgcaccatcttcactgcacatttcaagaccgctagaagaagcaagcacgactacagatatagcctccgcggtactcgttccgaagagcttgacatggattacatggatcatcctgcttggtcaactctcatagagggttgcttgctaatgaacatgccacatacccaggacaccctcctgtact

SEQ ID NO: 49771 - DNA, 262 bp, Zea mays
  Clone ID: LIB3067-055-Q1-K1-A7
cccacgcgtccgcccacgcgtccgcccacgcgtccgcccacgcgtccgcccacgcgtggcgatttgaagaggcagatggacagtgccctgcatgatgcctccgtgtttaggcttattatggacttgctcaaagttgttctgaataagtgccaggaaataaggcctctatcttatttaggcctctatcttcggggtagctgactaagtgttgttattgctacggaatccagaattctgtgaattgaaatgaattgtaccgatg

SEQ ID NO: 49772 - DNA, 385 bp, Zea mays
  Clone ID: LIB3067-055-Q1-K1-A8
cggacgcgtgggcggacgcgtgggtctatgtcatgaaagctccatcacaggcgtctgcgaccacaaaggctgaagcaagacccgtggtcacaaggccaaagatctcaaactcgaaacctaaggcttcaagggcgaaggttgcgcgagcgcaagaaaccccagctgaagcccctccttcagaacctgctgctccagaagatttcacggttgaacatggcattggagacgccacatgtcctgatctgaccgcgcaattggttgcttcgaacgaagtcccagtccatggttgatcagctgagcattttgcatatttattcccttcttgcagttctgtgaatagcgagggtgtgtgcttcattggaagttgaatcgctcgaagtgtcat

SEQ ID NO: 49773 - DNA, 427 bp, Zea mays
  Clone ID: LIB3067-055-Q1-K1-A9
aagaaataatagtaacgtggtcccgggcatctagcattctacccgcaatggttggggatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaaatttataggattcaaataatcaaataaagtaaaggtaggcgggtaataaccttatttatgacaagtttcaaattggtaaagtatacccctaggataaagaagaagaaggggctgagaaaactcgcaagaaaagttccaaccgatcgtctacttaaattcgaacgggttttcaaagcacaaaaacgcata

SEQ ID NO: 49774 - DNA, 356 bp, Zea mays
  unsure at all n locations
  Clone ID: LIB3067-055-Q1-K1-B1
ggccacgcgnttcgccacgcgttcggccattcgttcggccacgcgttcggccacgcctggggaggaaaccattaaaggtcaagttgaaggtcttggtttcaacaattcattccttgatccttgtgggtttccttctttagattgtgggtttcactgtcttccatccaagaaacactgtacaaatcacctaaacaggtaatgtactcaggagggggtgatgaaaacaagaacctcaaactcaaataagtacaaagagggttctcatgttatggagtatggtgataagaccttcaaggatgagaagctntccttttatcaaggttttgatcctgctaatgccaacattgcaaacatgc

SEQ ID NO: 49775 - DNA, 401 bp, Zea mays
  unsure at all n locations
  Clone ID: LIB3067-055-Q1-K1-B11
cccacgcgtncgctcccctgctccgccacctactcggataccgaccaccccacccnggcgccagacaacaggttgatggaggctaagatgggacgcttcttcgagtccgtgagcaatttcttcaccggaggcgaccacatcccctggtgcgaccgcgacctcatcgccggctgtgaaggagagcttgtcaatgctgtaaatgaggaacaaaggaatgaaagccttatgaggttgtcatgggcccttgtgcactccaggcagacagacgatgtaaaccgtggaatcagcatgcttcaagcttctttggataattctgccagtcctctgcagactagggaaaagctgtacttgttggctgttggattctacaggattggcgactactcaaaaagcaggcaact

SEQ ID NO: 49776 - DNA, 403 bp, Zea mays
  unsure at all n locations
  Clone ID: LIB3067-055-Q1-K1-B12
gtgcaaggcangaatgtgctcacaaacttctggggcatgaattttaccaccgataagggcagatctctagtaaagaagtggcagacattgattgaagcccatgttgatgtcaagacaaccgacaactacatgctgcgtttgttctgcattggttttaccaagaggcgcccaaaccaggtcaagagaacctgctatgctcaggcatcccagattcggcagattcgccgcaagatggttgagattatgatcaaccagtcttctacatgtgaccttaaagaacttgtttctaagttcattccggaagttattggcaaagagattgagaagtctacctccagcatcttcccactgcanaacgtcttcatccgcaaggtgaagatactcaaagcccccaagtttgatc

SEQ ID NO: 49777 - DNA, 400 bp, Zea mays
  Clone ID: LIB3067-054-Q1-K1-H8
cccacgcgtccggcttgacgggcgcgggcctcgtcgaccagatgggcaacttgttctgcaagacgctgctgttcgccgccgtcgcaggcgtgctgctggtcaggaaaaacgaggacgtcgagtcgctgaagaagctcgtcgacgagaccacgttctatgacaggcagtggcaggcgacctggcaagatgactccgctgggggaccaaacaactagttcagcgttgtggtacaaaaaaaatgcaaaacgctttcttgttacgtagcttatctatttcctcggccttcttgttttccctgtgtagtgagatctttttttttttttgtttttgacaaacgcaatgatctacgtcatgttgtaaaattgtatggaaaataattctgcagtttcagttttttttt

SEQ ID NO: 49778 - DNA, 158 bp, Zea mays
  Clone ID: LIB3067-055-Q1-K1-B2
aacaaatctacagctaaagcaggactatttcgtgtttagtcctggggctctcagagggaaatttgctaagatatgccggtgttgtgttacatgttttcgtgataggtctggttaaaattttgttctgttttacggcttgcgggtttcttgttggtgcc

SEQ ID NO: 49779 - DNA, 166 bp, Zea mays
  Clone ID: LIB3067-055-Q1-K1-B3
ggcatgatcacatgatcaggatcgtgtagtgctggccaggggacggcgcctttgtgagttgtgagagctcgtactgtgtctgtgtgactgtgtctgtggccgtatgagcatttagccctggatctgtgtttgttactctgtcttcttcgggaacatcgattatctc

SEQ ID NO: 49780 - DNA, 140 bp, Zea mays
  Clone ID: LIB3067-055-Q1-K1-B4
gcggcctacgccacctccccctcaccttccgccgtgcgccccgatccctcgccgcgagctcatctcgccgaggactggatcgccggagcccggaaggacatcgtgggtgtgtgtgtgtccttcgcacccatgcggggtta

SEQ ID NO: 49781 - DNA, 377 bp, Zea mays
  unsure at all n locations
  Clone ID: LIB3067-055-Q1-K1-B5
gagatcgtccgcaagtgcctcgcccgcactgaccagcagtgttcgtttgtggagcgggggaactacaaggtcgtttacaggcgctacgcctcccttttcttcctcgtcggcgtcgacagcgatgagaatgagttagctatccttgaattcatacatcttctggtggaaactatggatcgccacttcggcaatgtgtgcgagctcgatatcatgttccatctggagaaagtgcacttcatgttggaagagatggtgatgaatggttgcattgtggagacaagtaaacagaacatcttggcaccaatacaacttatggagaaaacttnctaaaatagtgatatccatttgtgtagttntacatccacttcttagcacat

SEQ ID NO: 49782 - DNA, 440 bp, Zea mays
  unsure at all n locations
  Clone ID: LIB3067-054-Q1-K1-G2
cccacgcgtccgcggacgcgtgggttgtggatgaagaggaacagtctggtaaatctgagtgctaatgaatctttgaactagctcataatatccttgattgtggatgaagaggaacatcacgcatccttgttctagtctatgtttggttaacacgcccaacagcagctctagggagatttctaccccttagatgctcagtttcaccaactagtttatcaacaacccctcagaatttttatcaacaacaattagtcggttgaactcctatttggacgattaatcaccgtttaatcgtggttagtgttacgatcagagttctagttgccctagtcgcgtcgtgcaccctaactgatcttgcaatggcgataaggccgactaattgcgactaatcgtgattagtcggacgactncaaaacatggctaggcacatgtatttgcaa

SEQ ID NO: 49783 - DNA, 272 bp, Zea mays
  Clone ID: LIB3067-054-Q1-K1-G3
ttcccggtctacccactcgtcctcttctcgtgtgctgactctttggtccaaaaaaaatacaaacaataaaaaaaaaaaaaaggaaaaaaaataaaaaaaaaaaattcaaattaatataatttattacaatattatacaacattacatatcactttattaactcatctatatttacatctaattccacttcttttacccacttttttactactaatacccttcctaatcccaactctttctcaatttaatacattttcctttctttacctttc

SEQ ID NO: 49784 - DNA, 330 bp, Zea mays
  Clone ID: LIB3067-054-Q1-K1-G4
gaaatgatcgattcgaagaataagcaaccgtcccgagtttgtctaaagagacccaacagcactatacgagtgacaccggttgaaaaaatatacaggggaaagcaaaagaatgctggcatgagataattggttgtgaattgcagcacaccgattgcagactcattcaacttccccatgttcctccttcacagcatttcctgagacctgcggacacattgcctaaccttcttcttgaactcattccgcttctctctccaatccttggcagcttcaatatttgctggagactcgtcattcggactagagagcattgaaatgatgctcagaact

SEQ ID NO: 49785 - DNA, 244 bp, Zea mays
  Clone ID: LIB3067-054-Q1-K1-G5
cccacgcgtccgcccacgcgtccgaaagatatcttaccctcagcaagttgctgttgcatgcactggaatcatttggtcaaggtacagcttggttatcacaccgaaaaactggaaccttttcagtgttaacgttgcaatggcgggtacaggcctgtatcagctttcacggaagattaggcaagattacttgtctggtgagaaggatgctgctccacaactgcaagaatagataatgacaacacac

SEQ ID NO: 49786 - DNA, 436 bp, Zea mays
  unsure at all n locations
  Clone ID: LIB3067-054-Q1-K1-G6
caaatattttgcacgaccagaaaagttttatacttatccttgcagcgtttcaagatctgggttcttgcagatcctggaatgttgagtaaaacgttgtcttgtttggacagctgcagttttcagcggaataaataactataaccgtgttactgctagacacaaagccttctctgaacaaagcttgcacacatgttattagttcagctagcagcaatttcagtcagctatatagcgcgcctcattggttgactgaagtggtgaatgtctatgctcaggacccaaattaaaggcgatgcaacttcttgctgcgatgtcagctagccggatcagtttctggaggacattatattataatataatatgaagaatacatattatngtatatgtcatgggtatatttcatcttcagatgcttgtcctattatcttttattcat

SEQ ID NO: 49787 - DNA, 417 bp, Zea mays
  Clone ID: LIB3067-054-Q1-K1-G7
cccacgcgtccggatactttcagttggttgtgaactataagctttgcgtcccgcggcgtggaaggaaatccacattacaatggtagtggcattttatagatttatagattggcataccactattcaatggtagtggtgaattatctagaagcaacaaagcaacagatttaaaatgccagttatagagttaggcttagttttagttaaaatattagtggtgaattatctaggcatacatccagtccacaccctcaacataccgagttaggctcagttttagttaaacaacgtcttggtttcttgtgcctactgatggcttttcttaatattatatcaatgacatcttaggttttggaaggtggtgcagttgtcaggactcttatagatcatagtattccttctaatggggatatcaat

SEQ ID NO: 49788 - DNA, 434 bp, Zea mays
  unsure at all n locations
  Clone ID: LIB3067-054-Q1-K1-G8
ctcctgggtcctgatggggaggaattgcgtgtgttggttgtgaaagaggcaggtcgtgtgacagaagccatcactattggaacactgatcgattcatacaatgcatctccagcgtttttgaagccattaatttccagtggcaatccagccggacccttcaagtttagtgaggctgaacaagaacagatgttggagctccgagaccaggttttcagagtatggggtcttttgagatcctcaaataactttgatccgagncctttgcaaccaatcgttcaggtgctacaagaaccagaggcccgcgtcttgggttctcgtgtcgcatgtggtgtaacacagcgccttgcggcacgtctgctgcaacagcttctcaggatcccttctcctggatcttcgtaacagattatatagagatgggctcgtatgaagcatgt

SEQ ID NO: 49789 - DNA, 366 bp, Zea mays
  Clone ID: LIB3067-054-Q1-K1-G9
cggactcgtgggctagatcattggacacatatcgaaacagctctagctagcgcgctcgtcgtgtaacctggcttccggcatggcttccaagcagatcggagtcttgacctgcttcattgccatcaccgctctcgccttccgtccctgcgcattcgccgtgcccatggacggtggctggtcgaacggctgcgccacctggtacggcccagccaagggcgctggatccgacggtggtgcgtgtgggtaccagggtgccgtccaccagccttcggtctcgtgaatgatcaccggccgcagccaatccatcttccaggacggcaagggctgctgcacctgctaccaggttaagtgcacctgacacgcctt

SEQ ID NO: 49790 - DNA, 275 bp, Zea mays
  Clone ID: LIB3067-054-Q1-K1-H10
caaaaggataatgcgcaatgctttttcaggccttgcttttttgttaatcttcttgtacgggggtagcacccctaaggatgagacgaagaaccacaacgctgacagggatcgcatcgctgtatgacgttttggagcatacagctcccgtctttttcagagatttgtgtcacctttttgatttgcttctggtgctactcttgttgccgcatcaaaaccagctaacgctgttttgtcgtgtcagtggtttatttgacaatgtgtaggagatttccacc

SEQ ID NO: 49791 - DNA, 363 bp, Zea mays
  Clone ID: LIB3067-054-Q1-K1-H11
cccactcgtccgtaagaaatccttggaccctgtggctccgctacacaaatatggtgttgtctgcatatcaaatatactgaccactacctgccagtatgaggccctcaagtatgtaagcttccctgtccaaacgcttgccaaatgcgccaagatgatacctgtcatgatctggggcacaataataatgagaaagaagtatgttgcaaaagattacttcttttctgtcgtcgtgactatgggttgcgcattgttcattctatatccggcgtcgatggatgtgagtccatttaataaaggcagagaaagcactatttggggtgtttcactcatgctcggttatcttggttttgatggggtcacaag

SEQ ID NO: 49792 - DNA, 353 bp, Zea mays
  unsure at all n locations
  Clone ID: LIB3067-054-Q1-K1-H12
cccactcgtccgatctacagcaacttcatcgatgcactcccagtggtcaagtactgctccgagaacagcaagcgtctcatccacttctccacgtgcgaggtctatggcaagaccatcggcagcttcctccccaaagaccacccgctccgcaaggaacctgaattttatgttctgaaagaagatgagtcaccctgtatttttggtccaatcgtgaaacaacgatggtcctatgcttgcgcgaagcaacttattgagagacttatatttgctgaaggtgcagaaaatggcctngaattcacaatcgtgagaccttttaattggattgggccaaggatggatttcattcctggtgt

SEQ ID NO: 49793 - DNA, 203 bp, Zea mays
  Clone ID: LIB3067-054-Q1-K1-H2
acgaccacgcgtccggcttggcttggctgcgctagcgcacaccgaacccgtcaccgatgcagcgtcgccgcagatccgccacgaccgaccgatcgatccggccggcggcgggcgccatggcctcccccaacccccaggccgctgcactgcaagccgaggctgacgctgcaacattagagagcctcaacgagcacacactcagc

SEQ ID NO: 49794 - DNA, 433 bp, Zea mays
  Clone ID: LIB3067-054-Q1-K1-H3
ctgaggggcgccgacaacgacccgagcaaggacatcgtggagatgaagtcggaggaggcgtaccggctggtgctgcaccaggtggtccggtggctggagcgcaacgtggaccccgtcaagtcgcgggtgttcttcgtcaccgcttcgccgacgcacacggacggcagggcgtggggcgacgacgacgcggagggcagcggcaactgctacaaccagacgtcgccgatcagcgccgcctcgtcctaccgtggcggcacgagccaggagatgctgcgcgcgacggaggaggtgctggccacgtcgcgggtgcccgtcgggctggtcaacatcacgcggctgtccgagtaccgtcgggacgcgcacacgcagacctacaagaagcagtgggtggagccgactgccgagcagcgcgccgaccccaggagctacgccg

SEQ ID NO: 49795 - DNA, 441 bp, Zea mays
  unsure at all n locations
  Clone ID: LIB3067-054-Q1-K1-H4
cccacgcgtccggatctttcccccgtcctccctcgccttcgcctcgccggcaggagattgccaccaccaccgccggaccaccccgaccctccttccctctcgcgctatggcccagactgttgtgctcaaggttggcatgtcctgtgagggctgtgttggagctgtcaagcgggtcctgggcaagatggaaggcgtcgagtcctacgacgtagacatcatggaacagaaggtcaccgtgaagggcaatgtgacacctgacgccgtcctgcaaactgtttccaagactggcaagaagacttcgttctgggaggctgaagccgtgacaagtgaatccgccacacctgccggccaccgcctgacaggttcgatgatctggaagtgcccagcaaaaaaatgtgaatgtatntagcttggatctgttacaaataattgcaaactgct

SEQ ID NO: 49796 - DNA, 434 bp, Zea mays
  Clone ID: LIB3067-054-Q1-K1-H5
gcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgacgagatcgacgccatgcttcaccagaccggaggcagcgttcctagcaccacctaaaagcagcagctgcggagcctcgttttgctctccgccctgcgtagtactaaacaaaagggaaaaagtctttttaaggaacttgt

SEQ ID NO: 49797 - DNA, 434 bp, Zea mays
  Clone ID: LIB3067-054-Q1-K1-H6
gctccctcgccgacaaacagggccgcaagagggcctgcgtcacctattgcatcagctgcgtcctcagctgcatcaccaagcactcccccgagtacagggtcctcatgatcggccgcatcctcgggggcatcgccacctcgctgctcttctccgccttcgagtcctggctcgtcgccgagcacaacaagagaggctttgacccgcagtggctgtccataacattctccaaagccatcttccttgggaacggcttaattgccattgtatctgggctatttgcgaaccttcttgctgagaacttgggttttggtcctgtggctccatttgatgcggctgcgtgctttctggcgattggcatggctatcataatgtcctcatggagtgaaaactacggagatccatctgaaagcaaggacctgatggcccagttcaag

SEQ ID NO: 49798 - DNA, 400 bp, Zea mays
  Clone ID: LIB3067-054-Q1-K1-G12
agtcactgagctgccaaccatgtgaccaagaaggcgaccctcttccaggcacggagctgaaggagatctggagagtcgcccctgccccacagaacgacgggtatcagtacacacactttgcgcacaaaataaacagcttcaacacggcacctaagaagctgttggcatctgattcccggctgaagcccgatagatatgccctcgagaagggcgacatgtccaagtctggctcagaaaagagcaggctggaggagcagcagagagccgagaaaaggactcgagaggccaagggcgagcagttcactccgcgatggttcaacgtgacggatgcggtcgccttcacgccgtggggtgacctggaaatttgcgagtacagcggcagatacacggagcaccgggc

SEQ ID NO: 49799 - DNA, 345 bp, Zea mays
  Clone ID: LIB3067-054-Q1-K1-H7
ggcccgggcaagcagcgacgactcagacaccgagaagtcggcggcagcggctggggcaggggctgactcctaccagcagctagtccggcggctgccccggccgtatcacaacctgaatgacggcgggcatagcaacctcaaggcgctgatgtgagtcgtagtcctggcttgtatccaatcacaacaagagaggctttgacccacagtggctgtccataacataatacaaagccatcttccttgcgaacggcttaattgctattgtatctgggctatttacgaaccttcttagctgaaaacttgagttttggatcctgttgctccatttgatgcagctgcgttctt

SEQ ID NO: 49800 - DNA, 327 bp, Zea mays
  unsure at all n locations
  Clone ID: LIB3067-056-Q1-K1-B1
cattggaagagagattacaatgtcagctgttagagagtgtgctgcatctcagaatagcagagttcttgaggctgttgcagttaacaacttanggaagtggaagacagcgacgcagatgacagcattgactctgcttctcgcaagcagagacccaagtctacctgcgcaaggcgctctagttgcccccggtgttgctctactttacgtctccacgggactcgccgtatggtccctagtggtgtacatgagaaagatatggcgtatactgctaaaatagtattagcacaatatatatatagtgtaatagaagaaacatgcaatgcgagc

SEQ ID NO: 49801 - DNA, 419 bp, Zea mays
  Clone ID: LIB3067-056-Q1-K1-B10
cccacgcgtccgtccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgatccttcgtcacacaactgtgatattccgcatgtgaaccgtactgagtaccagctgattgatatatcagaggatggatttgtgagccctcttacttcagatggcaacac

SEQ ID NO: 49802 - DNA, 124 bp, Zea mays
  Clone ID: LIB3067-056-Q1-K1-B11
gaaaaagatattctgcaaatgtaacagtgaacagttaacaatcgtggtgtgttgttgcatatctagttgatcggaacgacctagagaaatgtgaagaacacgaagcgcctttctgtttgaattt

SEQ ID NO: 49803 - DNA, 373 bp, Zea mays
  unsure at all n locations
  Clone ID: LIB3067-056-Q1-K1-B2
cccacgcgtccgggggctcatgtctactgtgagccacttccagatgcagatatacgaccgtagcagtagcacaaccagacggtcttcaggtttttggctcgcatgccggtcattatggtgggcttccacattgttcaaggaccagttgttttagggggcgctttctagcggagtgctcgtttttcacagatcacctctcagggggtttatctgttttttgagcctcggctgccatcactggcatcctgcccctagatccagacactggtccttgcccttacagtcataagttctttttaagttgccatagtgtccaggtcctctttccgtttactgttgcangcgttggtgatccattgacagctcttgacta

SEQ ID NO: 49804 - DNA, 421 bp, Zea mays
  Clone ID: LIB3067-056-Q1-K1-B3
gacaaaattaataactggagggagacagctcttatattgacatccatccttttcgctgcagttgtgttgtggttcattggcatatttgtccccagcgtcgaccgtttcaacgaagtgagcgagtatggccttactgccgccgagagatcaagtctcaggccactgcttggtgaaaacgagccacggacatcggactaaaatctgcgcaatccataaccatttgttacttggaagggcaatcttagggtatgtttgttttcctcctagattatataaactggattatagtgaaaataagctaaaataagctagcattgggtaatttatttcagttgcatgcgagttgcaatcttagggtacgagggtacaatatcactttggaaggctaaaataggttatcataattcaacttatataattt

SEQ ID NO: 49805 - DNA, 228 bp, Zea mays
  Clone ID: LIB3067-056-Q1-K1-B5
gcattattttgaatctcaatattagcatgtcaatttgcaaaaaaaaaaaaggaaaaaaggaaaaaaaaaaaaaaaaaaaaaaaaaaaaaaaaaaaaaaaaagggaaaaagaaaaaaaggaataaaagaataaaaaacgagagaatgagaataaaaaaggggggctatagtgaaacgataaatgcaatatactggccgaaggtaaacaatgtattgactgggaaaaccc

SEQ ID NO: 49806 - DNA, 371 bp, Zea mays
  Clone ID: LIB3067-056-Q1-K1-B6
cgaaatgataaattattgtcaaccatcttttcgattagtcggtcgacagactgtccgttgagattgtatgttgttgtatgaagaggagaagttgcagttaattgagcagtttacaaagttgaaatctcatgttagtttgactgctgatctttggtcctctaaccaaaaccttggatatcttggtgtaacagcacatttcattagtgaagattttgagttgcacaaaaagattattgcattcaagaagatttccttcccacatacatcttatgctgtgcaagatggtattacctcttgtttgctagagtggggattggttggtgatttgtttaccctgactttggataatgctagtgttaacaatttagcaa

SEQ ID NO: 49807 - DNA, 334 bp, Zea mays
  Clone ID: LIB3067-056-Q1-K1-B7
caaacctgcagcaaaaaaaaaaaaaaaaaaaaaaaaaaaaaaaaaaaaaaaagaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacagggcaaccaaaacaaaggaaccaacatctgtaacacctccttgaaaatcaaaacccttttgatacgcccaaaaaaaataaaacacaagcccggagtttcaacccaaataaattgaaaactctttatggaaaaaaaaccaaaaacaggagaaaaaatgcacattatacccaat

SEQ ID NO: 49808 - DNA, 367 bp, Zea mays
  Clone ID: LIB3067-056-Q1-K1-B8
cccaaggtccctttttttttctcgatctggaagcgccgcagtagcagccatggacgtgagcggagcaggcgggaaggcgaagaagggcgcggcggggcgcaaggccggcgggccgacgaagaagtcggtgtcgcggtccgccagggccgggctgcagttccccgtcagccgcgtcgggtggtacctcaaaaagggccggtacgcgcagcgtgtaggcacgggtgcccccgtctacctcgccgccgtcctggagtacctcgcggccgaggtgctcgagctcgccggcaacgcggcaagggacaataagaagacgcgcatcatcccgcgccacgtgctcctcgccatccgcaacgacgaggagctcggt

SEQ ID NO: 49809 - DNA, 424 bp, Zea mays
  Clone ID: LIB3067-056-Q1-K1-B9
gctgaaatgcttgtgatggcatacggaaggtcttatggtcttcctgtgattaccactcgtggcaacaatgtgtatgggccaaatcaatttcctgagaaactcattcccaaattcattcttttggccatgcaaggtctgcctcttccaattcatggagatggctccaacgtcaggagctacctgtactgtgaggatgtggccgaagcttttgaggtggtccttcacaaaggagaagttggacatgtgtataatattggtactgtgaaggagaggagggtgattgatgtggccaaggacatatgcaagctctttggcttggatactgagaaagtcatcaagtttgttgagaacaggcccttcaatgaccagaggtacttcttagatgatcagaatctaaagagattgggatgggcagagcgcacac

SEQ ID NO: 49810 - DNA, 437 bp, Zea mays
  Clone ID: LIB3067-056-Q1-K1-C1
ggtgttcttcaaccttctcctagaatgcgagatgtcccaaaactatcgcccctagttgcgcaccgagtacatgccgatcccctatctggtatggtgttcaccagtgaatctatcctcaccatctgccgcgagggcctcatcaaaatctgggttcgaccagagcagagcgaaaacaatcagcaatcgaattcttcagaatttgctttaggccctgcttcgaaggatagggcgatcacatcttccaataaagcaagtagctccagctttaagaagctgccgcctgttcttgtcacatgatgaatcaacgggatggttcttggggatatttctgcttcacgtggcattagtggtggatatgaatcttactccatggttgatggggatgaaactctcatatggagtctgcagactgcaagtaatgaaggtgagcatttgat

SEQ ID NO: 49811 - DNA, 258 bp, Zea mays
  Clone ID: LIB3067-056-Q1-K1-C10
tatgcccctagcaacgggtcggtccatgtcgagtcgtcgtcgctgctgcatgcctacccccctttttttgattcgatgctgtggtaattatagtggtcgcctctttagatgttacacgcaaaaaatattggcggtgatgcagatatttattgatttgttctggtaattaataagaaccctcaagctttggggtgttcacggaaaggttgagttgatgcggtgaaaacagcacgtgaaagggtaatgagagatcgatcg

SEQ ID NO: 49812 - DNA, 434 bp, Zea mays
  Clone ID: LIB3067-056-Q1-K1-C11
ggagaagttaagggagaagaaattgtcctgggttgatatttttgaggagataccaataaaagtttccaactcagcgcttgtcagtgcctttatgaaggagctggaacctgagtcacctgttacccagtgtgacctggaccgacttaaattgtcaaccgccccctttatggaaaggaacttggaatttctgattgggtgcatggatgatctttcatcagagcagaacaagttccaatattataaccgcaatctctcaagacaacagtcacagcagcaggcatggcttcaaaagagaaggcaggagaacatggcgaggaaagcagctggtgaggagccactaccagaagaagatccatccaatcctatatttaagcctattcctgagccctcacgattggagggctatctagtaactaatcagatctgcagttact

SEQ ID NO: 49813 - DNA, 380 bp, Zea mays
  Clone ID: LIB3067-056-Q1-K1-C2
ggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagtctgtctccaaaggatactatggagagtgtggtaaaagaggaagttacatggagattactggcttcagtgctccggtaagagagcagatc

SEQ ID NO: 49814 - DNA, 440 bp, Zea mays
  Clone ID: LIB3067-056-Q1-K1-C3
ggaccaccgggtgggaggctgcgagatcgacgacgggctcggttcgattcggctggcgcgagcaccagcctatctatctgagacgggcatcggcggcggagagacctggcgcgcggcggaacgctgaggttatcttgtattctcgtcaagacaactctcttccctcagagcactgaacaatcattgtgatttatgactaattctgagtggtgaaagaattaagaaaatacagaacaccgcaatggctgttagatgctcctgtactgctcttttccctctagtcttctgttttatgatctgtcagctttgctatggcactgtaactgatatccaatgtctgaagaagctgaaggcatcagttgatcccgacaataagttagaatggacattcaataacaatacagaaggatccatatgcgggttcaatggtgtggagtgct

SEQ ID NO: 49815 - DNA, 396 bp, Zea mays
  Clone ID: LIB3067-056-Q1-K1-C4
atgagtcatggggccccctctttgggaagctattctttgcattttgggtgattgtccatgtttatccggttctcaaaggtttggttggaaggcaaaacaggacaccaacgattgtcatcgtctggtccattctgctggcttcaatcttctcgctcctttgggttcggattgatcctttccttgcgaaggatgatggtccgcttcttgaggagtgtggtttggattgcaactaggatgtcagtgcatcagctcccccaatctgcatatgcttgaagtatattttctggtgtttgtccccatattcagtgtctgtagaatagagacatgaaatgtcccaagtttcttttgatccattgtgaacctacttaatatctgagagaattactgggggaaaat

SEQ ID NO: 49816 - DNA, 436 bp, Zea mays
  unsure at all n locations
  Clone ID: LIB3067-056-Q1-K1-A9
gtggggaagacggtggggctctacttctcggctaaccattgcgcgccgtgtatcaagttgacgacgaagctggcggccatctacagcagcctcaggggcaaggcggaggacttcgagatcgtgtacgtccccatggacagggaggaggacgggtacctgcgctcctgcggcgacatgccgtggctggcgctcccctacgacggcgcgccgtcgcgcgcgctggcgaggtacttcgacgtgcgggagatcccgacgctggtggtggtggggcccgacggcaggacggtgacgcgggacggccggaacctggtgaacctctacttcgacatggccttcccgttcacggacgcgcagatcaggctgctgcangaggcggaggacgaggcggccaaggagtacccgcggtcgctgcgccaccggggccaccgtcacgagc

SEQ ID NO: 49817 - DNA, 350 bp, Zea mays
  Clone ID: LIB3067-055-Q1-K1-G12
ggggaccaggcgtccggtttaacacggtgtgcactcttcatttcaggaagctggacttcgaagagttcgcgggttgcgtcatcagtgtttaccagatggaagccttggagacgtgggagcagcacgcgcggcgtgcgtacgagctgttcgacaaggaaggaaaccgacccatcgtgatcgaagagcttgcatcggaactggggcttggcccgtcggtgcctcttcacgttgtcctccaggactggatccggcacgccgacgggaagctgagcttcctggggttcataaagctcttgcacggtgtgtcgtcgcgctcgatccccaaagcctagccatgcgccatccattac

SEQ ID NO: 49818 - DNA, 214 bp, Zea mays
  Clone ID: LIB3067-055-Q1-K1-G4
caaacgaatcggcacgacgcatcggcatcgcctccgacgatcttgagacaaacaaaagccaccgctgcggcaactccgcctcccgccgacccggggatcgcctgacaacaggcagcgaaaaggggcgcagggtttgcccgccaagatggaggacgtggacgtctcgcggcagctgaagcagatgacggacttcatccgccaggaggccgtcgag

SEQ ID NO: 49819 - DNA, 308 bp, Zea mays
  unsure at all n locations
  Clone ID: LIB3067-055-Q1-K1-G5
cgcaaacntccgcccacacgttcggtttctcgtccgcgaggaccatcatataactgtcgccttcctctcgttttaaacaaaatctgtctctgcacggggcgtcaacggcaggcggaaccacacgatcggcggcggcgggcgggagcacctggacttggcggtggagtctgtcatacgctgggcaggcacgcaccatcttgtgcaagcgacctcacttgagtcctacctcgtatgctagcactagcaacgtggattcgagcgccggagccgtcaacgatcgatgggtcgaattgttgaaaaaaaaagaa

SEQ ID NO: 49820 - DNA, 322 bp, Zea mays
  Clone ID: LIB3067-055-Q1-K1-G9
ggaaccgaaaattgcagatttcgggttggcaaggcttctaggagaaggccacacgcggactcagacaggcagagttgttgggacattcggttatatggcgccagagtatgcatcacatggtagtgtgtcgcctaagattgacatctttagcttcggcgtcttgatccttgagatcgtgaccaggagaagcaactgcagctctgatgaccacagcactgtgaatctcctaagtgatgtctgggatcactggaagaaagggacgatgccacaaatgcttcaccggtcactggatgagtttgctcgaagccaagcgctgcgatgc

SEQ ID NO: 49821 - DNA, 214 bp, Zea mays
  unsure at all n locations
  Clone ID: LIB3067-055-Q1-K1-H10
cggacgcgtgggcggacacctgggcgttggccgaagaagaggagaagcgaagcaagcgggcttctagaacaagactgcanggggagggggaagaccaagcgaaaggggaactagagcaagatgggcggtgcactgctgcttgcgctcctactcgtatctgctgctgacgcccctcaggtacttggagttggcaatggagacaatcacatgagaa

SEQ ID NO: 49822 - DNA, 228 bp, Zea mays
  Clone ID: LIB3067-055-Q1-K1-H11
tgcgaggacagacaagtacacctcgtatgttttcatcgtttacaatgctaaccgcatcacacagtgccttgctacccttgctaagggcattcatgacaacttcggcattggtgacggtctgataacaactgttcatgccattactggcactcatactactgtttactgaccctcatcctaagactgtagaagtgagcaggctcccatctctaacatcattcatagcag

SEQ ID NO: 49823 - DNA, 331 bp, Zea mays
  unsure at all n locations
  Clone ID: LIB3067-055-Q1-K1-H12
gacccacgcgtaacgngcgacgcgtccgnccacgcgtccgcctatgctttcgtatcaacgtgcccattgngcctgtctctatatcaccatgcgtgtgaggctctactcctaagtcggttggtgtctggagggatgggaccaaacagaaaggagcaagaactttggggcgcaaggactgcgctacgatcttgagatatggtccatatggatgtcatgataacgatgcatgtacagaaaacctgtccgtgcctattcagtaatgntcgtgatgagtatcttccatcaaacacatgtaaaaattctaaaggtaatcttgattagtagcaaggga

SEQ ID NO: 49824 - DNA, 384 bp, Zea mays
  Clone ID: LIB3067-055-Q1-K1-H4
cccacgcgtccgcattgttggacgcgttcccctcctgcacgcaacctcatctcgtccgccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcgatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatcaatttcgataattattagtagatctatga

SEQ ID NO: 49825 - DNA, 78 bp, Zea mays
  Clone ID: LIB3067-055-Q1-K1-H5
agaacaaaaaaaaaaaaaaaaaaaaattttaaaaaaaaaaaaaaaaaaaaaaaaaaagggaggttttaaagaaggggg

SEQ ID NO: 49826 - DNA, 280 bp, Zea mays
  unsure at all n locations
  Clone ID: LIB3067-055-Q1-K1-H6
cccacgcgtccgcccacgcgtccgcccacgcgtncgtatcaacgtgcccattgtgccgcgctctaatcaccatgcgtgtgaggctctactcctaagtcggttggtgtctggagggatgggaccaaacagaaaggagcaagaactttggggcgcaaggactgcgctacgatcttgagatatggtccatatggatgtcatgataacgatgcatgtacagaaaccttgtccgtgcctattcagtaatgtcgttgatgagtatcttccatcaatcacatgtaaa

SEQ ID NO: 49827 - DNA, 399 bp, Zea mays
  Clone ID: LIB3067-055-Q1-K1-H9
cccacgcgtccgcagggacaacaagaagactcgcattattccgcgccacgtgcttctggcgatccggaacgacgaggagcttgggaagctgctgggcggcgtgaccatcgctcacggcggtgtgctccccaatatcaaccctgttctgctgcccaagaagacggcggagaaggcgtccagtgtggggagcaaggaggcaaagtcgcccaagaaggccgccaagtcccccaagaaggcatagactgactgtctggagtgatctgatgtttagcaggaccttgataccagtatgcggtgatgcgtaggctgtagatgggtcgaatgtgcttgtgtgtgtatgtgccctgctgcaagttgccctttgctatttaaaatggaagaagaaatgccttgtttctc

SEQ ID NO: 49828 - DNA, 399 bp, Zea mays
  Clone ID: LIB3067-056-Q1-K1-A11
ggaggaaggagatcgcgagcagccggagccggaggccgagaggatgaagacgttcgacccgtggccggtcttcttccgccgggagtggaagcgcaactggcccttcctcacggggttcgccatcaccggcttcatcatcaccaagatgacggccaacttcaccgaggaggacctcaagaactccaagttcgtccaggaacacaagaagcgctgaccaaccgggagtcgtccgaatcgcctgcggatgaaaaattagccccctatttatcttgtctttttttttatctagatgcgtgcactctattgtaataatgtaataagaggcaattggattgatccaacagcaaccggcttctgattttgatccgcttcgctgacataatatgtgccttttttctg

SEQ ID NO: 49829 - DNA, 428 bp, Zea mays
  Clone ID: LIB3067-056-Q1-K1-A12
gaattatccgggccgacccactcgtccggccggaacgagatcgctagcatactgagctttaggcctacaggatgaagacgttcgaccggggaccggtcttcttcctccgggagtggaaacgcaactcgcaccttcctcacgctgttcatcatcaccggcttcatcatcaccaatatgacgaccaacttcaccgaggaggacctcaagaactccaagttcgttcaggaacacaagaagcgctctccaaccgggaatcgtccaaatcgcctgctgatgaaaaattagcccgctatttatcttgtctttattcttatctagatgcgtgcactctattgtaataatgcaataataagcaattggattgatccaacaatatccggctttttgatttgatccgattcccttacataatatgttcctcttttctt

SEQ ID NO: 49830 - DNA, 382 bp, Zea mays
  Clone ID: LIB3067-056-Q1-K1-A2
cggacgcgtgggggcttctcctccccctcttaccaagtcctcctcgggttagggttcctgagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggccgcggtggctacggcggctgtcgcggc

SEQ ID NO: 49831 - DNA, 185 bp, Zea mays
  Clone ID: LIB3067-056-Q1-K1-A3
cccacgcgtccgaaaaccgcaccgacgctcgttcatatgtgtgtgtgtgtggtgtgtgtgcatgtagtggtaggcccttggcccactaagcagaagaactctaggcctttttttttgtcccctcgtgactgtcttgcgtggaaattttagataggtggaagtggcggaaccctccgatttgtctt

SEQ ID NO: 49832 - DNA, 303 bp, Zea mays
  Clone ID: LIB3067-055-Q1-K1-G11
cagcaagcccgtccctgctattctggagatcccatccaaggaccatccatatgatccgtcgcacgactctgtgctctctcgagtgaaatatctgttctctgcagaatcggtggcgtctgataggcgatgaaggcatccttgcgtagcagtacccttcgatgcatctattttgttatggtattgaaaagaagatggcacgtaccattgggtgcgagcgagccagcatgaataataatgagcttgcaaacaatgattggttgaactaaaccaacacaatttttttttaataaatggttcgaatga

SEQ ID NO: 49833 - DNA, 422 bp, Zea mays
  Clone ID: LIB3067-056-Q1-K1-A6
cccacgcgtccgcccacgcgttcgcaattgtagaacttgcagaggataggcactggagagtccggcttgcaataattgagtacatcccattgttggcgagtcaattaggtgttgggtttttcgatgacaagctgggggcgctctgcatgcaatggttggaagacaaggtcttttcaatcagagatgctgccgctaacaacttgaagcgccttgcagaagagtttggtccagagtgggcaatgcagcatataatccctcaagtgctggagaagatcaacaacccacactatttataccgcatgacgattctgcaagcaatctccttgctagctcctgtcatgggtgcagagatcacctgtcaaaagctgcttccagtcgtcattaattcttcgaaggacagggtttccaacatcaagttcaat

SEQ ID NO: 49834 - DNA, 391 bp, Zea mays
  Clone ID: LIB3067-056-Q1-K1-A8
agagaaaccaaggccaaggagcacagcaccccgtacgtccccagcaggagagggagagacagaagggtgtgcgaaggaaagaagaggcggtgggagaggagggcgacatggagaggccggcaccggtgaggaagtctcacatgtcgacggcggacctgctgatctggccggagggggcgccgcaggagtcgcccgccggggccacgccgccatccaaccgccggccgcatcagccgtcggaggcgctcaggaaggtggtgttcggcgggcaggtgacggaagaggaagccgagagcctcaacaagaggaaaccatgctctgctcccaagtggaaagagatgacaggaagcggcatatttgctgctgggggcgaggctgaagaagatgaatc

SEQ ID NO: 49835 - DNA, 371 bp, Zea mays
  Clone ID: LIB3067-055-Q1-K1-D5
aattagaaattagtgatgacctaccattgaagaaatggacataccatgatcataagggtgatttgctcagttctgtcacatctgcaaatagtgctatagccaaagaaattaatgaagtgctatttaaatcattgcctgctgatacacctcgccttgatttgtttgcatcaagtcatcttctgagccaaaggaagagtgatttgattgtcaaagaaaggcttggagtatgtaaaaccaggctgaggttgaaagagcagatgcttacaatgaagttcaaggcatattgtcacttgtggaaagacgtccaactattttctgcaaataaacagcgttcaaagtctaataagcgcactgatcagagcaaccgaaca

SEQ ID NO: 49836 - DNA, 343 bp, Zea mays
  Clone ID: LIB3067-055-Q1-K1-D6
cggacgcgtgggcggacgcgtgggcggacgcgtgggcgcaagtggttgcctccgggggagccacaaacacacagacaccatggccttcccagggactccggcgaggaagatcgtaccaggcggcttcaccgcagcacgaaccgccgtggccagcggcggcgctcttagcttcgacctggacggcgccggcgactttttctggggcctgtggcagctcatcaaggcgaaggccgccgaggcagcggcctacctcgctgccctcttcgcggcgctggcggagaaggcggacgagatcttcccgccggagacccgctcggagacgctccggcagtggatgcgcgtc

SEQ ID NO: 49837 - DNA, 186 bp, Zea mays
  unsure at all n locations
  Clone ID: LIB3067-055-Q1-K1-D9
ngcacgcgtccgggctatcagtggctgtccgatatacgtgagcaacgagcctgggcaggcaaacttanagctgctcaggaagctcgtgctccccgacgggtccttgctacgcacgcagcttagcgggcggcacacacgcgactgactcttatgcgacccacaacgcgacggctagagtttgctaag

SEQ ID NO: 49838 - DNA, 376 bp, Zea mays
  Clone ID: LIB3067-055-Q1-K1-E1
cccacgcgtccggagcttaatggcgatatttttggagcacgtgcagaatatcagcgggtgtattcagatttatgccctggctttctagaggccattgtgaagcattctaatatggaacaccgactgggagataaagaattgtcctgttcagtttatgaaaaggacatcgctgctgagaagggaatggaacagagccagctcttaccaacattgcttattcagtactaccgcttcttattttcggtcatcatagacttggaaaaggcaagggagatattaactgtgctgcatgagcagtttaatttaacaaaaccagtgcttgaggctgtcatccatctagagtcgattttttcatgcgaaaagcgtattgaaattt

SEQ ID NO: 49839 - DNA, 435 bp, Zea mays
  unsure at all n locations
  Clone ID: LIB3067-055-Q1-K1-E10
ccccgcttcacggaaaacctncttggttaaacatcatctaatatgatatgaattctggtagacagatacatatatatcgatgcattattgnatcattttttctagtttcaaggaatcataattattttctatttagaaatctttggattgcatttgcccaatttaagctcaaattctgttttgtgcacttattaagttgtttctgaatcttgcagaagcatatctacagagaggagtcaccaagcccattggacttccgatacgcagctttttctaatagaatggaaaacgaattgtactggaattgtttgtgtactttggctcattcgtccgaccgtatctttgtaatcagtgagaatggcaagcaaatgtccatgacatctattgttattgtaaaaacatgtgttataaccctgattctcagattacatttat

SEQ ID NO: 49840 - DNA, 361 bp, Zea mays
  unsure at all n locations
  Clone ID: LIB3067-055-Q1-K1-E11
ctcgtcggngcgcaacgccaccgncgtttcgagcggtgggtccaacgactcgagcggcacggttcgacacctcgtcgtaccagcagcgcgccgaggcccttggaggcctgctggagttcagcgcgcagctgctgcagcaggagcggtacgaggagctgggcatcctgctgaagccgttcggccccgagaaggcgtcgcccagggagactgccatctggctcaccaagagcttcaaggagacggcgtcatagcggagggagggagggagacgtagctgccagttttctaacgtgcaatgtagttcaggtagtctaagctatgttaggaccccccaagtgtatgtgctggaaggaaggcaaca

SEQ ID NO: 49841 - DNA, 319 bp, Zea mays
  Clone ID: LIB3067-055-Q1-K1-E12
gggaggcgctggtgctggagatcgggatgaccttcgggctggtgtacacggtgtccggcgacggcggtggacccgaagaagggcatcctgtgcaccatcgcccgcatcgccatcggcttcatcgtgggggccaacatcctggtgggcggcgccttcgacgtgccgtccatgaaccccgccgtgtccttcggccccgccctcgtcagctgggagtggggctaccagtgggtgtactgggtcggccccctcatcggcggccgcctcgccggcgtcatctacgagctgctcttcatctgccacacccacgagcagctcccct

SEQ ID NO: 49842 - DNA, 269 bp, Zea mays
  Clone ID: LIB3067-055-Q1-K1-E2
gtggtggcgcgcacgggatgcagctcctggcattcccggtgcgagacgggaagcgtggcgccggcgacggtggtgcagctggtggtgcacgcggaggggcaagacctggcgtcgtacagcgtgagcctggtggacgggttcaacgtgcccgctgtggtgagcccgcatgcggtgggcggcgggcagtgcccggccctggggtgcgcggcggacctcaacgccgggtgcccgccctcgcagcgcgtgctgggggccgggggcggcgtggt

SEQ ID NO: 49843 - DNA, 280 bp, Zea mays
  unsure at all n locations
  Clone ID: LIB3067-055-Q1-K1-E3
ggaagaagcttaatgaccggctctacatgctccgctccgtcgtgcccaaaatcagcgagatggacaaggcctccattctcggcgacccgatcgaatacctgaaagagcttgctgggaagatcgacgacctccaaaacgagctggagtcaccaccatccccagcttccacggcctcgctgccttcgacgcccacgagcttncgncctctgacttccacgcttgccgccctaccatctcgcgtgaaggaagagctgtgcccgagcgcgttgcctagccctac

SEQ ID NO: 49844 - DNA, 391 bp, Zea mays
  Clone ID: LIB3067-055-Q1-K1-E4
cggacgcgtgggcggacgcgtgggacgcaacatggatatttattcaagaatcgccgggggctgcgcagattcatcattccaggcagccaggccctctctttgctgagccgagatctacgggaagcccacttgcaggtgctcctcggaggaggcggacagagatccagcgacaacagcagcagcagcgccacgaacatttcggctgatcctcttctgtcgtcgttcggccttggcttccctacctcagacgcggagcaagcatccaagtcgactgtttccattcctgatgatgctacgacggtgaaagaagcgcccgctcaggcacggaagctaagtatcgattcgtcgctcacaagtgaagaaagggagctgaagcggaagcaagcccgcg

SEQ ID NO: 49845 - DNA, 231 bp, Zea mays
  Clone ID: LIB3067-055-Q1-K1-E5
cgccacgcgtccgcggcggtgacccttttccttcgcaacaaccggccggtcccggggggggaacttcccgcgtacctgctggcgcaaattcttggcgccacgctcgcctccgggacgctgcgcctcatgttcggcggccggcacgagcactttcccggcacgcttcccacgggctccgaagtgcagtcgctcgtcatcgagatcatcaccacattctacctcatgttcgtc

SEQ ID NO: 49846 - DNA, 374 bp, Zea mays
  Clone ID: LIB3067-055-Q1-K1-E6
cagcaagtcaaacagctccaaagggctgacaaacatccaagcaaatgccgtggaggagaccagcacaaggcgtgctgcattggacgcatctattaacgaagtgctgttccagatcataaagttcgccaacgagaaaaaggaccacattcctgctatccctgacaggattttcaatcacgagatcatgatcccaagctcggattctgtatttggatggaacacggacgtcattcgcagagttctgaatagcgggcacccatactcgctataactgaagacgacatctcagtgggcgcccgtattcagattattagcgtgctgccgccctctttggaagacggctctgctaaccatcgtggcgaaccatataatat

SEQ ID NO: 49847 - DNA, 115 bp, Zea mays
  Clone ID: LIB3067-055-Q1-K1-E8
tcgcggacgcgtgggattataaggcgcgaatctatccatctatctaatctactaacgcacggggatgcgtaacatcggcatgctgcgggcgcttgtcctggcgctcggggggggc

SEQ ID NO: 49848 - DNA, 359 bp, Zea mays
  Clone ID: LIB3067-055-Q1-K1-F1
ggatctgatggttcctgtaccagtagtttgaaatcagattttgagaatggaaaagaggttggaaagcggtcaaggcaccgttgctttgttgttactgcaagggcacggtcttttctttaccaccaggtaaggttgatggtcggtcttctaaaatctgttgggactggagatctaacaactgcagatgttgagagaattctggatgcaaagacggatactgctgcacccagtatggcaccttcttgtggtctgtaccttgctaacgttaaatatgatctgaatacctgaagacaagttttatctagtggcttctgttggtgggcctccagattatgtcagctgttggctatcaaaggaat

SEQ ID NO: 49849 - DNA, 285 bp, Zea mays
  unsure at all n locations
  Clone ID: LIB3067-055-Q1-K1-F11
ggggaccctaactactgaaaatgaagtccgtactactacactcataagctatgggttgtcggttttatagaccctgtggacaccacacannacctgagccgattccttggcgaacattcagtgccgaccggataacactcaagagacgccaaatgtgtgtatgcaataaatggttgtgacgcataacacaaacgtgtttaataaaaagctgtctgcactcacccaatgtgtgtgcacaaatcaaaatttcgccctggttgctgtcgtggaaatatgttgaagagt

SEQ ID NO: 49850 - DNA, 364 bp, Zea mays
  unsure at all n locations
  Clone ID: LIB3067-055-Q1-K1-F2
ggaaggcccagcgcgccaccggccccgccaccgtgctggcgatctgcaccggcaccccccgcaaatgcgtgtgcaggccgactaacccgactactactttcngatcaccaagagcgagcacctcaccgacctcaaggagaaattcaagatgatgtgcgacatgtcgatgatccggaagcgttacatgcacctgacngaggagttcctggcggagaacccgagcatgtgcgcgtacatggcgccgacactggacgcgcggcaagacgtggtggtggtggaggtgcctaagctggggaaggcggcggcgcagaaggcgatcaaggagtgggggcagcccaagtcgcggatcacgcacctggtgttc

SEQ ID NO: 49851 - DNA, 315 bp, Zea mays
  Clone ID: LIB3067-055-Q1-K1-F4
gtggaggcttacgacagagaaggaagcccgtactactccactgctaggctatggggcgacggggtcatcgaccctgctgacaccaggcgggttctgagcctctgcctctccgcttcggccaagccggttccggaagacacaagatacggtgtattccggatgtgaataaatgtgtgtgagtaataacgcagacgtgtttaataaaaagctgcctgcacgcacccaatgtgtgtgcacaaataaaaatttcgccctggtttctgtcgtcgaaatatgttgaagagtgttgttcatttcatatattactatctgatg

SEQ ID NO: 49852 - DNA, 350 bp, Zea mays
  Clone ID: LIB3067-055-Q1-K1-D3
ggggtctctccacatgaccatccagaccggcaagatccccgatccggagtccaccgagaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgacactcgctccctgatggtctgatgagggccactgacgttatgatcgccggaaaggttgccgtggtct

SEQ ID NO: 49853 - DNA, 188 bp, Zea mays
  Clone ID: LIB3067-055-Q1-K1-F5
accatcgcccccatctccatcgggttcatcgtggggttccgcaagacacaggacaccgcgtattaccgatcttacataatgcccgacatgaacaatatgacccgccctcatcaactgggagtggggctaccaatgggtatactgggtcggccccctaatctgcagcggccttgccggactcatctacg

SEQ ID NO: 49854 - DNA, 400 bp, Zea mays
  Clone ID: LIB3067-055-Q1-K1-F6
ggacccgcccacctcctgcagcgcatgttctgttggtgaggacatgttccattggctgtcgaccatcatggggccatcggacagcccatttgcaggtggggtattcttggtgaacattcacttcccaccggattaccctttcaagccaccaaaggtgtctttccgcaccaaggttttccacccgaacatcaacagcaacggcagcatttgccttgacattcttaaggaacagtggagccctgctttaactatctcaaaggttctcctgtcaatctgctcactgctcacggacccaaaccctgatgatcctcttgtccctgagattgctcacatgtacaagaccgacagggccaagtatgagtccaccgcacgcctctggacacagaagtatgccatgggc

SEQ ID NO: 49855 - DNA, 294 bp, Zea mays
  Clone ID: LIB3067-055-Q1-K1-G10
cccacgcgtccgcccacgcgtccgcccacgcgtccgcgagccagctgagccacagggggtcgctgcctcctcgactccgaggacggcgaggggatccacgccacggggcgtcaacggcaggcggaaccacacgatcggcggcggcgggcgggagcacctggacgtggcggtggagtctgtcatccgctgggcgtcgtgcaccaacttctccacggcgccctcacttcgggcctccctcgtatgctagcactagcaacgtcgttccgcgcgccggcgccgccaacgccgggctga

SEQ ID NO: 49856 - DNA, 366 bp, Zea mays
  Clone ID: LIB3067-058-Q1-K1-B3
agctggacagcaggaagagccttggagttctacgcgaggagcgagctagtgattacctcgggcgtgctgtgcacggaaagttacccagcagatcgatcggactaggcgggtatgacaggatccagaggttgctagccatggcggaggaagcatctgcgcctgcggcgggaacagaagctccgtcatggatgatgactatggtgttaggggtacacaagagcgatcacagctcttactcgctgcaatgatcactgctgcacttttttccgtcaagccatatcgcatcagtccgcctgctcgcgtcacgcgaaataccaccgacggctgcgactgtggccttgacggtccaaacgctatagatgtgct

SEQ ID NO: 49857 - DNA, 429 bp, Zea mays
  unsure at all n locations
  Clone ID: LIB3067-058-Q1-K1-B4
cccacgcgtccgcccacgcgtccggacgatgcaaaaggttcttgtgtacattgttacaatgagttcaaacttcatggatctggaaccaaatacaacaaggatttcacagtttatactaaacagctccaggcataccctatcgagcaactatttggccacagttgctccaaatacttccaaaagcatggtttttgatagaaattggcagaaaaaggccattgtttcagttatggaagctggtggtgtcaattggttagtagaacttctaagggttattcgaagattgaatttgaaagagcagtggactgacttgtcactccactntataactttgtactctctgaagtcaactatatctgaaaatgttcgtgcacaaaatcatttcagaagtatagggggaactggaggtctattaaatggactgggact

SEQ ID NO: 49858 - DNA, 474 bp, Zea mays
  Clone ID: LIB3067-058-Q1-K1-B5
agtaccggaaattggcagacagctcacatgagaaaaatgaagctcggagggagttgcttgaagtgatggcccacaggtctcatgttgacagcagtgttgagctcattggaagccttctctttggctctgaggacggtccaagggttctgaaagccgtccgtgcagctggtgagcctctcgtcgatgattggagctgtctcaagtccacggttcgtacttttgaggcgcaatgtgggtcgttggcgcagtatgggatgaagcacatgcggtccttcgcaaacatctgcaacgctggcatccttcctgaagcagtgtcgaaggtcgctgctcaggcttgcaccagcattccttccaacccctggagttctatccacaaagggtttagcgcctaagaatcataaggtgaggcgaaatatttcagccgctccaccgcaacgaactgggttacattaccagtcctcaagggggtcctag

SEQ ID NO: 49859 - DNA, 431 bp, Zea mays
  Clone ID: LIB3067-058-Q1-K1-B6
cccacgcgtccgattccaaaaaccgtgatatgaagagaacagaatcttcggctcccatctgcaacatggaagatatagaagagggatttgaaggttacgaggatgaaaggtcactgcttatgtctcagaagagcttggagaaacgctttggccagtctccaatttttattgcatccacctttatgactcaaggtggcatacccccttcaacaaacccaggttccctgctaaaggaagctatacatgtcattagttgtggatatgaggataaaacagaatgggggaaagagatcggatggatatatggctctgttactgaagatattttaactggtttcaagatgcatgcaagaggttggatatccatctactgcatgccacttcggccttgcttcaagggttctgctccaattaatctttctgatcgtctc

SEQ ID NO: 49860 - DNA, 461 bp, Zea mays
  Clone ID: LIB3067-058-Q1-K1-B7
cccacgcgtccgcccacgcgtccgcccacgcgtccgcccacgcgtccgcccacgcgtccgaggagaagctcgccggttcctataacatgttggggttaaactactacacctcacggttctccaaaaacatcgatatctcaccaaactactcacctgtgctcaacactgacgacgcctacgccagtcaagaagttaacgggcctgacgggaagcccattggtcctcctatgggaaatccatggatctacatgtaccctgagggcttgaaggatctccttatgatcatgaagaacaaatacggaaacccacctatctacatcacggagaacggaatcggggatgttgataccaaggagacacctctacccatggaggatgccttaaatgactacaaaaggctagattacatccagcgccacatcgctactcttaaggaatcaatagacttgggatcaaatgtg

SEQ ID NO: 49861 - DNA, 400 bp, Zea mays
  Clone ID: LIB3067-058-Q1-K1-B8
caagggaatagaaggaaaggatggaaagttccttgatggatgggttatttttgcggaatgcgctaaacccagaccaccgccggaggaaacagggatgaattcgcagccccagcagtcatggggagctccatcaggttcctggggtgcacagtagatgaagtgatattgtgagagcccctccctgtccccagccctggggctcgtagcggatcgtgagggatgaatttgtgtgtggtgtgtcacaggtgtgaatgcctttgttgtcccaatattcctaccgtgttgggagtggtcgtttgctcgcgtccacgtctttcacatgaattggttactgtggtagttgtagttctggatacgggaccaaaactaaagtattgctgtcaacaatctgcaacagtcg

SEQ ID NO: 49862 - DNA, 410 bp, Zea mays
  Clone ID: LIB3067-058-Q1-K1-C10
caatgatctctgcccagtactaagtgtgcagcagctttacaaaatatgcactcagtactgggatgataaatataacacagagagtgtgtcagaagaggtccttgaggagatgcgaacattgatgaccaaggaatcaagcgatgaaactctggggaacacctttctactggatgatgaaattagcttgcccatatcacttgaggagatagcagattctatggatgccaaagaatttcagaatgttgccccaccacaagagcttactgcaattcctgcctttcaattcttgaagagctaagccctggaaggcctaggcctacgttgctgcacgggcatacgcaaatacatctagattcttccatcagatgttatagggtttcaattctccttgtgctgtgtaattattttgt

SEQ ID NO: 49863 - DNA, 327 bp, Zea mays
  Clone ID: LIB3067-058-Q1-K1-C11
tcccacgcgtcctcccactcgtccgtccactctttctttaaaaaatatgcactggggactgggatcataaatataacacagagagtgtgtaagaagatgaacctgaggatacacgaacatacatgaacaatgaaccaacctataaaactaatacggaacacttttgtactggataatgaaattagctagcccatatacaattagaacattacaaattctatgaatgctacaaaattttaaactgtaaccatatcaaaaaaacttactacaatctgtatcttttaaaaatagaatagctaaaaacatttaagactaaacctactttga

SEQ ID NO: 49864 - DNA, 427 bp, Zea mays
  Clone ID: LIB3067-058-Q1-K1-C12
cggactcgtgggcgagctcaaccatccaatactcccagggcgctagctcttcgttgataaaaacacccctgcttcccttcctgcctgcacaccacatctcaatctttgctgcgagctcccgatctgtggtacttccggcatcgcgaactgaagtttaccaccgatccgttggctccttggcattccttttcctccagcagcggcaaagcctccatctttttgccaaccgacttgaggaatggggtgcatgaagctgcttggagtagactcaagctttatggaagatttctagtacttcattcccaacaagcaatcagataaaaacaaaaggagcaacttcaacagaacctgctgctccagtgattggaccgaccgatatttgcaaactgctgaaattgaatccatgggtagaggaagaggacgaggg

SEQ ID NO: 49865 - DNA, 423 bp, Zea mays
  Clone ID: LIB3067-058-Q1-K1-C2
cccagcaccaaaccgtgcaggttctgttgataattccagaaaccacacacaagtcgatgtcgaccttccaccacctgctctggatgatttctacaatggcaattggttccctccccaatgaattcagtatgggaggaaacaaatgcaataacattttgtacctgtgaaaaacaaatcagagaaggctaatggccagattacaaagcaatggtcgtgcgctaatgatttctacaatgacagttggttccctcccccaatgaattccgtgtagggaggggggaaaatgcaatgacattttttagctgcggaaaggcaaatcagagaaggctagcggccaaatcccaaagcatcaatcgtgcactcttgttagcactctgaactgaatgtgtcatcccggaggacacattttgtaaaaaaacagta

SEQ ID NO: 49866 - DNA, 410 bp, Zea mays
  Clone ID: LIB3067-058-Q1-K1-C3
gagaaattagctactcgatcactgtagtggtattattaccgaactccaaataagcaatgtcgacaacttcgacatccctcggcctgctaatccgtccgccaagatcatcagctggtacgccgtcctttgggtgtctcaaaccagtagtggtgactcttccttgcgctcctgctgagaagaagcggcctcgatccatctgttactctgtggatgccaaggctaccgaccatgcctttaacatctctcccgttgcccttgtgcatcccaacatgccgccaacgtctacgccacgatgggagatcaaggaagatggcaaagaagtcaggctgacattcttcaacttgtcggacggtgctacaacgggcgacttccaggttgccagtgaagacgatgtgctcatcatcaagagc

SEQ ID NO: 49867 - DNA, 351 bp, Zea mays
  Clone ID: LIB3067-058-Q1-K1-C5
ctcacgcgtccgcatccaccacgcacgacacctacccatacctataccataggctctgtgagtgaacttgtaagctgtagatgaggatgagccagcgagcacagcgaggtacacggagctagctcaacatatcacacggatagaagagcaagacgtccgacggcacctgtacctgcatagacatcgtgctggccattatgctgccgccggttgcacgaatgttcaaggcctgctgcctggtagagttctggatctgacttatgcttacattgttcggttacctaccgggcatcatatacgctcgatgggctatcaccaagttgtcggtcggcgcgttagcattgaatgcgc

SEQ ID NO: 49868 - DNA, 346 bp, Zea mays
  Clone ID: LIB3067-058-Q1-K1-C7
cccacgcgtccgcccacgcgtccgcccacgcgtccgcccacgcgtccgtccacgcgtccggccacgcgtccgatgaagggaagccattgcctctaattcagaaagcttttattggtctgactgctggagcaattggtgcttgttttggtagtcctgctgatctggcactcattagaatgcaagccgactcgaccctgccagctgcacaacgacgcaactataagaatgctttccatgcactctaccgtatcagtgctgatgagggagtccttgcgctttggaagggtgcaggtccaactgtggtgagagctatggcactcaatatgggtatgcttgctttctatga

SEQ ID NO: 49869 - DNA, 436 bp, Zea mays
  unsure at all n locations
  Clone ID: LIB3067-058-Q1-K1-D1
cccacgcgtccggctatcaatgctcctgtacagggcagtgcagctgatgttgctatgtgtgcgaatgcttgagatagacaggaatactcgtcttaaggagcttggttggacgctactcttgcaggtgcatgatgaagtgatactggaagggccttcagagtctgcggagctggccaagtccatagttgttgagtgcatgtctaagcccttctatggcaccaatatcctgaaggtcgaccttgctgttgatgccaagtgtgcacagaattggtatgcggccaaatagacctgttaagtgtcccagaagggcgtcaattccttcggtgaaactcggcggattttgaactggtatctgctggctgctgctagtagcctagtgagctcatctgcacgtggatgccatgcactgattatntcggtgttgatctggacagtg

SEQ ID NO: 49870 - DNA, 425 bp, Zea mays
  Clone ID: LIB3067-058-Q1-K1-B12
cccacgcgtccgcggactcgtgggtttttttttttttttttttttttttttttttttttggtttttttggatgggatgacaaccatattgtttgaaagcttcagagttctgatacagattagtccagattcctgatcaactcaaaacacaagccacttcatatgcactgtgccaccttctgatacaaatcctgtggccaattccggctcatgttgcttgctacaaggtttgcgatctttgatttgacagcgcgcaaggtcccatcagtatctctaacattgtcaatgcaatttagagcaaccttcaggagatctggcacgcaagcttgaacatggggtgacaagttcctgaaaatgtcaacagtcacatttggagccttggggtccaaatgaaggaagggtagcctgatggtttccctcaaagca

SEQ ID NO: 49871 - DNA, 441 bp, Zea mays
  Clone ID: LIB3067-057-Q1-K1-H5
cggacgcgtgggggcgaagatggcgatgaccgtcgaagtgcttgctgcactcgcgttcatgttctccacgagtattctactgcagatactggcatgcgctttgtacaacaactggtggcccatgttagcagctctcatgtacgtccttgtaccaatgccatgcctgttttttggtggtggatccacacacttcttgaccagcagagaaggtggagggtggattaatgctgcaaaattcttgactggtgcgtcggccatgggaagccttgctattccagcaattctgaggcatgctgggctaatcgagaccggggccatgttcatcgagttcacgtccttcttcatccttgtatgcacagtgctgtgcttccatagggcgactctggatgaagactggtaaatgcgcatttcaccgacaccctgaaccctaacgtttcttgg

SEQ ID NO: 49872 - DNA, 305 bp, Zea mays
  Clone ID: LIB3067-057-Q1-K1-H6
gcccacgcgtcgcggacgctgggtggccactcgctgatgcaaactgaaactgggttatggccccgggggaggaggtggcggtggtggtagcggtggacgcggtggttacggaggaccaggctatgggtccggatcagggtatggtgagggccgtggcagcggaagtgctgctggagggtatggacatggtggcggccgcggtggcggtggtggtgagggctcgatagctggtggctctgggtacgggtccgggcaatgatctggctaccgagctggcagcggtgcttgcgggggatattggagtg

SEQ ID NO: 49873 - DNA, 405 bp, Zea mays
  unsure at all n locations
  Clone ID: LIB3067-057-Q1-K1-H7
cccacgcgtccgcccacgcgtccgcgcttggcttgataaccaagggatcgtacaaagctcggcgctgatggagctaggtgctcccgtccatagttttcacaagatgggctgccaatccaagatggtaatgatatgttgagtttggcattccatcaacaaagaaactgtcgcgagatgcattggaggctctggaagtttcacaacaacacacaaaaaaagtcttcccaaaagaagtcccagtcgacctatagctatagtcctcattcttgacgcttcaggttcaagaaaaggaactttatgatggaaaaatggacttcaatctgctcaacccttncatgtactgtgccggccgagatgtgcttggtcgcttgtggttgaaatttcagatcaagagctctggaatct

SEQ ID NO: 49874 - DNA, 443 bp, Zea mays
  Clone ID: LIB3067-057-Q1-K1-H8
cccacgcgtccgcgacagcagccgcatctgtgttttggacaagcccaacataccaaagcctgcaccagagacggagaggctagtcgttatgaggggcgactacagcaaaatggacacatattatgtcatgcccaatgggaagcgtgcaaggtgtgctggtgatgtggataagtttctggaggcaaatccggagtacaaagaccgcatatctgcttcggatttcagctttgcgccacccaaggttgttgaggagactgtttctcacaaccctgcctggcaagctgccaaggccaagaagcaggagaaggcagaagcacaaaagtgaatgatactcccaaccgtgcttgtgtcatgtttaggtgatagtccgctcaagatcatgccccatcctatctagtgtgtacttgtctatcttgactgaagtcgatgtttaggtcttttta

SEQ ID NO: 49875 - DNA, 439 bp, Zea mays
  Clone ID: LIB3067-058-Q1-K1-A1
tgctctcgcagcgtgcgcctgacccgcgtcatggccgctatctcacagcatgtgccatgttacgtggaaagatgagcaccaaggaggtggacgagcaaatgatcaatgtccagaacaagaactcgtcctacttcgtggagtggatccccaacaatgtgaagtccagtgtttgtgatatcccgccacgcggcctctccatggccttcaccttcattggcaattccacctgcatccaggagatgttccgccgtgtgagcgagcagttcactgctatgttcaagaggaaagctttcttgcattggtacactggtgagggcatggatgagatggagttcactgaagctgatagcatcatgtacgatctggggtctgagtaccagcagtaccaggatgccgctgcagatgaagaggaatacgaggactaggaggacgtccatga

SEQ ID NO: 49876 - DNA, 432 bp, Zea mays
  Clone ID: LIB3067-058-Q1-K1-A11
aaatattctatttatgatcaaacagtgtaccttaacgattatcataagaagatgttgaaggatcaatatgagggactgaagacaatcgagcagattacaatggactcagcttcggtcgagaccaatatgttcaagctctgcaaggtgaggtttgttcagtttggccaaaaaggcatcccctacctgaacacctacgacggtcgcgctatccgctacctcgacccgctcatcaaggccaacgacaccatcaagatcgatctgcagaccaacaagatcatggacttcatcaagtttgacgtcgacaacatggtcatggtgactggcgggaggaacaccaggcgtgtaggagtcatcaagaacagggagaagcacaagggcagctttgagaccatccacgtgctgcttggagctttttgctatgtctagttttct

SEQ ID NO: 49877 - DNA, 367 bp, Zea mays
  Clone ID: LIB3067-058-Q1-K1-A12
gcgaaatgttctatttatgatcaaactttgtaccttaacgattatcataagaagatggggaaggatcaatatgagggactcaagacaatcgagcagattacaatggactcagcttcggtcgacaccaatatgttcaagctctgcaaggtaaggtttattcagtttggccaaaaaggcatcccctacctgaacacctactacggtcgcgctatccgctacctcgacccgctcatcaaggtcaacgactccatcaagatcgatctgcataccatcaagatcatggacttcatcaagtttgacttccacaacatggtcatcgtgactggcgctatgaacaccaaacgtgtacgaatcatcaagaacattg

SEQ ID NO: 49878 - DNA, 429 bp, Zea mays
  Clone ID: LIB3067-058-Q1-K1-A2
cgcacccgcgcgccaacgcgctcttcaccaagaccgtcaccaagggcgactgtcttcgacttggggcgcggcctcgtccactttcagcagaacagggggcacggccccgccgccgtcgtcgccgccttcaacagccagctccagggcacgcaggccatcgccatgacgctcttcggcgccgtgccgcccgtgccctccgacatccttgccaaggccttccgcatcagcagcggcgaggtggaccacatcaaggccaacttcgcgcccaattagagatccaacgtctgcattccctggatttgctcaataataaatccccgcggtgtgcatttcgattggatcgtcttcggttggtttgcttcgagacattgctgaccgcgcttgtcactgctaatttgtgcggagcggaggagttgcttgtgctccgat

SEQ ID NO: 49879 - DNA, 467 bp, Zea mays
  Clone ID: LIB3067-058-Q1-K1-A5
cccacgcgtccggctgacccgcgtcatggccgctatctcacagcatctgccatgttccgtggaaagatgagcaccaaggaggtggacgagcaaatgatcaatgtccagaacaagaactcgtcctacttcgtggagtggatccccaacaatgtgaagtccagtgtttgtgatatcccgccacgcggcctctccatggcctccaccttcattggcaattccacctccatccaggagatgttccgccgtgtgagcgagcagttcactgctatgttcaggaggaaagctttcttgcattggtacactggtgagggcatggatgagatggagttcactgaagctgagagcaacatgaacgatctggtgtctgagtaccagcagtaccaggatgccactgcagatgaggaggaatacgaggacgaagaagaggtccatgacgagtaaggtgatcttggaccctgctgcatact

SEQ ID NO: 49880 - DNA, 430 bp, Zea mays
  Clone ID: LIB3067-058-Q1-K1-A9
gataactgtgcaatctgaaaatcaaagtagaaagaagacttttgactgcaagcctcttggtgtcatttgggctcagttccctgagtactacaacgaaaagaacaccataatgtttgatgatctaagaaggaatttcgtcatgaatccacagaacggtctcgtgatcaagccattcaggaaagcgcactcaaacaggcatgatgatcacgagctggtaaagcttacacactacctgctttcgatcggagacctagaagatctcagcaagcttgaccacggtaaatgggagtcctttgtagatgagagcgtaaagagacgcaagcgctcttagtttccgtcagtatagtgactgtcagaaagaaaaacagaacacccattttcttttcttttcagtgctatggatacctcgcagattagagtaaccgaatga

SEQ ID NO: 49881 - DNA, 412 bp, Zea mays
  Clone ID: LIB3067-058-Q1-K1-B1
gcaaccgcttgcgtcagacgcacactgacggagagtgatcactgatttctggtcatggcaaccgtaactgaggaagttgctccggtcgtcaccgtctccgaggagccggcgccggaagcggcgaaggaggtggtggagaagccggaggaggggaagaagcccgacgaggagggtgacgagaggaagaaggccgaccccgccgccgagaaggagaagaaggcgaggaagccgcggagcatgaagcccaagtccgccgggctgcaccacccgccctatttcgagatgatcaaggaggcgatcctgtcgcaggacggcgggaaggtcggggcgagcccgtacgcgatcgccaagcacatgggggagaagcaccgggacgtgctcctcgccaattaccgcaaggtgctggcagtgc

SEQ ID NO: 49882 - DNA, 429 bp, Zea mays
  Clone ID: LIB3067-058-Q1-K1-B10
gtatcctccttgctagctccttgccttgccttgcctttgccttccctccgcgcgaggagaagagccagcggacggacggagcacaggaaagccggacggacggacggagccggacgcgcgagatggagatggcgggggcggccgaagcggacacgccgtcgcaggagccggtgcgcacgggccggagcaacaccatcctgctccccatcggcggcatcctcctggcctacctgctctaccgcttcctccgcccgcgcctccgcggcctgcgcctcgacctgcccgcctggctgcgctgccgccgcgcgccgaccggcgggggcgccgtgctgccctacttcgcgcccatcgccgaccgcctcggcgccgtcgcgctgccgtacctcggcgccttcgccggcccgcaggcggcgctcctcaggttccccg

SEQ ID NO: 49883 - DNA, 341 bp, Zea mays
  unsure at all n locations
  Clone ID: LIB3067-057-Q1-K1-H2
cccacgcgtccgcccacgcgtccgctcttcttcaccttactaacaccgtgctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcngcggcggaccggcaggccacctgcaactgcctcaagagcatga

SEQ ID NO: 49884 - DNA, 452 bp, Zea mays
  Clone ID: LIB3067-057-Q1-K1-F2
cccacgcgtccgaagaactcgaattcttatctatactggaactcagagcataggggggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaccgacctaaaggagaatacttaataatatggcgaaacatttatacaaaacacctatcccgagcacacgcaagggaaccgtatacaggcaagtgatatccaatccacgaaa

SEQ ID NO: 49885 - DNA, 288 bp, Zea mays
  unsure at all n locations
  Clone ID: LIB3067-057-Q1-K1-F3
cccacgcgtccggcgatgcccgtgctcaaggtccgcacccccatccagtgctacgccgactggaggcgcgccttccgcgaccacttcgccaccttcatgggcaacaccatcgtggagatccaggtcggcatgggccctgccggcgagctgcgctacccgtcctacccggagagcgacggcacctggtcgttccctggcatcggcgagttccagtgctacgacaggttcatgctgagtagcttgaangctgctgctgaggccgtgggcaagccggagtggggcaacgcg

SEQ ID NO: 49886 - DNA, 416 bp, Zea mays
  Clone ID: LIB3067-057-Q1-K1-F4
cccacgcgtccgaaactttcatctgactcggatacagaaacaattatctctgtctgagacggagatgtcaagattacctgccatagtgaacgtgttgaaagagacatcattttatcacacaagtaagcttgcagatgctgatatgacattgttggtaaagatattgaagtcttggcctccacaaatgatgtttccagtcattgattttctgagaatgttcgtgttgcatcctgatggagcttctttacttctcaagaccatcgaaactggaaatgatatacttttggaaacctttcgtaaagctgttgcgtcgcctgtacagccagcaaatatgcttacagtcctcaaagctgtgacaaacttgtttggcaactcatgcttgcaccagtggctgatgacccactgtgctgagatca

SEQ ID NO: 49887 - DNA, 238 bp, Zea mays
  Clone ID: LIB3067-057-Q1-K1-F5
cggacgcgtggggaatgcttatgcttcaatgatccgtactcacgttaacttgtcccatgcggcttcacaagtcgcaaccctgcctgctgtacagtagtaaccatgcatgctgtagtctgccctatatgttgacgctgtcgttgtacctggcaacgtgtaattaactgccccggagacatctgtttttgccatctttaaaacgtatggatctcaataatatgacaagagttgcctgctt

SEQ ID NO: 49888 - DNA, 306 bp, Zea mays
  Clone ID: LIB3067-057-Q1-K1-G10
tcgcgaactctatactccataacactattccttttattaatgtcaaaaaactaatactgaacatgtccatcaaaaaaagcgatacatctactaaaacacaccaacaaaatatctaaatcaactgaaatgcctgtaacctgtattatccatagcatagctcactttcaagtattttgctatccttaacattgataagacctctttctttacaccttctcttattccgtattcaatgcatataccttaaatttacccaactttacaggatttccaactgattactttaaaccagattcactttttata

SEQ ID NO: 49889 - DNA, 412 bp, Zea mays
  Clone ID: LIB3067-057-Q1-K1-G11
agcagctcgagcgcgacttcgaccgtctcaaggcctccttcgacgctctccgagcggaccacgacgccctcctccaggacaacaaccgtctccgctcacaggttgtgtcgttgaccgagaagctgcaagagaaggaggatgcgacggagggcggcgccaccgctgacaccgccgcgccggcggtggacgtcgaggcttacctggccgacgacgtcgaggagccagcagagcctgctgcgacgttcgaggtgctgcaggaggtgaagtccgaggacaggctgagcaccggcagcagctgcagcgcgatggtggacgcagacgcgctgctgtacggcaagttcgccgcggcaagtgatagcagcgtggagtcggacttgcacggctgcgatgaccactaccacgactgctggac

SEQ ID NO: 49890 - DNA, 124 bp, Zea mays
  Clone ID: LIB3067-057-Q1-K1-G12
gacccacgcgtcccagcagctctagcgcgactccaactttaactttttccaactccgacactctcacaagagacagcgaattcctacagcagaacaacaacctcctacactcacagcttaacat

SEQ ID NO: 49891 - DNA, 460 bp, Zea mays
  unsure at all n locations
  Clone ID: LIB3067-057-Q1-K1-G2
cggacgcgtgggtgcgttagtagccaggcccaatcttccagcccaaagttccatcccattgctcgctctgtccctccgttcacaacctcctccacgaccgaacgagcagagcagacccttccccctcaccagctccgggttccagcggcggcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaagcgaatgctcatgacccatgttgacctcattgagaagttgctcaactacaacacactggagaagactgagacaagttaagtgagcaagcatatcatgctctgaaagcactactgtttcgcagtatcatatatattgtaggccgtatnngtgttcttctcta

SEQ ID NO: 49892 - DNA, 290 bp, Zea mays
  Clone ID: LIB3067-057-Q1-K1-G3
cccacgcgtccgaaaaaaaataaaaaaaaattttttataaaaaaaaaaaaaaaaaataaaaaaggggggattttaaaaaacattaacaacactaaaaaaaaaacaaacaaaacaaaaaggcccgcttttctattggttcctagcttacttactcttgcttgcatcctaatacctttattctagtgccccctaaatccttttgattggccctttttttccaactttatccctgggaaaaccttttcttttcccactttattcccttttctgcccttgctcctttcccattt

SEQ ID NO: 49893 - DNA, 372 bp, Zea mays
  Clone ID: LIB3067-057-Q1-K1-G4
cccacgcgtccgcccacgcgtccggaaacacatcttcatcgaagacgacgtacaccccttgggcaagcctccgacgcccaagccgaccccgccgacgtacactccaagccccaagcctcccacacacccgacgcccaagccgaccccaccgacgtacaccccttccccaaagccttcgacacccaagccgaccccaccgacgtacactcccacaccgaagccgccggccaccaagctcgccacctacactccgacgccgccggtgtctcacacccccagcccgccgccaccatactactagaaagcgatgcctaccataccacactgctgtcagtctcttgagcatttaagtggtcctgatcaatggaaggg

SEQ ID NO: 49894 - DNA, 455 bp, Zea mays
  unsure at all n locations
  Clone ID: LIB3067-057-Q1-K1-G5
agagcaccgtccatgacgttgtacttgttgtgtggctccactaggatccccagggtgcagcggctgctccaggacttcttcaacggcaaggagctgtgcaagaacatcaaccccgatgaggctgtcgcctatggtgctgctgtccaggctgccatcctgagcggtgagggcaatgagaaggtgcaggacctgcttctgctggacgtcacccctctgtccctgggtctggagactgctggaggagttatgacagtgctgatcccgaggaacaccaccatccncaccaagaaggagcaggtattctccacctactcggacaaccagcccggtgtcctgatccaggtctacgagggtgagaagacccggacacgcgacaacaacctgctgggcaagttcgagctctccggcatcccccctgcaccccgtggtgtgccacagatcaccgtgtgctttga

SEQ ID NO: 49895 - DNA, 451 bp, Zea mays
  unsure at all n locations
  Clone ID: LIB3067-057-Q1-K1-G7
gcgaacccgccggccgctgctccccacagaatttgtcgtacaaatcgagcaaggctcagccacggcccagtctcagtctcatacctcatagagtccaagaattgttgggaattagcagtccgcgcatgcgttcttcctctcctcctagcatcccatctcgtcgtcgcccagcccaccattgttgttgccgttgatatgttcgcgtactgctgctatctatctgtcctccttccaccgtttcttgttgctgatgacaaaggttagagccgtaggtagagatgatatatgtttagaggtgtacacaaggaatngtgactcgacaaaactttctcggcttttcaccatcgtgggaggacgacttggatcgggccaaaagattgcagggccgagacccctctgctcttgaacgatgatgccatgcacgccgtccgtcaaagaagtgatgcaacca

SEQ ID NO: 49896 - DNA, 259 bp, Zea mays
  Clone ID: LIB3067-057-Q1-K1-G8
gaagtgtgttgagctcttctttgagatttctgagaacaaggaggactacaacaagtttgaggaggctttctccaagaacctcaagcttggcatccacgaggactcgcagaacaagaccaagatcgccgagcttctgagataccactccaccaagagtggtgatgagctgaccagcctcaaggactacgtgaccaggatgaatgagggacagaatgacatatactatatcactggtgagagcaagaaggcaacggagaac

SEQ ID NO: 49897 - DNA, 431 bp, Zea mays
  Clone ID: LIB3067-057-Q1-K1-G9
cccacgcgtccgttctacgtgcacttcatgttaataatgagaaggcaaagatgttgctcaaacctgacaaaacaattgttactgaaccacatcatatatggccaactctgaatgatgaacagtggttgaaggttgaatgtgcactaagggacctcattctttccgattatgcaaagaaaaacaatgttaatacttctgcactcacacaatctgaaatgcgagatatcatccttggtgctgaaattgctccaccatcacagcagaggcaacagattgctgaaattgagaaacagtcaagagagacgactcagttaactgctgtaaccacatggacatcaaatgtgcatggagatgaactcattatcacaaccacaagtccatacgagcaacaagcattcgcatccaagactgattggcgtgtcagagccatc

SEQ ID NO: 49898 - DNA, 356 bp, Zea mays
  Clone ID: LIB3067-057-Q1-K1-H10
cggacgcgtgggcggacgcgtgggggggtttttgagttttgacaatcagaacaatagcctgcaccgtccaccctcacgcaactgcctcttcgcggcggcgcaaaacaccaacacgtcttctccggttgcgaggagggtataggatttcgccgcggcgagatgtcggcgtacgacgaggtggagatcgaggacatggagtggaacgcggagctgaaggcgtacacgtacccgtgcccctgcggcgacctcttccagatcacgctcgacgacctccgcatcggggaggagattgcgcgctgcccgtcgtgttctctcttcctcaccgtcgtttacaacgccgaggaccttgctgacgc

SEQ ID NO: 49899 - DNA, 330 bp, Zea mays
  Clone ID: LIB3067-057-Q1-K1-H11
cataacacatacacacgtacaaatattataaatttaaaaaaaatctaaacataacaatagctatgttcaatataaccaaaagcatatacctttgcataatctatgctaaataacttaccatattcatcgaatcatatatagacttatacttatttcttagaaaataatgatccctcgactcaatagatatatattactcacatcattacccatatctatcagcttacacttcaaaaatagactgatctgaccattaacatatcagaacatagatcatatatctgacccatacatacttcgctgaaacaacttgtatttatgcttcatgct

SEQ ID NO: 49900 - DNA, 431 bp, Zea mays
  Clone ID: LIB3067-057-Q1-K1-F12
tcgcccacgcgtccgcgccgtcgctacatcccggtcctagtttcctatcccgtctccgagatgacgaagcgaaccaagaaggccggaattgttggcaaatatggaaccaggtatggtgctagcttgcgtaagcaaatcaagaagatggaggtatctcagcactccaagtatttctgtgagttctgtgggaagtttgctgtgaagaggaaagcggttgggatttggggatgcaaggactgtgggaaggtcaaggcctgtggtgcttacaccatgaacactgctagtgcggtcactgtcaggagcacgatccgtcgctcgagggagcagactgaagcatgatcggtcgcttgtcaggcatactggggtccactatattggctgtgtagccgagacagtacttcagcatttttgggttatgctctaagatctct

SEQ ID NO: 49901 - DNA, 441 bp, Zea mays
  Clone ID: LIB3067-057-Q1-K1-H12
cattcatcctgttaatatccgtcagaggtgttgcccaggaatacagcttggaagccggcaaaaatttgtgattttggtgcttctactgtcatttgttgttatgcttgcctttgccatcctcatatgggttggtagaggagacaatcctatcgattcttctctactgaaaagggtttatttggatgtattttcagtagtagttattgtacttggtggtgctctggcatgttacggtgcagtgttattctcgaagatgagcaaagttcgttctgaaactgtatcaactgagaagtggaaagttgccagtttagctgctgtctcgctgatctgtttctcgtcttctgctatacttgcacttgtgactaatgttccagtgcttttgtattggtattcaacagatgtggacatcatcaacaatgcttgtattttggttatatatta

SEQ ID NO: 49902 - DNA, 320 bp, Zea mays
  Clone ID: LIB3067-005-Q1-K1-A11
caacgacattccgagcccatcattatcacctcatcttcacagcctactaccacgacgcatgcgcgggagatcttttaacctcaggtagcttaatataatgaatagaggtgcagacttcctcgatttacagatatagagtaagcaagcagcagaatctttactctgaatgcgaggtgcaatcttactatgaactatggttttgccatccatttgataagctcgttgatgtcactcgatcattactcgatgatattttggcttctccttatggcgcttcatctggttgatgctattctcttattgaactcgcgtgctcttat

SEQ ID NO: 49903 - DNA, 249 bp, Zea mays
  unsure at all n locations
  Clone ID: LIB3067-005-Q1-K1-A2
tcgccacgcgtccgccacgcgttcgcccacgcgtncgnccacgcgtncgcttcctttttccaacctcaacttctctcaatgcttcttatgagcaaagtgctgataacgtgttgtaaatcagtggtaacgggacacgaaaatgtagagagaaagtgacagttgtattgatctcatgaaatgtgtacatatatatacatagtgaagagacaccacgaaaggtcgcaaaaaaaaaaaaattcnatattactt

SEQ ID NO: 49904 - DNA, 394 bp, Zea mays
  Clone ID: LIB3067-005-Q1-K1-A3
ctcaaatactgatctcactgatccagtatggctatggcaaaggcaggcgcgccgagggtctcggcggcccagctggtggctctcgggctagcgctcctctgcgctgtcgccggcccggccgccgcgcagaactgcggctgccagccaaacgtctgctgcagcaagttcggctactgcggcacgaccgacgagtactgtggcgacgggtgccagtcgggcccgtgccgctcgggcggcggcggcggcggcagtggtggccgtggtgcgaacgtggctagcgtcgtcaccagctccttcttcaacggcatcaagaaccaggccgggagcgggtgcgagggcaagaacttctacacccggagcgcgttcctgagcgccgtcaaggcgtacccaggct

SEQ ID NO: 49905 - DNA, 280 bp, Zea mays
  Clone ID: LIB3067-005-Q1-K1-A4
cgttcgggcatgggttccttttaccctctttgatactgattggatgggccgagaaatctatcgaggaagcccagacaacccatgagagacccaaaggtaccatgatggtgtgagaatgggttcttttggtctaatgctcaactctgtcgtccttggattcacctctgttgtgctagaaaagttatgtatgaagtggggagctggacttgtatggggtgtcttcaatattctaatgactttgtgcttcttggcaatgcttgtgataacatatgttgcaaag

SEQ ID NO: 49906 - DNA, 370 bp, Zea mays
  Clone ID: LIB3067-005-Q1-K1-A6
cccacgcgtccggtggcgttgaaaggaaggacttcaactcatatggtagccgaagaggaaatgatgagatcatggctaggggaacctttgccaacattcgtcttgtgaataagttcttgaagggtgaggttggacccaagacaatccatgttccatctggggagaagcttgcagtttttgatgctgctatgaaatccaagaatgaagggcatgacactattatcctggctggtgccaagtacggaagtggaagctctcgggattgggctgcaaagggcccaatgctgcagggagtgaaggctgtgatagcaaaaagctttgagaggattcaccgaagcaatcttgctggcatgggaataatccctctatg

SEQ ID NO: 49907 - DNA, 371 bp, Zea mays
  Clone ID: LIB3067-005-Q1-K1-A7
caagcaaagcaatcagagccaagcacccaccgtcctcctttctttccttcgactcatcaaagcatgtcttgctgcggcggcaactgcgcgtgcacctccggctgcaactgcggcagcggatgcggcggctgcaagatgttccctgacgtggagaccgccggcgtcggcggcgtgaagcccacggtcctcgccgcccccgccaccaaggcgagcgccggcgggttcgaggcggccgccgagggcggcggctgcgactgcaacacctgcaactgcggcaccagctgcggctgctcctgctgcagctgcaactgagccacccgcgatgaccagacaaccacccgggcttccccccacccatcggactacaacta

SEQ ID NO: 49908 - DNA, 437 bp, Zea mays
  Clone ID: LIB3067-005-Q1-K1-A9
tcgagcgacccgtgacgctctttgagcccctcgtattgcctttcatacactgctagctactatgctccatggggggcagttatttgacatctggcggcatcatctaatggaaagtggtgcagacttccttgatttacagaaatcttataagcaagcatcaggatctttttctgaatggaggggcaagcttactatgaactttggttttgccattgatttgataagcttgttgatgtcacttggtcattactcgatgatattttggcttcgtggtatggcgttttatctggttgatgcaattctcttattgaactcgcgtgctcttatagtttcctttttgaagaggattaaagcttacatcaagttacggaaggcacttagttcactcgatggagcacttacagatgctacgtatgatgaaatatgtgcatatgatg

SEQ ID NO: 49909 - DNA, 195 bp, Zea mays
  Clone ID: LIB3067-005-Q1-K1-B1
tgggccttcatttttccaaccaatgccacaaccttgcaaccagggcaaggggccttgggagggccttaaccagaaggacccgttcccaaggttcaagggttaaaaagtcgttcaagaaaaaaagggtcttgagggtcatttttaaaaaggaatgcaacacaacccgaagaacaactttcctggttaaacttatta

SEQ ID NO: 49910 - DNA, 431 bp, Zea mays
  Clone ID: LIB3067-005-Q1-K1-B10
cccacgcgtccggaagatggtgcgcaaggcgaaggttgagttcgacgagcagccgccggagaacttcgacccgaagaacccgtatgccgacccggtggcgatgctcgagtaccgggaacacctggtgcgagagaagtggatccagatcgagaccgccaagatcatccgggagcgcctacgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagtttgaatgaagtttccttgaactgtggtagt

SEQ ID NO: 49911 - DNA, 354 bp, Zea mays
  Clone ID: LIB3067-005-Q1-K1-B11
gtaagatcagaatttctcagcaccggaggaactgtttcttctctatcttcagcttctaacgaacggtctccatcaagtcagccggtggaaccattctcaaactttggtgccccttttgacaggtaggtctactttagagacgagacatatctcaccaagttcacgtgtgatcagcttaatcattaccgatcagattcagtctacctatgatcttatatactactggataatatcctacattggtgtgtacctttacacgtttatttctactattgttttgctgtctgtctgattgcttattattgtgtttatctatattaaaatgggcgcttcttgtattgtttttatactttt

SEQ ID NO: 49912 - DNA, 410 bp, Zea mays
  Clone ID: LIB3067-005-Q1-K1-B2
aattaaagaagtggtgaaatctggaaagattcctatgacaacttcatggacattagaggaattccaaactgctactctggaggatgatgctcttaaaggaatatcaaccatcaacatcaagcttgtatatgacgatcagcttgaaaggctcaaggaaaaagagcaaaaggacgctaagaagcgccagcgcttgggtgaaaatttttcagatcttttgtattccatcaaagaaatatcagcttcttcaacatgggatgattctaaacagcttttcgaggatagccaaaagttcaaggccttggacagtgagacttatgctagaaagctttttgaaaaatgccgtgtccaccttaaagaaaaggtaaaagagaaagaacctttgaaggaagaaaaaaaagcaaaaagagaga

SEQ ID NO: 49913 - DNA, 176 bp, Zea mays
  Clone ID: LIB3067-005-Q1-K1-B3
ctaggctctctcttgtatcctgtgagaatgcttttctgtgtcagcgtggttgtttttgctctagtaagttgacggataatgatcgatatgcaaattttttttggtgttccatggctctaatacagccagacttcactaggaactgtgtcgctgtttatgttggcagttggttctag

SEQ ID NO: 49914 - DNA, 182 bp, Zea mays
  Clone ID: LIB3067-005-Q1-K1-B4
tcggtcgaagatgctcgagactatcaggtctctgatacagcgcctggagaaagtcgacccgttgaagatgacgcacgaggagcagctctgcttttggatcaatatccacaatgctctggtcatgcatgcttttctggcctatggtctgcacgacaagcgcatgaagagcacggacatgattc

SEQ ID NO: 49915 - DNA, 362 bp, Zea mays
  Clone ID: LIB3067-005-Q1-K1-B5
cccacgcgtccgatcacgcgtacggccacgcatgctcggacgcttgagctcgaatcatgtcgtacaagccggcattgtgaagaaggagcacatcaagattcatggtttctgagcaaccgccgggtccatatcaaaccaaccctgcatgcagggcatcttattatatataatatctgaggtggagcatatctatctggctgtgtactgcaagcaggcctagtacgccgtctgcgcgttcctcctattacacatataggcccctccctgcgtgtatgcttgttaccgtcgtgttcaaccttgtactacgaggctccatcgaacatcgatggcttgcttctttatcagaacatgtttgaataaaa

SEQ ID NO: 49916 - DNA, 411 bp, Zea mays
  Clone ID: LIB3067-005-Q1-K1-B6
cccacgcgtccgcccacgcgtccgcggacgcgtgggctttccccgtgcttctccgccgtcgaggccgcgtcccagtgcgaagagaccacgactcagatggccagccgctgggtccggcccgaggtgtacccgctgttcgcggcaacgggcgtggccgtcggcatctgcggatttcagctcttccggaacatcaccggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactactacttgctactgtggatttt

SEQ ID NO: 49917 - DNA, 461 bp, Zea mays
  Clone ID: LIB3067-005-Q1-K1-B9
ccggaccggaactgcagggtcgactcaagcgacgcgtccacgcgacgcgtccacgcgacgcgtccacgcacgcgtacgcacccttaatggtcacctaacctaggtggtcaagctcaagggcctggacatcaacaccatacagcacaactacacagagtgagagcccctctgctgcaatgtctaccacaacacctttgctgcccgacgggagccatctgattacagataaaaattttactagctgtaaagctctataccaccagatactgccatatgatggtatggttgggtacccgtctttctagggagtttcttttctctctctctttattcttattgttatgtttttcaatagtggagtgtgcgcgtgttgtaatcgtttttacctgcgtttttctctaactagccggtgacctttcgggaagcgaggtgaataaataatgcatctaaaattctttgcc

SEQ ID NO: 49918 - DNA, 442 bp, Zea mays
  Clone ID: LIB3067-005-Q1-K1-C10
cccgagtgcaacgtcatcgaggaggagggcccgtacgaggacctcgccggcgatagcggcctctcccgccgctgccagatcatactcggcttcctcaccttcgtcctcctcttcaccgtcttctgcctcatcatctggggcgccgcccggccgtacgagcccgaggtcatcgtcaagagcttggtgatggacgacttctacgcgggtgaaggcacggaccacagcggcgttccaacaaaattggtcacaacaaactgttctctgcacatagctgtctacaaccctgccacaatgtttggaattcatgtcacttctggccccatccacctgatgtattcagagatcccaatagcagtcggtcagagcttggtgatggacgacttctacgcgggtgaaggcacggaccacagcggcgttccaacaaaattggtcacaacaaact

SEQ ID NO: 49919 - DNA, 419 bp, Zea mays
  Clone ID: LIB3067-005-Q1-K1-C11
aaggagccgcagccctagaaagcctcctagagcaggaagaagcgtctccagtgacagccgcagcagcagttcaccttcccctagacgcggcaggtagaaagaacccgtggcattgtgtatgcggcaggtaaagccttttatcccttgactctatctgtatcgtttgcctgtgcttgtgacttgctgtgagttcaagtattggttcgaggagaagatgagagaacgctacagcaatgctccaaacggatctgctcaacatgcctggtcgaccgccctagtttgtgtggtctaccctagacagaattatctgctgtgttggcttgtgtactttgattgtaccccaagtattttgaagttctgaacttatttctgctaaaaaaaaaataataaaaaatataaaaatattatctaataatttt

SEQ ID NO: 49920 - DNA, 282 bp, Zea mays
  Clone ID: LIB3067-004-Q1-K1-G2
caagatcgatgttctcaagtacagggatcttccgtagccacatccagtccagattgtgggtctgaggtttatacgtgtaaattcttctgctagtgagatcaagatgaagggtacaagagttgcatgaacccactaaccattggcggtcaaatgagttcttttaaatagcttcagattttcttgttatgtaccaaaccggtctgccactagtgcaatgatctcagaaacatagaggacatcttatgaaactatagaagcccatggctgttgttcccaccgtgc

SEQ ID NO: 49921 - DNA, 341 bp, Zea mays
  Clone ID: LIB3067-004-Q1-K1-G3
cccacgcgtccgcccacgcgtccgcccacgcgtccgcccacgcgtccgcccacgcgtccgcccacgcgtccgaggaaggggtccaataaaaaaaaaaatcgccgccgtcgcccagcggaccttctcctcctcttccccgcacgccccgccgctggctgcgtcgggctacaccccgcgccgcgagtacggcctggtgcccatggtgatcgagcataccttccgcggggagcgcgcctacgacatcttctcgcgcttgctcaaggagcgcatcgtatgcatccatggccccatcactgacgatacggcgttcctcggcgtcgcccagctgctcttccttgaat

SEQ ID NO: 49922 - DNA, 355 bp, Zea mays
  Clone ID: LIB3067-004-Q1-K1-G4
cccacgcgtccggcaaagacgaacgaagtatacaaggttgatgagaggggcatacgctggttctacactggtgatattggtcagttccatcctgatgggtgccttgagattattgacaggaaaaaagatatagtaaagcttcagcatggagaatatgtgtctcttggcaaggttgaatcggctctagcaacaagcaactatgtggagaacatcatggattatgccgatccatttcataactactgtgttgccctggttgttccagcgcaccaggccttggagaagtgggctcagaattccggataaactatgaatgctttgcatagctttgccaaaactacctaacaatttatga

SEQ ID NO: 49923 - DNA, 345 bp, Zea mays
  Clone ID: LIB3067-004-Q1-K1-G5
cccacgcgctagatcgcgagcagccgtttttactgttattttttgaagtacatcgggggattcattgatagctaaggattacgagtaattcatgtcatgtcattagggcataaaattaccacaacagtcactcagagcacacacattgagtggtccaaatatttccagctatggaaacttgcagagtaactgatactactacagcaaatagcagcaagttaagctagattgttaggaaagagcacctgcacctggctgtcttcattagtggatatactagacctggtactgaacatgttagccattaccgttataaggtccatgggcaggttgcatttatgtaag

SEQ ID NO: 49924 - DNA, 420 bp, Zea mays
  Clone ID: LIB3067-004-Q1-K1-G6
cccacgcgtccgcggacgcgtgggaaaaaacaaaaaaataaaaaaaaaaataaaaaagggaaaatatggcacccggtgtaaataactcctgcattactctctcttacatgctctttcttttcaccttttcttatgtaccttaccttcattttctatccttatccttacaacaacgtgaccgttatacaactcactgtcctatttttactttcttctctatctcatcatccctttgccatatctttcttttatcctcttgtcctttttcattttttcttttccttttttttctattaaatcccccatttgttcctcctttttttacttttttattatctttatttctctcttttttttcccttcttatttgcttttaatttttttcttcttctttatttctttttttcttttttttttttt

SEQ ID NO: 49925 - DNA, 266 bp, Zea mays
  Clone ID: LIB3067-004-Q1-K1-G9
gcgtgcgacaagtcacagcagacaaaagagccgtgcttttgcacaggccatactgtttgcaagaacgcgtctcatttgacaagtgacagcccatctgttttctgccaccacccgcttcgactaagttatgttcaaactgatagatcccgtcgctgagctcgagctagctcatgactcttatcatcctgctcaatgtgactgaatgccacttccatcagtgcaagcagactggtgcatctatacatgcgcttcatcttgtttaacgg

SEQ ID NO: 49926 - DNA, 266 bp, Zea mays
  Clone ID: LIB3067-004-Q1-K1-H1
aaggcctcagcactgcacattacgtgctgcgatggaggaattttttgagaatttgttttatttcttgtcgtgtccaaaatccacaaatctgtcaataatgataggcaggttcgactgacgtggctgacttggttggccaccggatgttttcttacaacgagtcatgaaccataccgtcccatcttttgttggaagattttactttggcaaataattttgtggcacgttatatgtaaagatggtacagttttagcttcattgtccac

SEQ ID NO: 49927 - DNA, 410 bp, Zea mays
  Clone ID: LIB3067-004-Q1-K1-H10
cccacgcgtccggcgtcccacgttgccttggttcccccaccctgctgtctccctccctccttgcgtccttccccgccactgcgcagcgcgagtgcggcgacagccagtcacacactcacactcactcgaccgctctcagccccgttcgcgtcgccgcatggcgaggaggcaatggcggcgggcgggaatggcaccgacggtgacaccagggcggccttcgcgcggatctacaagacgctgaaggaggagctgctcaccgacccggacttcgagttcaccgaggagacacgcgcctggatcgaccgcatggtggactactatgtactcggaggcaagtagaaccgtctgctctctgtggacgacagctacaagctgctcaagggcgcttatgctcattgcaaggaggaaac

SEQ ID NO: 49928 - DNA, 448 bp, Zea mays
  Clone ID: LIB3067-004-Q1-K1-H11
atccgatctgtttctagcatagatacctgtaaaatgtcggctacgtcgacagcctcagctgcacttgtatcagctatggacccgagcagagccggatgcaaggagcagctggctgcaaggggccggcaatcgctcgaagctacgacagacgcgtcctcgccggcaaggccggctcgcctaggagggccgtgcacgcctatgcgtaccacaagaacctggaggaccagctgcgcccggcgttcgtgccggacgatgtgatcggcagcgcccggagcccagacaagtactggagcccccaccccaagaccggcgtgttcggcccggcggcggtggaccccaagctggccgctggtggcgcgcctgacgccggcgcggatgctgcaagaggcacggtgctggaccagaaagtgtggttccgcccgctcgaggacgtcgagaaagccgcccc

SEQ ID NO: 49929 - DNA, 281 bp, Zea mays
  Clone ID: LIB3067-004-Q1-K1-H12
accttatcacacttaagccactcacatacaaaatttctaacattatcctactcattacacacatatgccacatatgaacaaacgatccattatccagcaaaaaaaaaaaaaaacaataaaaaaaaaaaaattaaatattttaaaaaaatactgttatacatatacaatacattaaattattttaattccctttacttgacccatatggtaccattttaaattatcttactatgcacataaaatctcttatttcactgttcacctatattatccacatgctt

SEQ ID NO: 49930 - DNA, 265 bp, Zea mays
  Clone ID: LIB3067-004-Q1-K1-H3
cacagttccacgcagcagatcagagagtctgcaggtacgctagcgatctagctgccgctgtgctgcgtacagtacgtagtaccatggcgaagaaagtggccactctgctggccctcaacctcctcttcttcgccttcgccgactcatgcggctgcaggtgcggcggatcctgccctagtccaggcggcggtggcggtggcggtggaggatctggtggtggtggtggtggaagctgttggggtgggagttgtgggggttggtcggg

SEQ ID NO: 49931 - DNA, 252 bp, Zea mays
  Clone ID: LIB3067-004-Q1-K1-H4
gatacgcggcctgagaggtctagtgcgcatccaagcagaccagattgacgcagtcaggttcctgccaacacgaagtgactgcaatatcttccacgctagagggattctgtgacagactctatatgatactttaagatgtagactgagcaagttgccgaacatatgaacgcacattatgtctgattcaagaacgatgagagagtcctcgaatcggatctcttcaccgaatccattatccagaccactgaattt

SEQ ID NO: 49932 - DNA, 382 bp, Zea mays
  Clone ID: LIB3067-004-Q1-K1-H5
gacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgttcttctcgtgggcgacgacccttggcagtaagcactgcatgcgacgttgattcttttttttttctgcattcttcctcacattgcgttggcaacccaaccccacagggaattcgtgagcacggtgttctgcataaagatccttctcccgcatgatgtgcatcagatggggaagcatggcctgg

SEQ ID NO: 49933 - DNA, 430 bp, Zea mays
  Clone ID: LIB3067-004-Q1-K1-H9
acggccacgcgtgcgcccacgcgtccgcccacgctttcgtccacgcgtgcgcccacgcgtccggggagatcaacgtcgtcgttggggccagccatcggtagagccggtagtagagactacgaccgaggctagctaagctaagagatggcggatcaccagtactcggcgtggacgacttccgctgctcgtcatcgggtcttcttctgtgcgctcatggctcttgttagttttgtggctgcaggacgacccattgtgctcgccgacgccatcgtctttcacgtggcgaacaggtgcccgttcccggtgtggccggcgtccgtccttaacaccggccacccagtgcttgccggcggcggcttttacgtcccgcaaggcaagttgaggcgcgtcgtcgcgcctggcaacttgaacgggcgcttttgggctcgta

SEQ ID NO: 49934 - DNA, 175 bp, Zea mays
  Clone ID: LIB3067-005-Q1-K1-A1
gaggagttttgcaacataatgcgcaagatctacatttaccccaagggggaggtccagaagatgaacttgaaatcattcgtgcccaggaaggaggaaccccaagcagcaggcgaaagctgagccgtcgacggcgcaaaccagtaggatgtctgcctgcactggaacaagcaatttt

SEQ ID NO: 49935 - DNA, 385 bp, Zea mays
  Clone ID: LIB3067-004-Q1-K1-G12
ccgccttccagctccccgtactactttccaccgtcttctgccgcctactcggccctgcctcaggacggatctgaccagttctatcgccctagtggatactactctgcacctgcacctacaccacatccgtatgagtacaccggagggccctctgcaccggtggactacaacaggcaatatgagcagagagggagggctggagccgcttgtagtggcacaggtaacggaatgtatagagcaggcactgcgctagcgggagatgctgaggctgaagcccttggagacctagcagatgtacatgcttaaggtgctgaagcaggtgcacgtgcacatcggcatctcgtacaaggccatgtccatcatgaactactttatcagcgagatt

SEQ ID NO: 49936 - DNA, 444 bp, Zea mays
  Clone ID: LIB3067-005-Q1-K1-A10
cacagtcctctaagcagatccccttgttgctcagcatcgatgaacaagacaaagcattatcaaaggcaattgaaagtggcgataccgatcttgtgtaccttgtgctattccatatttggcagaaggtagctgtagagaagaaagctcctttggatttttttggtgttataaatgcaaggcctgtggctagagatttgtttatggcatatgcaagacattctaagcatgaagaattgaaggacttctttttatcgactgggagacttcaagatgccgcctttcttttgttgaaggaatcatgggaattggagaagaaccccatggcaagcaaggggtctcctctccatggtccacaagtgaggctcattgagcaggcccatagactttttgctgaaaccaaggaacatgtttttgagtccaaagcttctgaagagcatgccaaat

SEQ ID NO: 49937 - DNA, 176 bp, Zea mays
  Clone ID: LIB3067-004-Q1-K1-E1
tcgtcagattggagagggagacgaggtgggtgtcctaggggagagacccagttagctgcaggggtaggtcgtgttcggcgtccgtcttcggagagttccaagagattggtggtgcggctgtgggttccaagtggatccaccacatccagcgcctcattttgttcaatgtgtttgtt

SEQ ID NO: 49938 - DNA, 214 bp, Zea mays
  Clone ID: LIB3067-004-Q1-K1-E10
tcggccacacgttcgagcgcattcctactcgcttttaaacatcaacaggccgtacacacgagcggtcacatgcatgcattgaggcgatcactgtcttgctaactatgatatatttgcacggaagcatcaccacatatatgatgccactctacgttagtgctctcgctatggctaaaaggatgttgcactactgtacatagtgcaatctcttaca

SEQ ID NO: 49939 - DNA, 161 bp, Zea mays
  Clone ID: LIB3067-004-Q1-K1-E11
catgggtatccgtctgctcagttaaatgcgctgcattgatactacgctatagcatacccatgcggcgaccattatggactgtggatcgatggatgctgttactcctgtcaggatttgttctaagttaatcctaaggaaaaaatggtgcttcttggtgctgc

SEQ ID NO: 49940 - DNA, 318 bp, Zea mays
  Clone ID: LIB3067-004-Q1-K1-E12
gatgaatgctagcccggactgtgacttcgcccgattctgcgaccgcaagtacagacagctgatccatccaggcttggagtcctaactgatcgggacctcggattgcggaacactgccggtggtgagcgtggccggccaactctacgagctgttcgtggcaatggcaagctcgatctggacactccacaggttagcatgggcatactaccccgcagtcggcatattccaggtcggccggtgcgcatagttctcgacggtgtacatggagaacattgtccggtcgaagaagcgttttgctgagagcaaggagccccggaa

SEQ ID NO: 49941 - DNA, 131 bp, Zea mays
  Clone ID: LIB3067-004-Q1-K1-E3
gtcggaagaacaggaagcggcatatcatttctcatacaggccctctttcgtatcgtgggggcgactatcgtccagagactaatatacggcgtctacttctgcaccatcggtctgtatgatctgtgatctta

SEQ ID NO: 49942 - DNA, 424 bp, Zea mays
  Clone ID: LIB3067-004-Q1-K1-E4
gaatcacacaacagcagctcaaaaaacctttcacacctcaacaagcagagcatagacccgggattcgtcggcgcggtagcgagagctagagatggacggttggatgttctgtttctagacctctctgtttgtggcgctgtatctccttctggacgtgctcttctgctactcctgctctgtctgttttctttcttttgtttgtttttttttttgttgtcttttattttctttatatttatttttactttttattttattattttttttttttatatttttttttttttttattttttttttttttttttttttttttttttttatttttttactttttttaattttagttttattttttcttttttttatttcttttttttttgtttttcttttttttttcttttttttttttttttttattttt

SEQ ID NO: 49943 - DNA, 272 bp, Zea mays
  Clone ID: LIB3067-004-Q1-K1-E5
cccacgcgtccggggacgcgttccacctcacggagagggcaaaccgcatcatcgtcgcccagttcatgcacggcgacaccgactacatgcaccccatgaacctcagcaccatcctcgccatggaccaggagggcctctagactatagctcgatcagccggacacgattatacgtacatgcgtgatgtgtctcacgtgcctagcacgttagtcatgtgttggatgatggcagcccaatttgccaataatattcgtgcctcgatcctagtttca

SEQ ID NO: 49944 - DNA, 52 bp, Zea mays
  Clone ID: LIB3067-004-Q1-K1-E8
tcgagcaaacaatagcgagcgagagagccttttagcctagagactagccagc

SEQ ID NO: 49945 - DNA, 169 bp, Zea mays
  Clone ID: LIB3067-004-Q1-K1-F1
tactcggttccggatacccggctggactccacgcgtccgcggacgcgtgcgtttacgcgttcgtggttgcgtgataattgccaggcaggcaggtcgtgcaggagggcaagaagaccgaagaccgatccgtgcgggggctcgggactggaactgtacatgaccccaaaat

SEQ ID NO: 49946 - DNA, 90 bp, Zea mays
  Clone ID: LIB3067-004-Q1-K1-F10
gcgcacgcgtacgccacgcgttcgaagaaggcacttcatgtgacatttaaaaagcctagtgggagtgttagcttatctgggcacgggttt

SEQ ID NO: 49947 - DNA, 310 bp, Zea mays
  Clone ID: LIB3067-004-Q1-K1-F12
cttcagagaagtgccgtgccagtgccaccgccggccgcatcatcgttccgcccccctgagtgttgagtaacttcttccgatccagattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatctatcttctttgtggtcttctcttacctggtccttgttctgctgttctac

SEQ ID NO: 49948 - DNA, 444 bp, Zea mays
  Clone ID: LIB3067-004-Q1-K1-F2
ctctccctcaaccgccgcctgctcctccgtcgcgattccgacacacccgcctgtgttagccccggagcaggccgcgggcactggaggtgggaggcggtggctggggtcagggggttgtggctctgcgccgccttcctcttcgcctactagcatgctcgccttctcatctccatccagcgagaaggatggtttattatatgcatacttcctagctttgtgattctgtgtcttttcttttttgtttgtctatcttttttttcttattcttgttgcttttctgtgttttcttttttttttgtttgttttttttctttgtcttatttattttttttttttatcttttttttttgttttttttctttttttgtttttgtttattttctatttttttttcttttttttttttttttgtgttattttttctttttttttttttattttttt

SEQ ID NO: 49949 - DNA, 324 bp, Zea mays
  Clone ID: LIB3067-004-Q1-K1-F3
cccacgcgtccgcccacgcgtccgaagagggcaccggtaatgtcaacgacgacggaggcggcaaagagcggctcagccgcaccggtgcggtgccagcggatcggctgcgacgccgtattcaccgacgatgacaaccgcgagggctcctgccaataccaccccttcgcacctatgtttcatgactgcatgaaagaatggagctgctgcaagcaaagaagccatgatttcagcttatttttgcagatacctggatgcacaacatgaaagcatacaaccgaaaaaccaatcacaaaagctgtatcatctaaccgtacaaaggcaaca

SEQ ID NO: 49950 - DNA, 88 bp, Zea mays
  Clone ID: LIB3067-004-Q1-K1-F4
cggacgcgtgggtgagtgcacaagaatgtctccagcgaaaaaagacatattagtaaataggaataataataaaaaaaagaggaataaa

SEQ ID NO: 49951 - DNA, 354 bp, Zea mays
  unsure at all n locations
  Clone ID: LIB3067-004-Q1-K1-F5
atcaaggggaagggaatgattcagggtatctctgcagttggtgcattttttgagctgcttagtcaacccagcttaagtgtgcagcacccagaagaaaacaagcaggttgctccagctgagctatgcccaatcctgaagaggctttacagaatactgataaaaagggagctcccagcaagggacattcttcaagccctgagggacgaaacgatgaatgatcctcgggaaaggattgagatggcacaaagccatgcattctacctgccgtctttccttggaaaaccatgatctaantagtcttgtagattattagaatattaacggacgctgtgcttcatgttttttcactgtgct

SEQ ID NO: 49952 - DNA, 449 bp, Zea mays
  Clone ID: LIB3067-004-Q1-K1-F6
ggagtttctcaatgctgctgatgacaagcggaaggaagtcctctctaaaatagaagaggatgttgctaagctcagcggttctgcagccaagcatggaatgatatatgtgacatctgtaaagatgatcatagacaagggctttgactacacttataaggttactgataggcttcaccttatgcttgagatgtctattatttctttttaagctctttaatttattttttataatattttttttttatttttttttttattttttttttttttatttatatttgtttttttaattttattatattgtttttttattcttttttattattttattttttttttttatatatatttttatttttttttatttttattattatatttgtttttattattttttattttttatacttttttcttttatttatttttattataatttttttttttta

SEQ ID NO: 49953 - DNA, 330 bp, Zea mays
  Clone ID: LIB3067-004-Q1-K1-F7
caggtatccaataatcttctatgggagtgcagtcttatatgttactttattgatagagatgtcttgtttttgaatctcatgataaagcttaccttggtttgatggtttcagttagcataactctctgattccatcgacttgctttaaggaaaaaagaattgcatgcatgtttcagcagtaccaactatactaagttactaacttatgtggatatgaaccttctatgcatttgtttttgtagaatttgtaagaaatatccgttttgctgttatttacttttgcttattattgtatgaagtttgaatggatgtgaggccctgtaatattctt

SEQ ID NO: 49954 - DNA, 435 bp, Zea mays
  Clone ID: LIB3067-004-Q1-K1-D9
aagataaacaacccacattatctgtatcggatgaccactttgcaagctatttctttgctagctcctgtcatgggtcctgatatcacatgccaacagttgctccctgtcgtcattgcttcttcaaaggacagggttccgaacatgaaattcaatgtcgctaaagtcctgcaatcacttgtaccaatccttgatcaatctgttgtggagaagacagtgaaaccatgcttagttgagctcagtgaggacccagatgtagatgtaagatactacgcacaccaagcccttcgggcgtgtgaccaaatggtgatatctagttgactagcctgtccaggaattaacaaatgagatacatattggtctattctttttgaacattttaaagtgttatgtagtcttaaaaataatgtaccaccaatgacgttgatgcatcttttt

SEQ ID NO: 49955 - DNA, 260 bp, Zea mays
  Clone ID: LIB3067-004-Q1-K1-F8
ctgacgatgacggccggcgcgaacagcctgcacccgccggagtgcagcgtgggcgagacctgcgagaaggcgacgtcgtaccagttcgcggtgctcttcgtggccttcgcgttcctggtgctgggctcggcggggatccgcccctgcagcatgcccttcggcgccgacctgttcgaccccaacacggagtctggcatgcgcggcatcaacagcttcttcaactggtactactttaccttcacggccgtcatgattgatct

SEQ ID NO: 49956 - DNA, 167 bp, Zea mays
  Clone ID: LIB3067-004-Q1-K1-F9
attcgtccacgccacgcgttcgctcagtcggcagtgctgtgttcattctcggctccagcatacccatgcaggaaccatcatggactgtggatcgatggatgctgttactcctgtcaggatttgttctaagttaatcctaaggaaaaaatggtgcttcttggtgctgc

SEQ ID NO: 49957 - DNA, 413 bp, Zea mays
  Clone ID: LIB3067-004-Q1-K1-G1
aaactggggcaagatcagggcgtctttctttcccctgtttttccaggttggatgacaacgatttctctcttgcagtctgtactcttgtgtaccatggctctccgtaagttgtgaaagcatgagcacctatttccacctttgatggccaagaatctcattgtagctctgctgtaccatgtataagctgttattaactagtggaaagcagcacgaaaaaaattctgaagggagtgtgaatcttggtgggtcatctgtgtacctgtgttcctgataaatgctctcgattaagcatgttgatctttaaaatatttttgattttcatatattttatttaattctttttttatctttatctagtttctttatgttagtatattgttttttttttttttttttttatattttactctttt

SEQ ID NO: 49958 - DNA, 448 bp, Zea mays
  Clone ID: LIB3067-004-Q1-K1-G10
agccacgcgtgactccatgtagaagacgacgtttaaggcgaattatcaatctggctctaaaatcatcaggctgggcgatcgacatgtttaccggactctctccacaaacaggatccacaagtgctggctccacacaagcaaccatactacaaagacattcaaatgctcagggtaccttgggctcatggaggtctgaatgtatcatccaaaagattgatgatacttgctcatggcttcgaaggctactaagaaggcctgaaattgatgacactgaagcatgccttaacatggagctaattgagtcaacagccacagaaaaatatgttttgccttctccttcaaaaccttcttcaagttcagtagtggaggacatcaattttgtaacatccttcacacttccataaacagtaatattatctttatttgttgagaactgctttgcactgtt

SEQ ID NO: 49959 - DNA, 294 bp, Zea mays
  Clone ID: LIB3067-004-Q1-K1-G11
gtcggacaaaaactgcaacagcagtccttcctactgaattggagcagaagaacggagaggtcgaggaaaagtatatcaagcgactaacgacatttgtagaaaaacagtgctataagctacaagacttgctagctcggattgcagatggcggatcagaagtactgagaactgacgactttacgtgctcataatctggtcttatactgagcgctcatggatcttggtagctgtgtggctgcttgacgacccattgtgctcgacgacgccatcgtatttcacgtggcgaacatgtgc

SEQ ID NO: 49960 - DNA, 416 bp, Zea mays
  Clone ID: LIB3067-035-Q1-K1-F1
gccacgcgtccgccgtcccgtgctccctccgctaggtctcccatttgcttccccacctcgggggtcggctcccccagagagcaggagccgcctcgtccctgccggtcccgaccatcgagacgatgctgtccaacctcatgtaccggttcgactggcagctgccggcggcgatgaaggcggaggacgtggacatgaccgaggtgtttgggatcacggtctcgaggaaggagaagctgctcctagtcccacaggctgcgtgatgatgatgataatctagtgcaatgcaatacacggttttaaattactaacaccaaaggctgtgttactggaccttacataataaataataaatgtgctactactatatagccaggcttcacagtaacacatacttctattgcccatgctacatatat

SEQ ID NO: 49961 - DNA, 440 bp, Zea mays
  Clone ID: LIB3067-035-Q1-K1-F10
cccacgcgtccggccatctactcttagaaggttcaaagagagagacagaggataagatagggccacgagaaatcgatgctgatgactccgatgtggagcctaaaagcgatgacgagagcgatgaagatgatgatgacgacgacactgaagctctaatggcagagcttgagaggattaagaaagaaagagccgaggagaagcttagaaaggagcggcaacaagcagaagaggaggccaagatgaaggaggctgaactgatgcggggaaacccgttgattaatatcaacaatgctggctccttcagtgttaagagaaggtgggacgacgacgtggtattcaagaatcaagcacgaggagagaccaagacaccgaaacggttcatcaacgacaccatcaggagtgatttccaccgtaaatttcttcagaggttcatgaagtga

SEQ ID NO: 49962 - DNA, 169 bp, Zea mays
  Clone ID: LIB3067-035-Q1-K1-F11
aaaaaaaaaaaaaaaaaaaaaaaaaaaaaaaataaaaataaaaaaaaaaaaggggcacactctggatagaggtaaaattttacgcacgctcgcatgcgacgatatatctcttatattgtgtcccacatataaaatactgtggacggattttcaaaacgatgactctgaa

SEQ ID NO: 49963 - DNA, 123 bp, Zea mays
  Clone ID: LIB3067-035-Q1-K1-F2
cgcgagccgttcaatcacaacaattatcaaacagttaaatcttaattctgaaatcctgacctcatagccggggtcctcttcatactctggcatgccaaattattcttaaacgttaacttcccc

SEQ ID NO: 49964 - DNA, 342 bp, Zea mays
  Clone ID: LIB3067-035-Q1-K1-F3
ggaaggtgttcaggaagctcttaacttgaatgaatctgaattgcatggtcgccagattaagggcgccccaaagaggactaatgttcctgggatgaagcagcgtccaccacgtgggtataatccataccatggctacccttatagatcatacggggcaccgtatttccccccatatggttatgggagggctcctagattccgccggcctatgcgctacagaccttacttctgaagtacggggtagggtaatgaagttcaatgcaaaaccagcccatggtcactggtcagtcccgggaataatcaactgtatcgtttgcactggtgcggctcaatgctcctgta

SEQ ID NO: 49965 - DNA, 401 bp, Zea mays
  Clone ID: LIB3067-035-Q1-K1-F4
gaaatattacaagcaacacttggcaaagcgtcttctttctgggaaggctgcttctgatgatgctgagagaagcatgcttgtgaagctgaagacagaatgtggctaccagtttacttcaaagttggagggcatgttcactgatttgaagacctctcaggatactacacaagggttttatgcatctacttcctcggagctgccggcagatgcccccacaatgtctgtccagatactcacaactgggtcatgggcaacgcaaacctgcattacctgcaatctccccctgaaattgtttctgtctcagagaagtttctggccttataaccttggcccacataatgggcaggaggctaacatgggaaaaaaacattggggaccggttgcattaaagttacatttgg

SEQ ID NO: 49966 - DNA, 271 bp, Zea mays
  Clone ID: LIB3067-035-Q1-K1-F5
gcaaggcgttcatgaagctctgaactcgcatgtatctcaactatatggtccccaaactaagggcgccccaagaaggactaacaggtttcggatgaagcgatgtggcaccactccattgtgacgcataccatcaataccatgtaccagcatgactggcaccttatttccaccaatatggctatggaagggctcatgaatgacgaggttctaagcactacctacctgaatgccgaagtactacttaggccacaagatgtcaatggatgacgat

SEQ ID NO: 49967 - DNA, 362 bp, Zea mays
  Clone ID: LIB3067-035-Q1-K1-F7
cagcaaagcataatgatatttccgctgtacgtcgaccctctacaggagagagacgtgcttttactagagatggtgttctgagaactgatgtgaagacacctagtaaggcatgagcaactgtggctcattcgatgagtgaaatgactacagtgggcaatacgagaaaggctatcactccaaatgcagctagaagtagcaagctggaaacataaagcaataactacagactgaagggaccttcagcattggatagccactctactaggtcaaacagaatggacttgcaagtgtctggctagcagaaatcgagttctgtgaaccttcctacaaggaaaattttcagttctactgctggagatcca

SEQ ID NO: 49968 - DNA, 224 bp, Zea mays
  Clone ID: LIB3067-035-Q1-K1-F8
acggtagattgctatgatggttgagatttactcttgaaccaaagatgttctatcttatatcctgaattagttatcccaaaaaaaaaaaaaaaaaaaaaaactaccaaaatactacaacataattaaaaaaaattcaccaattaaaaaaaatcttatagataatacaaaaagagcttattcattctactacctttttaaaaaaaatatgatgcccccacaaagta

SEQ ID NO: 49969 - DNA, 105 bp, Zea mays
  Clone ID: LIB3067-035-Q1-K1-F9
cggacgcgtgggctgattttcccttttcaacagttgtcgtgaggctgtatcgtctggagtaaaaaaaaaaagctaaaagccggcactaataatgatattaacttg

SEQ ID NO: 49970 - DNA, 288 bp, Zea mays
  Clone ID: LIB3067-035-Q1-K1-G1
acgcatcaaagcataatgatatttccgttgtacgtcgaccctctacaggagagagacgggcttggactagaaatagtgatgtgagtactgatgtgaagacacctagtaaggcatgtgcaacagaggatcattcgattagtgaaatgtctacagtgggcaatacgagaaaggctttcactccaaatgcagcctagaagtagcaagctggaaacattaagcaccttactcatactgaagggaccttcatcattgaatatccagcttactaagtcaatcataattgacttg

SEQ ID NO: 49971 - DNA, 434 bp, Zea mays
  Clone ID: LIB3067-035-Q1-K1-G11
agaaaaaccacccactcccatgttcgaccagtccccactctcctctcctccctgcgcatggatagccatgccgagcacctcgccagaaccgtcgcagcagccagagcccaccgtctccatgaatccagcggttccagctccgcccacccatgcagcgcgcctggtccctgcctcgtcctcgccctggccccaggtcgcggccaagtccggcgagcctggcatcccgacgcgggtgcacacgagcccgacgtcccggcgagccgtcctccctgtccctacgtatggctaggctcccctgcagcgcggacaggaggccatggcgcgcggctgagtgcccctgcgcagcggcgtcacgaccagcccctttcttctctgccatatacccctcttgctgcaagttgaagaaccggtcatggaggagaaaatagcctgag

SEQ ID NO: 49972 - DNA, 429 bp, Zea mays
  Clone ID: LIB3067-035-Q1-K1-G12
cccacgcgtccggggtgctggcctgcatggccgtcgcgggctacctaatctggcgccacgagggccccagcgccgaccggcgtcccggcggctcgggctcgggggcggggctgtcgtccccgggcgctgcggctgactgcggcaaggagaggtgtcacggggtgctgtacgacgacgaggcgtggcggccgtgcctccgggacatccacccggcgtggctgctcgcctacaggctcatctccttcttcgtcctcctcagcctgctcgtcgtcattgtcatctgcgatggctgcagcatcttctactactacactcagtggaccttcattctggtgactatttacttcgggctcggcacggccctgtccatctacggctgcagcaggttcgccgaggagaacgtcgccgcggcggcggcggcggcagaca

SEQ ID NO: 49973 - DNA, 347 bp, Zea mays
  Clone ID: LIB3067-035-Q1-K1-G2
cccacgcgtccgcccacgcgtccggggagagggaggccttcgctacctccgtggcagcgagagacgaccatgaaggcgctggtggtgacggtgcttctcctcctctcttccaccctcgccgcggcacagtggtgcgtgtgcaggcaggacgcgtctcaggccgcgctgcagaagacgatcgactacgcgtgcgggtcgggggcggactgcaactccatccacgagacgggggcgtgctacaaccccaacaccgtcgcggcgcactgctcctgggcggccaacagctactaccaggacctcgagcgcggcgagctgcgccgtggcgcggctgagtttgcggacggcga

SEQ ID NO: 49974 - DNA, 153 bp, Zea mays
  Clone ID: LIB3067-035-Q1-K1-G3
aaaaaaaaaaaaaaaacaacataaaaaaagaattaaaatctaaaaataaaataataaaaaaaaagggacaaagagtgaaagcgctttaggggatccaggttctcgtactctcttatactatatccaaggtacagtatagcgtatcctaacttc

SEQ ID NO: 49975 - DNA, 298 bp, Zea mays
  Clone ID: LIB3067-035-Q1-K1-G4
caattgttcaaagcatggaccttgtataattacatgtttttatcatagatagattaatttctgaaatgcccatagattggtatatttgtggaaatttatttgccaactgtaagcccgtcgtgatgcatagaacatttgtggtataagatttttctgttgatgtttgcaggttatttttccagcacttgacattcgagtgaaaaatgtcgcaaggacatattctcttgaacataaaggagaaaatgatctcttcgcacatcagacaaggcttctactctttcagaggaaagtcattttt

SEQ ID NO: 49976 - DNA, 440 bp, Zea mays
  unsure at all n locations
  Clone ID: LIB3067-035-Q1-K1-E9
cacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccaatggctgntctttctgctgctgatgcttccccggtctcagctatcgggtttgagggctatgagaagcgccttgagatcacat

SEQ ID NO: 49977 - DNA, 374 bp, Zea mays
  Clone ID: LIB3067-035-Q1-K1-G5
gatccgcaagtaccagaagagcacggagctgctgatccggaagttgcccttccagcgcctggtccgtgagatcgctcaggacttcaagacggatctgcggttccagagccacgccgtcctggccctacaggaagccgtcgaggcctacctcgtcggcctgttcgaggacaccaacctctgcgccatccacgccaagcgcgtcaccatcatgcccaaagacattcagctcgcccgtcgcatccgctgcgagcgcgcgtatgcgtatctcgcgctcggccccagtggccgcggagggatggaagaaggcaatttgtaaccttatgctgtttgttcgcttttagacggcgtggtgaagaactagtgtaaaaacggct

SEQ ID NO: 49978 - DNA, 459 bp, Zea mays
  Clone ID: LIB3067-035-Q1-K1-G6
gaatatgcagctgttgccagagttcttgcaagttgaagcttttgctaagttcagtaatgctattggaaaggtgatagaagcccaacctgacatgccagttgttggagccataactctatatgtatcacttctgacctttactctccgtgtacatcctgatcggcttgattatgttgaccaagtgctgggtgcatgtgtcaagaaactttcaggcaaggcaaaacttgaagatagcagggcaacaaagcaaattgttgcacttcttagtgctcccctggaaaaatatagcaatattgttacttcattagaactttcaaactatcctcgggttatggattatcttgataatgctacaaccaaagtgatggctgtggtaataattcaaagcataatgaaaaacacaacctgcatatctacttctgacaagattgaggcactattcgatttaattaaggggct

SEQ ID NO: 49979 - DNA, 359 bp, Zea mays
  Clone ID: LIB3067-035-Q1-K1-D10
atgatgaccttgaggttgttggtgttgtgactctgcgtgatgtgatctcatgctttattcatgagccacccggttattgcgacaactatttggcttcagcgatggagaagcttgaggggaaaggagtcagatcagtggagaaaatttgagcttttctgtagcgtgaatgttgataataacaggtcagtatgtgaggaaggtttatttggttggaacggtgcattcgtgtcgtgttaatccagcaaatcctgtgtaggttaagtaacaaggcttctgtgctgttaaaaatattttactatgtcatttctttggacggttttctgaacaaatgtgtggtaaccattaggccttgttcggtt

SEQ ID NO: 49980 - DNA, 442 bp, Zea mays
  Clone ID: LIB3067-035-Q1-K1-D11
cccacgcgtccgcccacgcgtccgcgagattatcaagaggaagaagaagaagatgggcctcggggagaagctcaaggagaagctgccgggccacaaggacggccaccacacggccgcaccgtccccggcgcccgcgcccgtggagacgcatgcccaccaccaggaggaagcgcacaggccgcacgtcgtcccgaccccggccccgccgccttcaccgcacgtccaccagcacgaccacggcgtcgtcgtccaggacgacgtgaagaccgggaccccgccgcatgcaccggatgaggagaagaaaggcctgctggacaagatcaaggagaagctccccggtggccacaacaagaagcctgaagccgctgccgctgccgcaccggctccgtccgtccacgcgccggcgccggcgccgcacgcggagaacgtgagcagcccggat

SEQ ID NO: 49981 - DNA, 173 bp, Zea mays
  Clone ID: LIB3067-035-Q1-K1-D12
cggactcgtgggctatctgccgctccagcctttcgctttggtttatccaccgactgctcgggcgacggctgcatgatggtgcaacgtctgacctacctcaagctgcacagctattccacttagtccaaccaatcacattttcgacaagaaccctgttggccagctcgaatacc

SEQ ID NO: 49982 - DNA, 446 bp, Zea mays
  Clone ID: LIB3067-035-Q1-K1-D2
cggacgcgtgggcgcgcacccggttccgcgtgcctttccccacctactctcgcggctctcggcagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcaactgtctatctgtgttgcgcttcactaagtgtgattgtaacagtggtaccttctgtggtctgtgttccgcgaagttgcaattgggtgctcgatcgaaagatgtt

SEQ ID NO: 49983 - DNA, 228 bp, Zea mays
  Clone ID: LIB3067-035-Q1-K1-D3
ggattttctcggtacatgaaaaaattactgtatattaaaacccgctcagctcgggtttcaggtgctccccgtgcttcacgggaatttggcgacaaaaaaaaaaaaaaaaaaaaaaataaaaaaaaaaaaaaaataaaaacaaaataaaaaaaaaaaaaaaactaaaataaaaaaaacgacgtgtaaattactattatatataaatacaaaatcgcatagataagaaga

SEQ ID NO: 49984 - DNA, 226 bp, Zea mays
  Clone ID: LIB3067-035-Q1-K1-D5
gcgtcccgtcgcttccgggtacgtataactcgtacaacgacgtatctaccttgagcatcagctgcgtgcatttacgacactatgcgaacagatcatatgattgcggctatatatatatctatggctcgggtgtaacaataatgaccgctacatttcagagctatagtactatgacgtgaatcatatatagtcagtatatatacggaaggtctgctcgccgtactac

SEQ ID NO: 49985 - DNA, 456 bp, Zea mays
  Clone ID: LIB3067-035-Q1-K1-D6
atgctttcttggcatcagaggccatcatcaagcagattccccgtctccttggtcctggtcgcaacaaggcaggcaagttcccgaccctggttactcaccaggaatccctcgagtccaaggtgaacgagactaaggcaacagtcaagttccagctcaagaaggtcctttgcatgggtgtcgccgtcggcaacttggcgatggaggagaagcagatccagcagaacatccagatgagcgtcaacttccttgtttcccttctgaagaagaactggcagaatgtgagatgcctgtacgtcaagagcaccatggggaagccatacagggtgttctaagtctgctcttttgtgaagtctgctaggttctggcaccgaggttttattgaattaaactcttgttaagagtatgtttttggacgatcctatatttcgtcctggcgctactatgtttcaaaatggt

SEQ ID NO: 49986 - DNA, 451 bp, Zea mays
  Clone ID: LIB3067-035-Q1-K1-D7
gcttcatcatctacaggatcgacgagaagaagaagatggtggtggtggagcaggtgggcaagcccgtgctcggctacgacgacttcgccgccagcctccccgccaacgagtgcaggtacgccatcttcgactacgacttcgtcaccgaggagaactgccagaagagcaagatcttcttcatcgcctggtctcctgacacggcgcgcgtgaggagcaagatgatctacgccagctccaaggagaggttcaagcgggagctggacggcattcaggtggatctccaggccaccgactccgccgaggttggccttgacgtcatccagggccgtgcaagctgaggatgcccagcgatgaactgcccatgccagaggatgtatgagcatcatcagttcagatgagaacttgactgggcgggctatgtaaaaactgcatccaccgcagtgatgaaatc

SEQ ID NO: 49987 - DNA, 343 bp, Zea mays
  Clone ID: LIB3067-035-Q1-K1-D8
ggagaggcaatcaccacgtacgtatacacacgggcacgtaactagctagctagctagcagtggtagaatgacgatgaggggtctctctgttgcggtcgctctggtcgtggtggtggccgcggcctgccttgccgcgccgcggggcgcggacggctcggtcgagtgcggtgcgacgccgacggactctgtggctctgatgctggcgccgtgcgcgtcggtggcgtacgacccctgctccgcgccgttcgtgtcctgcttcaacgcggtgcacgccattgtgaagcacagcctcatgtgcctctttgccgttatgcttgttcaacagctgctgaagcacctgtat

SEQ ID NO: 49988 - DNA, 435 bp, Zea mays
  Clone ID: LIB3067-035-Q1-K1-D9
gttcaggatccacatcttcccgagcgagttcttggttggcctcttcctcttcggaccacctccaaggctcttggtgtagcttgccactctcaccaatcaagttttcatgtctgatctcgacattcagatcccaactgccttcgatcccttcgctgaggccaatgctggggactctggtgcagcagcagggtcaaaggactacgttcacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggcccgcattgtgaaagaggagcacat

SEQ ID NO: 49989 - DNA, 430 bp, Zea mays
  Clone ID: LIB3067-035-Q1-K1-E10
cccacgcgtccggggtttcgtgctaggaaaagacgcggttggcaaggccaaagcgttcgatgagaagcacggcttcacatccacagccggtgctaaggtggcctccatcgacaagaagattgggctgagcaataagattaccacgggcacttcgttggtcagcgggaaggtgaaggagatggaccagaagttccaggtctctgacaagacaaagtcagcgttcgcggctgccgagcagaaggtgagcagtgccgggtccgccatcatgaagaacaggtacgtcttcaccggcgcgtcgtgggtcaccggagcgttcaacaaggtcgccaaggctgccacggacgtcgggacgatgaccaaggagaagatggcggccgaggagcagcagaagggcttctccggcccgtcgtctaggagccactcgtacacg

SEQ ID NO: 49990 - DNA, 223 bp, Zea mays
  Clone ID: LIB3067-035-Q1-K1-E3
cgacatcctccacgacgccaccatgagggatgctcgcgtaggctgatcctgatgagctccggcttcggcacctgctgactgctgcttcatcctcgattgtaccaagcatgcatatacagactatgctatacaaactcatcaacctagttcactggcacttgcctgacataattattccacgagacatgatcaccaccattacctgatatatcactgtcatatc

SEQ ID NO: 49991 - DNA, 410 bp, Zea mays
  Clone ID: LIB3067-035-Q1-K1-E4
accagatgaaattgcgaaggttctgaatctggaagtgatggacagaagcaggcactggaagattgtgggctgcagcgcttacacgggagaggggcttctcgagggcttcgactggctggtccaggacgtcgcttctcggatctacgtcctagactgatgctatttgccgcgtcagtcgtcctagacggatgctatttgtcgcgtcagtgctacttgagcatcattagagtgtggtgcctgcattaaagcctgtactaaggccctgtttgtttaaggtttaaggtttaggaatttgtgttcactcctactcactttgggattgccgggggaattggttgcctggggtatattgaaggtaaattaaacgttcatgagttcatttctctttatttatatgtcagattaaggtt

SEQ ID NO: 49992 - DNA, 325 bp, Zea mays
  Clone ID: LIB3067-035-Q1-K1-E5
accacgcattcaggtgttcttggcaacagtggcgagcatttatgccaaaactctagtgtctgatatacatgataccagttgtactctttgacacgcaaagatttactatgcaattgaccacctaacgaccagagttatccgcaagctttacaagtcgctttatcaaatctccacttgactgcagggaccattgattgatgctctgaatgacaataatcgtctatgctggtgcaacataaatttgggcttaagcatcgagatgatggctactggtcctactgatgcattctagcattcgcctacatactactcaatacatattgga

SEQ ID NO: 49993 - DNA, 433 bp, Zea mays
  Clone ID: LIB3067-035-Q1-K1-E6
ccttgcttgctggccccacagccataattactgaaatcaatgaaaaaattggtgctgctggtgtagtcagccaggagtgcaagactgttgtttctcaatatggacagcagatcctagatcttttgctagctgagacacaaccagcgaagatctgttctcaggttggtctgtgcacttttgatggcactcatggtgtcagcgctggaattcggagcgtagtggatgatgaagctgggaaatcaaatggtggtctcaagagtgatccaatgtgcaatgcctgtgagatggctgtggtatggatgcagaaccaacttgcccagaacaagacacaggagctcattctgaactacattaatcaagctttgcgagcgtcttccgagtccaatgggagaatcagccgtggactgtggcagtcttgcgtccatgcctgaca

SEQ ID NO: 49994 - DNA, 438 bp, Zea mays
  Clone ID: LIB3067-035-Q1-K1-D1
acgcggacgcgtgggtgctctcccgcaacggcgtcaagttcggcgaggccgtctggttcaaggggggcgcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggccttcgtcgagctcaaggtgaaggagctcaagaacggccgcctcgccatgttttccatgttcggcttcttcgtccaggccatcgtcaccggccagggcccgctcgagaacctcgctgaccacatcgctgacccagtcaacaacaactcatgggcctacg

SEQ ID NO: 49995 - DNA, 300 bp, Zea mays
  Clone ID: LIB3067-035-Q1-K1-E8
cttccgtgccagagctctcagtccgtggccttgttgactccgttggcccctcaagtttctcagggataaccgccatatcatgactcactactaatcgagcagcacaattttggtgtacggcattcaagtagcatttgactatctgagtgttatgctttaccaggcttttgcttttagtattgcctttatattgagtactactacaatacttcatgtcgctttgttttcaaaaatactttatgtcaattttgcaagtctgatttgctcgaaataagaggctcatgctgttgtgcggtgctt

SEQ ID NO: 49996 - DNA, 229 bp, Zea mays
  Clone ID: LIB3067-035-Q1-K1-B12
atcgagtacagtcggctaggtaatctggtggtacgactacatggcggccaccagcagcaaggcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgactgacccgccggcc

SEQ ID NO: 49997 - DNA, 320 bp, Zea mays
  Clone ID: LIB3067-035-Q1-K1-B3
cccacgcgtccgcccacgcgtccgggggcttcttcagcacctggacaacgatccttccctggagttcgggtaccatcatcaagcctacatggatcagctgaacaacgaggacctggtggacccgaatgagcatggtcgatctggatggatatgaaatgctctgatgaccccaaataaagttgatgcacagcagggattcaccctgcatgacgcgagactatgtattgaggctaagacctagcgtgtgtagtgttgagtgcgaagctttgttactttataaatcgttgtcatgcccaaaaatatatattatgttttaatta

SEQ ID NO: 49998 - DNA, 209 bp, Zea mays
  Clone ID: LIB3067-035-Q1-K1-B5
attcagtagttgccttcgccttgctttgctgcttccgcctcaatgttctttcagaacgagaggtaaacgtggtgcacaggttctctgaattctgtacgccgtaggacaggggcgagcatgtcacggcgaatgaagaaacaatctctcctagaataactacatggcagcactcatcagtccatccttcccttcagcactctctcttgcac

SEQ ID NO: 49999 - DNA, 456 bp, Zea mays
  Clone ID: LIB3067-035-Q1-K1-B8
cccacgcgtccgcggacgcgtgggtatctaggtatggcaaaactgacagtgaaatgatttggcaggctgtgctagagaatgttcagtcagactcattaagaagattgttagccagagagggtcgactgatatccgtcagcctaggcacagctccaactgtacaattaatattcaactctcgagtaaataaatctaaagctgagaagtataggggccaaattctgcaggcatttgaatctgttctttcttctaccataatacttgaaattcgatatgaatctaaggatgatctggcagcaggccatgctccagttatttctgcctaccctgaggatggctcctcaaatctggtattaaggaggtcttttactaaacatagttcagtttcttcggggggcgagaacttaattaggaggcttcagaaagatagtgtggtccaacttggtagctcaaatc

SEQ ID NO: 50000 - DNA, 444 bp, Zea mays
  Clone ID: LIB3067-035-Q1-K1-B9
atctaataagaagcaaaagatgaactcaaatgaaacctcacctccacatttaccaagtgcgaccgaaacaagcgagcctacaactccaaatgagactgtcacaacaagaccacctggaaagaagaaggccaaagcagcagcatttcaagctgaaaagaaaggctacacagaaactttaaacaaattatttgaaaagaagaaagaaacagatgaatttaaagaaatgaaaaaagacgagaggtttagattagcattagcagttgaacaagagagggctgcgaatgagaaattaaatatgcagttaaggagtaaagagctagaattgaggcagcaagaagttgaacaacataagaagaaggaagaagagaagattatgacactagaccttagtgtcatgcctgctgatcagaagcaatattacatgagactacgatctaagatatt

SEQ ID NO: 50001 - DNA, 431 bp, Zea mays
  Clone ID: LIB3067-035-Q1-K1-C11
tcgcccactcgtccgcccactcgtccgatggtgtgcttcttgtcgcacctatgtgcaagatttgagaagatgtaacaccacctgcacctgtattgaaggcactgagcatattgtcatgtcttcttcctgaggcgaagttatttccgcagaaagatataggagatttggcatttagagatccaaggaaaaggaaagtagctgagtacaatgccatctcatattctgaccaaatgagattaagaacagcagttgaacttttaaaagccacgaaggacattgaatcacagttggaaaagatctcctctccattgctgattcttcacggagccgcagacatggtaaccgatcctcatgtcagcaaattcctttatgagaaagccagcacgaaggacaagaccctcaagctctatgaaggcagctaccattcaatc

SEQ ID NO: 50002 - DNA, 438 bp, Zea mays
  Clone ID: LIB3067-035-Q1-K1-C12
cccactcgtccggtgtgcaggaaatggtttcagagagtaccaaccaaaaggcttgaaccctgctaatggtaaccaatttggatttatggtggccccttcacaggagcagatgttataccaacagaaggtccatgcaccgccgtactcgtcaccattcatggggttccacaatcaccccttggcagttccaacaaatgggtacttaccatatactcagccaggtcacttctaccctgcttctatgacccctgttggatatggagttgctggtgaccaatgtgtcgacttctcgatgcagtacagaaataacattcatccttactcgggtcctgaatttggttttctgccttcacagccagttcacaagacctcagtgaacttccatgcggtaccagtgacaccactgaccccgttgtgtagccgcggaatgccagtggc

SEQ ID NO: 50003 - DNA, 440 bp, Zea mays
  Clone ID: LIB3067-035-Q1-K1-C2
cccacgcgttcgtccacgcgttcggccacgcgtccgttcacgcgtccggcaagtaccagaagagcacggagctgctcatccgcaagttgcccttccagcgccttgttcgtgagatcgcgcaggacttcaagaccgatctccgctttcagtcctccgccgtcgccgcgctgcaggaggccggcgaggcctacctcgtggggctctttgaggacactaacctctgcgccattcacgccaagcgcgtcaccatcatgcccaaggacattcagctcgcgcgccgtattaggggccagagggcctgagcgaggcgaggctctcttaccgtaggcggcgttcgtgttgctttcggcctgcttggaagacttgtgcttctcttgggttactttttggtggcatttggcattttggtaccatagtgctttgtcttagtatcttagggg

SEQ ID NO: 50004 - DNA, 211 bp, Zea mays
  Clone ID: LIB3067-035-Q1-K1-C4
caaagacatgcgagtaccagacatgtgcaactctagtagtatggtgcgtgttatcactagggacgcgtactcgtatagttgtgttcagttctgggtctatagagatatgtagccctgcattgtcgaaataaatactgtgtccactcgttcgtgaaatgaaaaaaaaaaaaataatataaaaaaaattaaaaaatataaaaaaatttataaa

SEQ ID NO: 50005 - DNA, 367 bp, Zea mays
  Clone ID: LIB3067-035-Q1-K1-C5
cccacgcgttctcccacgcttccgttcagtattagacagccactagcactactacggtgacgactgctagaatggatctggtttctttgacaaggtgaatgtatttattcatgtcattttttattagattttaatttgtatttatgtttttttattatttattttattttttattttatttttatatctttttttattattattttagttatcattttttttttaattatattttttatttatttatttttttttttctttatatttttttttatattatattatttattattttatttttatttttatgttattttttatattatttatatattttttaatgattatatttttatttattattatt

SEQ ID NO: 50006 - DNA, 453 bp, Zea mays
  unsure at all n locations
  Clone ID: LIB3067-035-Q1-K1-C6
cccacgcgtccgctcggaatggaagcacatcaaggaaggctcttctgtcaagcagccgaggttctggagatcccagcgacccaaatcgcagtagccacctagtcccgaccaccagcagcagcagccgtccatcaaccaatcaaaggcttcaccagtcaactggacttgagggcaggacctcgtcattcccaaaacctggaagaatcggccaggatgaccccactatgaggagttttgaacgccttactatcagcgcagagaggaggagatgaatctttggaggtgcaaaaggtctgaccattgacgagtatactgatttcattgaatattcattcggttccagatgatgcttactgatgagcaagtcaaaagattatgtactgtgcatgatgctgagctcttcacattgcgatgctcgtcgaatcttggcacanatttgagttctgtacattc

SEQ ID NO: 50007 - DNA, 429 bp, Zea mays
  Clone ID: LIB3067-035-Q1-K1-C7
gcggtttctctaggtggggttggcgtctctaacatggttcacaagattgagcgacatgagtacatggggtttgaggacctttgcaagtacgatgcgtaagaagcagggaagctgaagatgtgagctatgtggtgtgcagttctccgcaagcagaagtgggataattcaaggatagaagggttccatgatgcattttggtgcgtaggaccgaagaggttctagcagcgacagttcctcgaagggaggctagttgcatggattggcttcagatgaattttgggcactgaattttcaaaacaaatgtagagatgattttctgccacggcagaatgtcgtcagtgcatttcgttgtaggaatatgtacactgcacatcttcagataatcatcctatagtactatgcgatatgaaatatcacatgatagacaaa

SEQ ID NO: 50008 - DNA, 452 bp, Zea mays
  Clone ID: LIB3067-035-Q1-K1-C8
cccacgcgtccggaactccatgaggcttctgatatatggactccgtctctacactgatgaagctctggtaaaatcagtgacacgtgaaggaaaaccagagtaaatccgatgaactgaagatccgtatgatcgtttagcttgctgctctgacgataacgactttgcttctttacagggaattgctgagaggtccactctattatgtcctggtgctgctgttcagcgttttagtcttctggcgtgagtcccccatcgggatcgtctccttgtcgatgatgagcggtggcgatggttttgctgacattgttgggaggaggtatggctcagcgaagctgccattcaatcggaagaagagctgggccgggagcatctcgatgttcatttctggtttcctgctgtccgcgatgatgatgctctacttctcaagcctgggttacattgatgttatctgg

SEQ ID NO: 50009 - DNA, 415 bp, Zea mays
  Clone ID: LIB3067-035-Q1-K1-C9
cacgctgttctggctgttggctacggtgtcgaagatggtgtcccctactggctcatcaagagctcatggggcgctgactggggcgatgagggttacttcaagatggaaatgggcaagaacatgtgcggggttgctacgtgtgcatcctaccctattggcgcatgaaggccttaccaagtggtacatggtctggttgggcttaattaatgctggttaaaccggacctggccaatgggtattccgaaccggaaccttggttgggaattggaaatcatgaaaggggaaggagttgaccggacccttgcttgcacgtctccccgagtgtgtaggtagatggacagttggggttccaaagcactatactcatacgtgtgtgtgacagtatatatgtgacacaatatacgcatagagcgtt

SEQ ID NO: 50010 - DNA, 460 bp, Zea mays
  Clone ID: LIB3067-035-Q1-K1-B11
ggtcgacggacgcgtcaggccacgcgtccggtggcaagaagtgcaagattccagttcccaggaagattcataaggctggggagtagaagcttaaacgagaccacctaaaccatctctttgcagaactggttaatatgctagaagctgattgacagaacacttgcaaagcgatgcatactgactgacactactccgatactaagatacctgcttgatcaaggagactctatatacaaggcacataccaacctacaaaacgaatctcattatgtaagccgtcgtctttgagcatgtcatctaacattcactctatcggccgctgtcctgctggccttaatctatcaaactcctgtatctgattttatacattagaaatgctttatacaaatgcctaatccaactcatgactctgttgaacatgtggcttgtcacgctacctttgctgcatgtctcatcatgg

SEQ ID NO: 50011 - DNA, 385 bp, Zea mays
  Clone ID: LIB3067-038-Q1-K1-C4
gcacctcgtccggcgccgctgctacttggagcgccgacgagatcaagaaggccctccggtgggcgctcttcttcgaggagattttcaaggacctgctcgactcgggccagtacgaggattctgcaagagaactcgatgcggcactccttgagctcacttcaagtcccgagttccctaagggtcttgctgctgtacgttcagatttgctatccatggcaagggtgttggttatgcgacattttctgaaaccaaacacaatgagcgtggaaaacttttgtgctcttcttgaagcggttgctggcatggatattgatggcatttgtgctagtggtgcgcacaacgcatgcgagtatgctgagtcaatattgaatatgaatacatcatg

SEQ ID NO: 50012 - DNA, 436 bp, Zea mays
  Clone ID: LIB3067-038-Q1-K1-C5
ggtcggcttaaattcctggagagatttgcttatatcaacacaacaatttatccactcacatgaatcccgctcctcctgtactgcatattgccagcagtttgtcttctcactgggaagttcatcatcccaaagattagtaacctagagagtgtttggtttatatcgctctttatctcaatctttgccactggtatccttgagatgaggtggagtggtgttggcattgatgaatggtggaggaacgagcagttctgggtcattggtggtatttctgcgcatttatttgccgtcttccagggtctcctgaaggtgcttgctggtatcgacacgagcttcactgtcacctctaaggccactgacgaagaatgtgattttgccgagctctacatgttcaagtggacaacgcttctgatcccaacaaccactattttgatca

SEQ ID NO: 50013 - DNA, 376 bp, Zea mays
  Clone ID: LIB3067-038-Q1-K1-C6
cccacgcgtccgcccacgcgtccggtgaaactacaggtccggctttatgaagtgccaagggatgcattcgagaatgactacgttgaggaaccactccctgaggaagagcaagtgcgtcccttctccgaggatgttgatgccagcgcgaaggaaatggatgctgccgcagaagcggaggctactggaacaactgcaggcgctgagaagagtggtgatgtcgctgctgtgtgaaggcggttgctacaacctgaagaggtctttttcggacacttgaataaggttaccttggctagctatctactacaatcatgggcatctttatacaggtttgatgtatctaccatcgaaggttatgctattattgttcgctgaatct

SEQ ID NO: 50014 - DNA, 457 bp, Zea mays
  Clone ID: LIB3067-038-Q1-K1-C7
gctatctcaatcactgctaccagcaattgtagaacttgcagaggataggcactggagagtgcggcttgcaataattgagtacatcccattgttggcgagtcaattaggtgttgggtttttcgatgacaagctgggggcgctctgcatgcaatggttggaagacaaggtcttttcaatcagagatgctgccgctaacaacttgaagcgccttgcagaagagtttggtccagagtgggcaatgcagcatataatccctcaggtgctggagaagatcaacaacccacactatttataccgcatgacgattctgcaggcaatctccttgctagctcctgtcatgggtgcagagatcacctgtcaaaagctgcttccagtcgtcattaattcttcgaaggacagggttcccaacatcaagttcaatgttgcgaaagtactacagtcacttgtaccgatcctc

SEQ ID NO: 50015 - DNA, 119 bp, Zea mays
  Clone ID: LIB3067-038-Q1-K1-C8
caacaaaaccccccaacagacccactttttctaaaagataatctaaaaccccctctactctaaccactactactattcttcaacaacacaccttacaccactcccatacctcacttcaa

SEQ ID NO: 50016 - DNA, 262 bp, Zea mays
  Clone ID: LIB3067-038-Q1-K1-C9
cctacaaatagacgtcattttcagcgaataattgttgtgaaaatgtgtatgttgcattgaaattgtggccatacaagaaggaatcgaatgtagaacgatgatgtacgagatagacttggggtagcggtagcaccaattgaagaaaaccttgttcaaaatcaaaaccgattgagatggtttagactttagacatgtccaacagagagatctatagaggcaccattccgtagtgggatcttaacacatgataatactaggaaaa

SEQ ID NO: 50017 - DNA, 429 bp, Zea mays
  unsure at all n locations
  Clone ID: LIB3067-038-Q1-K1-D1
ntccggagattctgaccacatttccaagagaactagaccggttggcatgtctgaggagatgaatcggtgggtgaacatgctgcctgtgacttatccacagagccataattaccaacaagatgatttccacaaagctgttgcacggaccttgagccaaggatcagcacctatgagcatggatttccatccacttcaacaaactcttcttcttgttggtaccaatgttggcgacattggattgtgggatgttggtaccaaagagagactcgttgtaagaaacttcaaagtctgggaccttggtaaatgtacaatgaccctacaggcagcactggttaaggacccaactgtgtcagttaatcgcataatatggagtcctgatggaaccttgtttggtgtgcttattcaggcatattgacagattattcctat

SEQ ID NO: 50018 - DNA, 424 bp, Zea mays
  Clone ID: LIB3067-038-Q1-K1-D10
gactagttctagatcccactctgcctctgtgctggaaagggcagaaagcattcaaatctgtgtttgacgtcaagaatgaattcaagtcaatgtttctgagctttgccagttccaagaatgccgccatggagatcccacctgaaaactacctcattgtcacaaaaaatggaaatgtgtgcctggtcattcttgatggaacggctgccaagctgagtttcaacgtaattggagacatcacgatgcatgatcagatggtgatctatgacaacgagaaatcgcagctgggatggtcgcgttgggcatgcactatgagcgccaagtctattctgtcttcctttccctgagctcagttctatgtacttctgatagagtttaagaaaatcactatatcaaaccttctcgcaatgcatgaatttcctaactg

SEQ ID NO: 50019 - DNA, 433 bp, Zea mays
  Clone ID: LIB3067-038-Q1-K1-D11
gggagatcagtatgcagttgcacttggactacttgatgagggcaaagttgttctgggtgtgttgggaggtccaaatcttccattaaaatcaacaaacaagaacaatagcagctcttttggggatcgaataggttccctcttttttgctacaattggttgtggagcgcaagttgaggccttagaaggatctgagccacaaaagattagtgtttgctccaccaataatccagttgacgcctcattctttgaatcctttgaagcatcacactccaagcgtgatttaactagctccattgcagagaaacttggtgtccgagctcctcctgttagaatggatagccaagcaaaatatggtgccctagcacgtggtgatggtgccatttttctgcgcatcccgcacaaaagttacatagaaacagtttgggatcatgca

SEQ ID NO: 50020 - DNA, 414 bp, Zea mays
  Clone ID: LIB3067-038-Q1-K1-D12
gcgatcgagtacagtcggctaggtaatctggtggtacgacgacatggcggccaccagcagcgggtcgtcagcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgtccgactgctagcagtgtgctagccaagccaagcc

SEQ ID NO: 50021 - DNA, 403 bp, Zea mays
  Clone ID: LIB3067-038-Q1-K1-D2
cggacgcgtgggtctgatcgtcctgttcctcacagcagcagccatggcggccgagccggagaagggggcggcccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgccagcggcttctccgcgaagctcaccccccagcaggtcaaggatctcaaggagcaaccaggtgttctccaggttgtgccgagccagacttaccagctacatggtcctgggtctggcactcaccagggcacgacacacaccttgggccttatgtgaaagcgtatgagaatcaagaagatt

SEQ ID NO: 50022 - DNA, 264 bp, Zea mays
  Clone ID: LIB3067-038-Q1-K1-D3
gtccactcttcctcttacgccccaataccttattgtaaaacctacgcgatttcccttccaggaggatctttgcaatctcctacactacaacaaataacccatgaccatccacgattactgaattgcctcctgctttccagagtgcaatataatgcacattggctgcactgtatgctgttaacactgacactgttactcataacactttcaacacacaaacctcttcaggcctttatgcattaacatatatcgccactactatta

SEQ ID NO: 50023 - DNA, 402 bp, Zea mays
  Clone ID: LIB3067-038-Q1-K1-D5
accgagtacgagcaaccgcttgcgtcagactcacactgacggagagtgatcactgattgcgggtcatggcaaccgtaactgaggaagttgctccggtcgtcaccgtctccgatgagccggcgccggaagcggcgaatgaggtggtggagaagcccgaggaggggaagaagcccgactaggagggtgacgagaggaagaaggccgaccccgccgtcgagaaggagaagaaggcgaggaagccgcggagcaggaagcccaagtccgtcgggctgcaccacccgccctatttcgaggtgagcaaagatgccgtcgtcgtcgtcgttcgtcttgtcggttactcatccgtgcttggattctcattctgatgatcggtcgctgtgtctgctggggacctgaggttat

SEQ ID NO: 50024 - DNA, 393 bp, Zea mays
  unsure at all n locations
  Clone ID: LIB3067-038-Q1-K1-D6
cggacgcgtgggcggacgcgtgggcgacgatacattcagatccagaagatggcacttccctgtggtacaattttacgatctcccttgtctgggcaccattcctggtcaaagctaaaatatttgaggacgacgatggagtttctactgctgatctccagctgcaccttgacgttctcgagacagactggactagtcaatgggagaagttcgattacgcggtgatatccacgggccaatggttcttcaagactgcagtgtactgggagaatggagctgcgattggctgccactcctgccagaacaaaaccctggaagagaggcctncggagtactccttccgcagggcactcagggtggccttccagttcatcacattctcaccttacaagccag

SEQ ID NO: 50025 - DNA, 346 bp, Zea mays
  Clone ID: LIB3067-038-Q1-K1-D7
ctttgttttatgtagaagaaaaggacatggctgatggtgggctttcgatgtcatcctccttccgtcttcctacatcttcttcggtgcgcttctccaaacaaacagatgaagatggtgaaggaattcctctaagatcgtccgaatcattccggtcaccacattaacgcatgtttgctaatcattaatttgcacagagttaggggtgggtattatatagataatgctatcagtgagcttgtactaagggtacgatggatggaccctcttttgctttggcagaattgtatatgtatgcccaacatcttgtggaactcccaatatatttctcttggctgtcgtgtgtgat

SEQ ID NO: 50026 - DNA, 413 bp, Zea mays
  unsure at all n locations
  Clone ID: LIB3067-038-Q1-K1-D9
gcgcatgtactatggcacaccattctacggcggatatggctatgccttcccggtgccacacggaaacatgtgcgctgcagcgtatggcacgtacccgctatatggcaaccagcagctagtgagctagagagctcccctccgacgtgtcccctctgacgggaaacaaaggttttggtccggtgagcatagtagcgtcaggtgagaaggtgcctttataaggctgtcctaagaagtgggcgagatatgttgttgcatcgntatcgttatggtgcctgtaactgttgtgtgtgccgtgtgcgttcggaagaattggatggaatggaactcgtggcttagtgtagtacatcaaagagtcatgttattctttcaagaaattttgacttggtaataaataaactatngtttgtgcgtcc

SEQ ID NO: 50027 - DNA, 358 bp, Zea mays
  Clone ID: LIB3067-038-Q1-K1-E1
ctcgtctgtttcctctacggccgccaccatcgcctcgcgaccgcctgccgctccgctcgaaagggtttagtgaagattttttgaagccgagaagatggtgctgaagacggaactctgccgctttagtggccagaagatctatcctgggaaaggcattcggtttattcgtgctgattctcaggttttcctttttgccaactcgaaatgcaagcgctacttccacaaccgcctgaagcctgcaaagcttacctggacagcaatgtacaggaagcagcacaagaaggacattcatgctgaagctgtcaagaagaggcgccgcgctaccaagaagccatactcgaggtccatttggggtgct

SEQ ID NO: 50028 - DNA, 413 bp, Zea mays
  Clone ID: LIB3067-038-Q1-K1-C3
aacattttcaagttagctcaaggagaatacatagctccagagaagattgagaatgtctatgctaggtgcaagttcattgctcaatgctttatatatggtgatagtttcaactcttccctagttgccattgtagcagtcgaaccggaggtgttgaaggcttgggctgcatcagaaggaatccagtacgaggacttgagacagctctgtgctgatcctagagcaacagctgctgtcctggctgatatggattccattgcgaaggaagcacagctgagaggtttcgagtttgctaaagcggttactcttgttgctgagccattcacattggataatggccttctcaccccaacattcaaggtcaaaaaggcgcaagccaaagcatactttgcaaagaaatctcaaacatgtattca

SEQ ID NO: 50029 - DNA, 411 bp, Zea mays
  unsure at all n locations
  Clone ID: LIB3067-038-Q1-K1-A8
cggacgcgtgggcggcgttgaccatgaacgtcgcgggagtagtcaaggattggctgttgatggcattctcgtggtccgttatccgggacaccgtcaccccgatcaacctgttcggatatgggatcgcgtttttaggggtggcctactacaatcatgtcaagctgcaggcgctcaaggctaaggaggcccagaagaaagccgcacaggctgatgaggaggttggatcgctcttgcaggagcgcgatggacacggtgatcataagagcgacaatcaggcttagactgtcagatctgatcctggccttcccatattgacttcagcgcccagaagaattcttgatctgntgttgcggcactacgcaactcaacgagatttttgtcgatgcacattggggaagatcttgagcaact

SEQ ID NO: 50030 - DNA, 395 bp, Zea mays
  Clone ID: LIB3067-038-Q1-K1-A9
tcgtccacgcgttcggctgtgagaatggccttcggtctttctacgggcgaggatccctcgaactccaagggtgcatcaccgagccggtagacggggaggtctcgcggcttcggcttcgttaccttctccttcgagaactccatgctcgacgctatcgagaacatgaacggcaaggagctcgacggccgtaacatcaccgttaaccaggcccagtcccgtggcggtggcggtggcggcggtggctacggcggcggtcgcggcgggcggcgctatggtggcgggcgccgtgacggcggttatggccgcggtggcggctaccgcggtcggcgcgagggtgtggcggcggctacggaagcggtggcggctacagcggtcggcgcgagggtggtggtggc

SEQ ID NO: 50031 - DNA, 330 bp, Zea mays
  Clone ID: LIB3067-038-Q1-K1-B1
gaaaaaaaagaagaaaatttaaaaaaaaaaaaggcccaaccaaaagggcggacgaacaaaaaggaaaaagcaaaacaaagcaggaaagaaagagaaaacaaaagacaaaaaaggcacaaaaaaaaaaaacaaaggacaacagaaaaaaaaggacaaaaaggagaaaaaaacaagagaaaaaaaaaaaaaaaacaaaaagaacaaaaaaaacaacaaaaacacaaagagcaaaaataaaaaggacaaaaaaacaacagaaaaagaaaaaagaagaaaaacaaaagaacgaagaaaaaacacaacaggaaagagaagaaaaaaagacaagag

SEQ ID NO: 50032 - DNA, 435 bp, Zea mays
  unsure at all n locations
  Clone ID: LIB3067-038-Q1-K1-B10
gcgcccacgcgtccgcggacgcgtgggacctggtgccctaccctaggatccacttcatgctggcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtgcggaatcaactaccagccttccagcgtcgtccccggcggtgacctggccaaggtgcagcgtgccgtgtgcatgatctncaactccaccagtgttgtggaggtcttctcccgcattgaccaca

SEQ ID NO: 50033 - DNA, 428 bp, Zea mays
  Clone ID: LIB3067-038-Q1-K1-B11
gttcccactgtcagtaacacaaacagaggtatactaaaaacctctgaaaagtcgagttgtgattctgctgagccccgaaggactacttctgattctgctgaacctagacgatctaacaggcgaattcaaccaacttcaaggttactagagggcttgcaaagttccctcgtaatctcgaaagttcctggcgagaaggttcctaggagcaattacaaaagtgcatcctcaagagggagaactcaagctcatgggtgagtgaaggcaccacatagctcatagctgcttttggtgggacagctctcgtgtacatagctgtagccgtccagtatggaaggaggatagggttggagtaggaagtctttattggagcgcatggattcagatgtattataaactaacttaagtgcattgtgttaaccttttctttt

SEQ ID NO: 50034 - DNA, 362 bp, Zea mays
  Clone ID: LIB3067-038-Q1-K1-B2
ggaaatccgtttgcttcatgttgtgcaggcttatatctgattgctggattcggcaaacccgcgttggatcctgtatcggttagtccttgcctgcaaggttcttgttgttttgttttggtggtcgagcatcgcatgttctgcttctggatccagatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgt

SEQ ID NO: 50035 - DNA, 397 bp, Zea mays
  unsure at all n locations
  Clone ID: LIB3067-038-Q1-K1-B3
cggacgcgtgggcaaggaccatggtggtgtgctcgacgggacggcccttgtgctgtgggagtggtgcgagggagacaaccagcgctggaagattgttccctggtgaacaaggaaatgtgtgaccgagcccgcaccaaggaggagctcctgccgtaataagtgaagtgattggtactgaagtttctggaaataagaggctcttccgagatgcctgtttgtgtgagtatttgcgtttccattccgttttcatgataataaaacgcattgattattaatatatgtaatgtgatgctacactgagtggcagcgttggtatatatttgtaagaagtaagaacccattgttgttggactaagcgtgacgagtgatgtactgatgtatngaaccttgcttgatg

SEQ ID NO: 50036 - DNA, 331 bp, Zea mays
  Clone ID: LIB3067-038-Q1-K1-B4
cccacgcgtccgcccacgcgtccggccatggctgccgaagctggcccaatctccaaggtcctgatcgtcgtagcgatgcagacggaggcgatgccgctcgtccacaagttcaagctcgtcgaggcgcccgcccacgaatccacatttcctaaaggtgccccatgggttaggtaccatggcaactacaaaggcctccacattgaccttgtattgcctggaaaggatgctgttttaggagtcgacagtgttggtacggtatcggcagctcttttgactagtttttccattcaaacattgaagccagaccttatcattaatgctggcactgctg

SEQ ID NO: 50037 - DNA, 462 bp, Zea mays
  unsure at all n locations
  Clone ID: LIB3067-038-Q1-K1-B6
ctcatcctgctcacctactttgcggtcgtctccggactcgtgtacgacgtcatcgttgagcgccctggcatcggcagcgcccaggaccccggcactggcgccgtccgccccgtcgtcttccttccagggcgcgtcaacggccagtacatcatcgagggactctcctccgggttcatgttcctccttggcggcattggcatcatcctcctcgacctcgccgtcgaccgcacgaggccccggagcctccgcgtctcgtttggaagcgccggcgcagtcgccgttgtcatcgcctacgccatggccatgctcttcctccgcatcaagatccccggctacctctggtgaggttgataaatcttgcctgttaactagaccagatccgtcgcgagatctcgctgcatctaaatagacctgcgtgctgtgcagtgtggactgtgctctntcattntgtcaattaatgtt

SEQ ID NO: 50038 - DNA, 457 bp, Zea mays
  unsure at all n locations
  Clone ID: LIB3067-038-Q1-K1-B7
gtgtttcagacacctaatgcagaactacgtgaagcaatttgttggatccgagtacatgtatgctgcagctagagcatataggagggaggtgttcgaccattacttttccgatgtccaagaaattcccaaggtgtctagttggttacatgagcatcatgatagtttgtggtatcgtagtgggtttaatccagccatcaagtgtgactatgttaccaacaacatagcagaagtgttcaacaattggattaaggattggaaagatctgcctgtttgtgacttggctgacaagataaggaaggaaatcatggagttgtttcaaaagaggaaggagataggacagaggttgcaaggtcgaatactaccctncgtggtccatatcctncatgtaaggactagaggtttaggtcacttaacagttaagaaagctgacaattacattgcaaaggtgagggataat

SEQ ID NO: 50039 - DNA, 380 bp, Zea mays
  Clone ID: LIB3067-038-Q1-K1-B8
gaagtcccgcaagcaaatgaaagagcggaagaacagggccaagaagatccgtggtgtcaagaggaccaaggctggtgacgccaagaagaagtaaacagtcatttatatttctgtattactgtcctgaactctgggtggtcgtctagttgcaatgtcataattatggtcgtgttaggttttgttccgcactcagcagtaagtgaagttttgtaattcctggatgtgaacctacccggattggctgtagcatgttgtgagatgagaaggctattttgtcatgcagttgtgtcatttgcaagccaatccattttgtcatgcagttgtcatttgctcacctctgatccatatcagctttgatcgtgctgcatttgcgccaaaaa

SEQ ID NO: 50040 - DNA, 414 bp, Zea mays
  unsure at all n locations
  Clone ID: LIB3067-038-Q1-K1-B9
ggagcgtagtggatgatgaagctgggaaatcaaatggtggtctcaagagtgatccaatgtgcaatgcgtgtgagatggctgtggtatggatgcagaaccaacttgcccagaacaagacacaggagctcatcctgaactacattaatcagctttgcgagcgtcttccgagtccaatgggagaatcagccgtggactgtggcagtcttgcgtccatgcctgacattgcgttcaccattggaggcaataagttcaagctgaaaccagagcagtacattctgaaggttggtgaangacaggctgcccagtgcatcagcggattcacagctatggatatcccaccaccccgtggccctctctggatcttgggtgatgttttcatgggagtctaccacaccgtcttcgactatggcaagc

SEQ ID NO: 50041 - DNA, 431 bp, Zea mays
  Clone ID: LIB3067-038-Q1-K1-C10
tcgcccacgcgtccggaggaacaaaatgagctcgtagaatcagctgcagagatgctttatgggctgatccatgcacgatacattctgaccagtaaagggctggctgcaatgctggagaagtataggaactatgacttcgggcggtgcccgcgtgtttactgctgtggtcaaccatgcctgccggttggacaatcagatattcatcgatctagtaccgtgaaaatatactgccccaagtgtgaagacatctactacccacggtccaagtaccaaggcaacatcgacggcgcatattttgggacaacgttccctcacctgttcctgatgacatacgagcacctcaagctacagaagcccttgcagcgctatgttcctcgtgtctttggcttcaagctccataagccatgagcctcatgtatttggcttcaagc

SEQ ID NO: 50042 - DNA, 449 bp, Zea mays
  Clone ID: LIB3067-038-Q1-K1-A7
gccagagacaacttgaagttcttgcatgttttgttcgccaggttccctcagtacaagggcggggacctgtatatcacaggagagagctacgctggccactacgttccacagttagcccagcgcatggttgagttcaacaagaaggagaagctattcaacctgaaaggcattgctcttggcaaccctgtgctggagttctccaccgacttcaactcgcgggccgagttcttctggtcgcacggcctgatatcggactccacctacaacatcttcacgacggtgtgcaactactcgcggtacgtgagcgagtactaccgcggctccctgagcacggcctgcgacagggtgatgagccaggtggcgagggagacgagcaggttcgtcgacaagtacgacgtcaccctggacgtctgcatcttcgtcggtgctcatgcagtcccaggtcctcg

SEQ ID NO: 50043 - DNA, 318 bp, Zea mays
  Clone ID: LIB3067-038-Q1-K1-C2
ggccaaccactaaatcagataacaatttgaatagtacagtacagggaggacaagtggcaataggaggacaataatcacgctgaataagtaggccccacatcacagtccttctggcaactgcacatggttttatcattttatttttaaaattgttttttatggacattatctcgatcacgttcctgccacagaagctcatcaagcatcggacggcctgtagttgtagacgtgaaagcttgcatgtggggccacggcgtcgaggaagatcctggccgtcgccttctgggccaccgacgcctgctccttctccacgagcgc

SEQ ID NO: 50044 - DNA, 384 bp, Zea mays
  unsure at all n locations
  Clone ID: LIB3067-037-Q1-K1-H12
cccacgcgtccgcccacgcgtccgctgtgaactagaggcatcaagaggttgttttcatttgcttgtggttcatcgtacctnctgttttgtgcatgttgtaccacaggtatctagcaggtcacttaagaaggccattggattcaaaactcatgtacgctactgtgatgcattgatggtcctgaagtcatggataatgtcaaaggtaccctttagatcaagcattccttccaagttgtccaaatgttaggcatggaaggaacatggagataggaggtggcaatggtgaatggagtntattttgttcgtataatacttttcattcatngtctcatttacatttaatacccttctcaaaccctttaaattatctatgatctatctatg

SEQ ID NO: 50045 - DNA, 423 bp, Zea mays
  Clone ID: LIB3067-037-Q1-K1-H2
tcgccagcttcgcatcccgcaagttcccagtcagtcgagcagccagcggcggtgccaagaagggcgaggtgcgagctccactccccacacctcagaagaaaaaggtgatggcgcaactgccgccgcgggcgccgagcgccgcgccgcaggaccactggccgccggcggcgggggagttcctgggcttcgccgcggccaggcgcggcgcgcaccgccgctccgcgagcgactcggccgcgttcctcgaggccgtgcccattgacgacgacgtcgtcattggcggcggcagctgcggcggcgacgacttcgaccgtctcgaccacgaccagcttctgtccatgttctccgacgtcgacgtcttcgtcttcgtcttcgtctacggcagcgcctgtgagagggcgcagcttatggacgcggtgggtg

SEQ ID NO: 50046 - DNA, 328 bp, Zea mays
  Clone ID: LIB3067-037-Q1-K1-H3
gacaagcagtggctggacaagaatgcatcttacatggacttcaatgaggtgctgaagtcgacgacgagcccagctggagagggagcttatgctggacgatgtcatccgcatcgaagacatgccgtcatacagcctgctttgctagtaaccaaaataccaaattcgccggagaacagaactgagttgatggttcaactgtatagtacctccctttgtctgatttctgggaggatttttttttagcaacaaagtagagtgtcgacgtactggtatcatgcttaatttgggctaatgatggtgatatgcacaaaataaaaatatatattat

SEQ ID NO: 50047 - DNA, 409 bp, Zea mays
  Clone ID: LIB3067-037-Q1-K1-H4
cccacgcgtccgccgccttcttcttcttcttcttcttctcctctgcccctgcttgtcgtttgctcgtgctcccccaccccctttctgattcagcaagggttccttccgcggcgcggcgcgtcgccatgggcaactgctggggcgccaagatcagctccgacagcccgtcccgcggcgcctcatccccgtcagggacggcgtccaagttggcgagcaggaacggggcggcggcagccctgagcgggtgcagcagccacgcgtcgtccgcgtccatgctgccgacgccccgcagcgaggacgagatcctggagtcggccaacgtcagggccttcagcttcaacgagctgaagaccgtcaccaggaacttcaggccggacagcgtgctgggcgaaggcgggttcggatccgt

SEQ ID NO: 50048 - DNA, 212 bp, Zea mays
  Clone ID: LIB3067-037-Q1-K1-H6
cgtccgaaataaaaacatttcggtctcatcttcttccacatccatcctccatcactccagctgggtggtctaggaccgacttagcgaatttcgaagcaagggactgaagaggaacctgaggaaggcgaaaatgatctaccggaactgggagctgttctcgtccacagtcgtcatttgggtcggcttcgccaccgtcagcctcgccgctatct

SEQ ID NO: 50049 - DNA, 316 bp, Zea mays
  Clone ID: LIB3067-037-Q1-K1-H8
cggacgcgtgggcggacgcgtgggccggagatcagtagtgcaagtgcaagctttcaaccgggtccagcaacatcagttgatgattcagtatcaatgtcacaacatttgcctgcttcatttggtgatgcttcacggatcagcagcactgatattgttggtgcacctagtgtccaagagacagatgacatgcaggttgatagtcatgttgctgaggactcagagccagaaaacgatgatctttatttatcaaattgtcgaatttctctggtgggttttgaagagtaagagttggtaatgcttgtcatgctgatacgta

SEQ ID NO: 50050 - DNA, 438 bp, Zea mays
  Clone ID: LIB3067-037-Q1-K1-H9
ctcaaaaggcaaacattgatgcagcggtgaataagttttcagataacttcacaaggatgttgttccattatgatggtcggacaactgagtgggatgaatttgagtggtcaaaaagggccgtccatgtgagtgtcacaaagcaaaccaaatggtggtatgccaaacgatttctacatcctgacattgttgcccgctacgactacatatttatctgggatgaagatcttggtgtcgaacattttaatgcagaggcgtacattaagcttgttaggaagcatgggcttgagatctctcagcctggtttggagcccgataaaggtttgacatggcaaatgactaaacgaagaggtgatcaggaagtccacaaagtaactgatgagagacctggctggtgtagcgacccttacctgccaccatgtgcagcgtttgttgaaatta

SEQ ID NO: 50051 - DNA, 382 bp, Zea mays
  unsure at all n locations
  Clone ID: LIB3067-038-Q1-K1-A1
nccacgcgttcgcccacgcgtccgcccacgcgttcggttgacagtaagcccggtgtacacagagaggcgcacagcactgccctttcactgtgacatggtcctaaggatgcggcggcttctacactacgcagataagtatctatctgaacctaagggagagacaactcactaattgtcatgtacaattaatatctagctaggtaggtatgtgagggcacatttgacgagctttgtagactgattttgcaataaccctgataacttacaggtggatgctgtaacctttatctctttttttaggtctgtattgtttgtcgacacaagatttgagatatgattccgtttgtcgactgtattaatcagaattacaagtacagcgttt

SEQ ID NO: 50052 - DNA, 396 bp, Zea mays
  Clone ID: LIB3067-038-Q1-K1-A10
atcagcaagcatgagaagcgaatgaatgtacagtatacatgtcagtcgccaactgctagggctttatcgcgatccactatacatgcgtcagcatcaacggcgacggtcgcaaggatcgcgatgtaaactactgtaccagagattaacagatgatcccaatgactgctgaatatgtaaaactaacatgtgaacacattatcatatataatgacaagtatgttgctcactgcataactcctttaatctatctttgcactagctctatcacaagtcactgcggtgctaaaccatcattaatcaaatcgacgcctgattacaaagcttactatatgaccataaacacgtcggaactcatgtaccatactgtgatctatatgaatgctaagtacctacgac

SEQ ID NO: 50053 - DNA, 400 bp, Zea mays
  unsure at all n locations
  Clone ID: LIB3067-038-Q1-K1-A11
cggtcccattccccccgcccacttgtcggactcaagagctcccctcctccgcgccgcgggcacgcgcgccgtcgtcgccagcccgggttcatttctccgttccttggtgcggtggtagccgagcgctccggccatggcgttctatcggggcctcaccgcagtctcgagactgcgatcacgcatggcgcangaggccaccacgctggggggtgtgaggtggctgcagatgcagagcgcgttcgatctcgatcttaagtcccagttgcaggaattgattccggaacaacaggatcgcttaaagaagctcaagtcagagcatggaaagacccagcttggaaacataactgtggatatggtccttggtggaatgagagggatgactggaatgctttgggaaaca

SEQ ID NO: 50054 - DNA, 363 bp, Zea mays
  Clone ID: LIB3067-038-Q1-K1-A12
gcgtgcgtgaaattcgtttgtaggtggtggcgctgctccagttgctgctgccgccccagctggaggggctgcaagtgctgctgcccgtgctgcagaggagaagaaggaagagcccaaggaggagtctgatgacgacatgggcttcagcctgttcgactgaggaggccctcgctacccagccattagcaaattcccttatgctgtccaagacttatcttacgctatgtctgtagccttttgttattacaagtactcaagttttgagtttttgagatgtggctatgacaatgtgatgaagaaccctaaaccatcgtattagagtgaaacttgtttctatatagagttccaagtttcttgaacctc

SEQ ID NO: 50055 - DNA, 406 bp, Zea mays
  Clone ID: LIB3067-038-Q1-K1-A2
cagctcctcagttgaaaagagctatgagctactctgatggccaagtaatcaccatcggtgcagagagattcaggtgccccgaggtcctcttccagccatccatgattggtatggaggctgctggaatccatgagacaacatacaattcaatcatgaagtgtgatgtggatatcaggaaggacctctacggcaacattgtgctcagtggaggttcgactatgttccccggtatcgctgatcgtatgagcaaggagatcacttcccttgcaccaagcagcatgaagatcaaggtcgtcgcaccacctgagaggaagtacagtgtctggataggagggtcgatcctagcctcgctcagcactttccaacagatgtggatattccaagaggagtatgatgagtctggccc

SEQ ID NO: 50056 - DNA, 435 bp, Zea mays
  unsure at all n locations
  Clone ID: LIB3067-038-Q1-K1-A3
cccacgcgtccgcccacgcgtccgcgccgtcgttcgccccctccgcgacagcctcccagccgactgctggacctgggtgagcgcatttcaactgcgcccctcccctccgccgcagcacccagcccccttatgccatcccgctggtctcaacagctacactgtgttctctcgctcctcaccctgggtgctctgtaccgtcgtaccgatgctaggcatggacggacgtcaaagtgacttcccctcaactctcgcgggtggccacatataaattgtccctaaataaaacgacgctgcaattgacgtcttcaagggaatcgacaaacccttttgtggagcaggccatacaattctncgtagcagctgctaaagcgaccattattgataaggagaggaaggatgtagtagataagttactgctgcaaggtctgaacatta

SEQ ID NO: 50057 - DNA, 413 bp, Zea mays
  unsure at all n locations
  Clone ID: LIB3067-038-Q1-K1-A4
cccacgcgtccgcccacgcgtccggaaactctttcggccagtggaaaaacgatggaccatgtggatttgttgagagaacagttgaaaattttgtcaggggaggttgcgtttaatacaagtgctcttaagcgcctcacagaggaagctggaagaagcccaaagaacgagaagattcagatggaaatgaagaagaagaccgatgaaattaaggggaagcatcaacagatagcatctttggagagagagatagctcatgcaacattaggaactcaaggaaaggtcgatacgttagagcattcaccgtcttatcatgaactacttgagcagctcaatgagaaatctttagaacttgaggtgaangctgcagataatagagtgatacangatcagctgaatgagaagataacttgatg

SEQ ID NO: 50058 - DNA, 433 bp, Zea mays
  Clone ID: LIB3067-038-Q1-K1-A5
ccgacaacatccccggcaagtgcggcgtttctgtcggcgtgcccatcagccccaccgtggagtgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatactgcacaaggttctaaattataataatgaatactttttttgt

SEQ ID NO: 50059 - DNA, 355 bp, Zea mays
  Clone ID: LIB3067-038-Q1-K1-A6
gcaggctatagtatgcataaagtcacggtttctaagtgggtaccagctcaattttcaggggagtatcatagatctcgagagattggtctcatcagctactgctcctgatgatatcgatagctctggccttcacagctaaatgcatattcagcaaatcaaggatcccagaatagttctttggtttctgtttttacttcttttttctaggtgctcatgtaaatagtccttacaacttgtgaatgcgacttctattgctgtcccctgcacaatcccagggtcagaactgcagcgagcagctcgtgcttgcataactatgacacttcataatcatgtactcattgtggtagatcttgta

SEQ ID NO: 50060 - DNA, 398 bp, Zea mays
  Clone ID: LIB3067-021-Q1-K1-G10
gcgacctggcggaccgtgggatccgcggccctttttttttttttggcgggtaagatcaatcagcatgtcctaatctctttgcccattgtgccgcagatcaagttctggatgttaccaagttacggaagatacaaaattcttccgctgagcatattgctctgcgttattcaacggccaaaggaaaatgactatttctataactcgcgtttaaatattaacagccaaggttgggaaaaagcagcatttgtgaaaagcttcaagcagccttgttcttgcagtagttctccagccactccatggtaacactcttcggcctctcaagtggcatgccaagggcacggtcccagatgagctgagatcctatccccatgctttttgaaacaccgaacaagacagtg

SEQ ID NO: 50061 - DNA, 332 bp, Zea mays
  unsure at all n locations
  Clone ID: LIB3067-021-Q1-K1-G12
cccacgcgtgcgcccacgcgtgcggttctatctgaccgcaacaactcctcattacatcggttatgagaggctgatcgattggtagatacgtactcgggtggagcagagcaacgagagacatggcgacgacgacgcgtgttgccgncgtcgtcaccggcgtgctgctggtcctgtcggcgttggcgaaccttgcacgggccgaggacccgtacctggtcttcgaatggaaagttacctaccggaacaaggtcctggttggccttccccaaaaggtcattcttattaaccgctaatttcccggtcccaggattaaatggttcttcaacaacaac

SEQ ID NO: 50062 - DNA, 251 bp, Zea mays
  Clone ID: LIB3067-021-Q1-K1-G9
gccatccgcttgtactttgccgagatcgtctccgcggtcgcgcgaggccacgctgcgagcgtcgagtgccgtgacctcaagcccgagaacgtgctccttcgcgccgacggccacgtcacgctcaccgacttcgacctgtcccgccttctccaccccagcatgtcgtccgcggagtcgtcgtcgcccccgcggacagcgtcgtcccgcggtcaccacaaccgtcggtcgcgcgttctcgcgcggagcgactc

SEQ ID NO: 50063 - DNA, 416 bp, Zea mays
  Clone ID: LIB3067-021-Q1-K1-H10
gtgttccattccttgacaaaagtttcatcagtgtagcaatggacattgatcctgaatggaagatgataaaacgtgacctcggtcgaattgagaaatgggttatccgtaatgcatttgatgatgaggagaggccctatttacctaagcacattctctacaggcaaaaggaacagttcagtgatggtgttgggtatagttggatcgatggattgaaggaccatgccagccaacatgtctccgattccatgatgatgaatgctggctttgtttacccagagaacacacccacaacaaaagaagggtactactacagaatgatattcgagaaattctttcccaagcctgcagcaaggtcaactgttcctggaagtcctagtgtggcctgcagcactgccaaagctgttgaatgggatgca

SEQ ID NO: 50064 - DNA, 334 bp, Zea mays
  Clone ID: LIB3067-021-Q1-K1-H11
gttgagatcataacaaaaatggctgctttctatggagtaagacgtgtttgggttggacagaacagtctcatgtctactcctgctgtatctgctgtcatccgtgaaagaatcggtgcagatggatcaaaggctactggtgccttcatcttgacagcgagccataacccaggtggtcctacggaagactttggtatcaaatacaatatgggaaatggtggacctgcccctgaattttttaccgacaagattgtctctaatacaacgacaatctctgaatacctcatctctgaaaacctttcagatgttgaaatatcatgtgtcggtgtcaccagct

SEQ ID NO: 50065 - DNA, 420 bp, Zea mays
  unsure at all n locations
  Clone ID: LIB3067-021-Q1-K1-H12
attcaagcacctcctattcccccgccgggcaacaactcagccgccgcaaccgccacatgagccatgggcgcctgcgcaaccaagcccaagacgcttgaggggcaggccacagctgaggccgccgtctacacacccaaagttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggacgtcgccgagcccgaccacaaggaggacgaagccgtggagaagaccgtcgtcgaggaggaaaagccagcggcagcagcccatgcagaggaaaaggtcgccaccgncggcgagaccacgacgactgtggaggcgaataaaacg

SEQ ID NO: 50066 - DNA, 287 bp, Zea mays
  Clone ID: LIB3067-022-Q1-K1-A1
cccacgcgtccgcggacgcgtgggatttaaacgacttaagcaggagaaacaggaccgtgcagctgctgctggcaaaaatattgatgagattcctggagcggaaggacttgttgtcagagttgtttcatcagtggataagaagctggaggttaaaccacgttttttagaaatttttcaagaagacaactaccctacagagttcccttacaagtccaaggctgttctcttgttccagaaaatagaaggtgtggaagtatgtctatttggaatgtatgttcaagaatttg

SEQ ID NO: 50067 - DNA, 421 bp, Zea mays
  unsure at all n locations
  Clone ID: LIB3067-022-Q1-K1-A11
ggctgcccaagcgccgccgccacagctcgataccgccgcgggtattctcggcccgtaccagtcggtggcggagcgctcgcctgctgccgcgtacaacaccgacagcccagatgggaattgcttcgacaaaaatcgctgggggcatggttttgggcatctncttgcccaaaaccatctcccgatcaatggaggagattgtggaggcatcaagaattcgggagtacaagaaatttgattccagtacagccagcaagactccatctcgtggtccttttccgctacctccaccgcccaagtctgctcctggcaagctagtggactctaaagccctagaacatcttgatgcaccagttatggcggattgtctctactccgtctatgctttttgtaagggcctaggcctctgctacaaatgtggatt

SEQ ID NO: 50068 - DNA, 353 bp, Zea mays
  Clone ID: LIB3067-022-Q1-K1-A2
cccacgcgtccgctctctcgtagccgcgtccacctcgcagcagcgaggccagccaaaagtagattcggcgccgtgggcctgccgtcctccagctgaggaggaaaggcagctatcggcgaggaagggtggtggactggtggtgctagcggtggtggtggtggtggtggtggaggatcccctctcacgtcaagcgctgtgtggaaagcataaaggcgggaggaggaggagagggcgaaggcgcatagctttcccgacgcacaaagcgaaaaggcttcataaagaagaaagcttccgtcttgggagggagagcgaggcatcctgcgtgtgagcgtgcgataaatagcggctccagg

SEQ ID NO: 50069 - DNA, 372 bp, Zea mays
  Clone ID: LIB3067-022-Q1-K1-A3
cggacgcgtgggctagctagctttccccagctcttcttccacagcactgtctgtctggcaattaggtgtactaatgcgctagtggcactgctgctactctcgtgtactcccagctatctcctctctatactcttgtacgtacgcacgtgtcgcaaccgcaatggagtgcgagaccgggcttgtgcgctccctgaacagcgagggcctgtgcatgtcggcagcggcggcggcgccacgcgccgacgccctgaactggcgcaaggccgcagaggacctgtacgggagccacctgtacgaggtgaagcggatggtggtggagttccgcgagccgctggtgaggatccagggcgccagcctgagcatctggcaagt

SEQ ID NO: 50070 - DNA, 363 bp, Zea mays
  Clone ID: LIB3067-022-Q1-K1-A4
gtttccctcccccaaaactactttcccacaaacccagaccagagcagcttgcgtctatcgtttcttttcttgttggccttctccttgccttgcttttgcttgctcgttgcttcttgagctcgagcccgccccttctgcgccttgcccaagtctctgtgtgttttttataggcttgagagcttggaatagcggggggtggaggaagcggaagaggagcttcgttttgtgttctagagggagtcatgttccatggcggcaggcctctgtccctccgggggtctctcaaggcgcttgaagctgatatccaccatgccaacaccctggcgcatgctatacacagggcgtatgggggtgcctgcgtgc

SEQ ID NO: 50071 - DNA, 459 bp, Zea mays
  Clone ID: LIB3067-022-Q1-K1-A6
cccacgcgtccgcccacgcgtccgaagggaaggcaccattgctgatagctgtgctctattgtacaatgaaattcaaagactggtggaggcaaacagggctggagaaaatgaaggccagttcaccatcgttatagacgacgcttccctgttggaagtcgtggcccttggttctgtaagcgatgtgctggatttcttgcactattgtttcacactcacgtctgagatgaattgcaagctagtgatcctcattcacgaggatatatacgcaaatgaggagaacatgggtctccttttacatctgcgctacattgcggatcttgtgattaaagcagcacctttaagcactggtttggctgctgatgttcatggacagctggcggttgtgaacaagggtacattcagcgagcaaagggcaaaagcacagaaagtttggaacttccatttaaagtggaagaaaac

SEQ ID NO: 50072 - DNA, 367 bp, Zea mays
  unsure at all n locations
  Clone ID: LIB3067-022-Q1-K1-A7
cccacgcgtccgcccacgcgtccgcccgtcacaactcacaacccgagccggccaaacgcgaagcagcaggagctcccctgaccctgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcatggctacccaccgcagggctacccgcagcagggctacccgccgcagtacgcgcagccgtctncacagcagcagcagagcagcgggccttccttcatggaaggatgcttggctgccctctgctgctgctgcctcctgga

SEQ ID NO: 50073 - DNA, 288 bp, Zea mays
  Clone ID: LIB3067-022-Q1-K1-A9
gtttgcaccggatgtactacctttggccattgtctcttgatccgtccagtgttacgtcactactgtagagaagagaacggttttggtccttgaggcgccccctgtactggtgttgacgctgtagaactgttacttaagttgcttgggatgatcgtcgttgtccttagattatcttaagactagtaatctgagcttagtttacgctcatgctgaacatgtatcacggcttcagcttaattaccatcggtggaaagaccagtggagcggcgaacgcacaagcggaccggc

SEQ ID NO: 50074 - DNA, 301 bp, Zea mays
  Clone ID: LIB3067-022-Q1-K1-B1
gttatagggcgagaaggattatgctctgcccaaattctcagataaaattatgaagtttcaagtgaacccagtggctgcactttcactttgaagacttgcagaggaaattcatggtcacttcattttgtgaggttaattatagagaaagggtagaaattatatgaagaaacatagtaaaaaatcattgttaggaacaaactccaatagcaggctctacttgtacgtcgcagacataagctgagactgagctgcgattgcaacagattatactcttctatcatgttgactgaagttccctcag

SEQ ID NO: 50075 - DNA, 399 bp, Zea mays
  Clone ID: LIB3067-021-Q1-K1-F9
cctgagccaaggactggagaggtgtgcatgtctgccagctttaacatcattcctagcagcgcctgttctgccaaggctgttggtcaagttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgtggaagaggatctggtttctaccgacttccttggtgacagcatgtcgagcatcttcgacgccaaggccgggatcgctctgaacgaccacttcgtcaagctcgtctcgtggtacgacaacgagtggggctacagcaaccgc

SEQ ID NO: 50076 - DNA, 331 bp, Zea mays
  Clone ID: LIB3067-022-Q1-K1-B10
cccacgcgtccggggatgggtaccgtggtggtcctcgtggtgctcctggtgactttggtggcgataagagtggagctcctgctgagttccagccatcattcaggaggcctggctttgggcgtggtggcggcagcggcttcggcgcgggcccaacctcttcttccatggagtgaagttgcccttggtttggacatggtgtttcccttcgcatgtggcctttagttttgaaggacagttattatgtactagtaatgttactcggatcggccagtgctgacatatgcaaaaaaatgttcttgtcgttatacattggttccagtattattgtctt

SEQ ID NO: 50077 - DNA, 291 bp, Zea mays
  Clone ID: LIB3067-021-Q1-K1-A11
tcgcgggcgccttggggccgccgtgcctgtttttcccaactgcagcaaccggccagtgcgcgcggtttctttgcatttgcatggcttcgcgcttcgctctgggagcttgcactagccggtccgcggcctatgcgcggggcatctttcgagtgcgtgcgtatctgttcaagctctgatcggctcttcggcccattcgtctgaagaaactgaccgtcggcttattgctcttgctctttaacctaatcccggggctgagaagggaagagaagaaggcacgtccacaccttaaag

SEQ ID NO: 50078 - DNA, 282 bp, Zea mays
  Clone ID: LIB3067-021-Q1-K1-A12
aaaaaaaaaaaaaaaaaaaaaaaaaaaatttaaaaaaaaaaaaaaaaaaaaaaaaaaagggagaaaattttaaaagatcaaaagctcacaccaaaataaaatacaaaaaaaatacctgtgctatagtttcactgaatcgaagttcattgccccgagtttcccaactctttctactggaaaaaccctgactcaaccaaattcaatggccttgcattacattcctacatcctcggataccctagtagcgaccaggccctaacagttcgccctatatgacctttt

SEQ ID NO: 50079 - DNA, 392 bp, Zea mays
  Clone ID: LIB3067-021-Q1-K1-B10
cacaaaggaggggacacacacacacacacacaccgtctccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccagagtgccaggcggagacggcggtcaccccgcgccggctggccgagctgctcgtgtacgtgtcggccgaggtgggcatgaccgtggccgcgttcgcgcaccacgagctcaacgccatcaaggacgacgacgtcctgtacaagtgcatcgacacctgctccg

SEQ ID NO: 50080 - DNA, 432 bp, Zea mays
  Clone ID: LIB3067-021-Q1-K1-B12
gccgagctcctcgggaatccggtgccaggcctcgccttctcgcggcggtgctccctccggcttcgtcccccagcgacgcaggcaggcgcgcgcgcggccatgaaggggggcggtgccatgaggccgtcgcctatgttctacgtccacgaggcggacgtcgtccagatccaccacttcctcgaggagtgctccctctgcgccaaatcgctctccggcgacatcttcatgtacaggggtgacacgccgttctgcagcgaggagtgcagggagcagcagatcgaggtggacagggcgaagcaccggcggaagaagcgcgcggcggcgcacgcgctgtccgcacgcagcagggagcaccggcaccagcagcagctgcagcagcaccaccaccagcagcagcaaccgcagccgctgaatgcccgcatggacacccgc

SEQ ID NO: 50081 - DNA, 388 bp, Zea mays
  Clone ID: LIB3067-021-Q1-K1-C10
cggacgcgtgggcggacgcgtgggtttttttttttttttatagtgaataacaatctatggatccatatatcaacttacacagagaagttcagtacgaaagcgaaagagacaataaacatcaaagttgaatcaggagacatatgcatgtacatatacataaatataaaagaacaattttacggcgtctcgatgtgtttacgcatgcatatatccgcatgcatgcattgcagcggaccatcgcctcttaatctccctggtcgcccgcccctggcagtgagtgactgctggtgcccacatgaatgaagtcttcttgagatagagcagagcccctttggttgattattattcctcggaagcggaaatgaaccggacgacgggacgagagaac

SEQ ID NO: 50082 - DNA, 342 bp, Zea mays
  Clone ID: LIB3067-021-Q1-K1-C11
cgcgtccgcacgtgctcatcgtcctcgcggctgccgttgcggtcctggccgcgcggcctgcgtctgcggtctgtttagccgctgccgtggccgatatctgcattaagactccgacccccgacctgtgcaccaggactgcagggaagcacgccaacaagtacaaggtggtggactcggagactgtgctagagatgcaagtcgactcgttcaagaagcgcgtgaaagcagcgcggatgctcgtcaaggaggaagtcaagactgccgcgactcccgaagcgcgtaaggcgctgaaccttttcaagacctactacctggactccgccgacaacctcggcgcctgca

SEQ ID NO: 50083 - DNA, 117 bp, Zea mays
  Clone ID: LIB3067-021-Q1-K1-C9
cccctatcgcggagttacccgtgatctataccacttccaccctgatacctcgttccattcaaaagcgcccctggcatgcatgtctacccaaagctatccatactttattcttgacaa

SEQ ID NO: 50084 - DNA, 390 bp, Zea mays
  Clone ID: LIB3067-021-Q1-K1-D10
cggacgcgtgggcggacgcgtgggcggactcgtgggcaagtaacattgaccgcaaacgggtcatcgtccggtgcggtcaatgtaattaactaagcttctcaatcatacatagcttggcaaatgcctgagggctagctagacaaggtccgttgagctagcccctttgggaagaagggagaggaatggcgctggtggcccgttgagcgaggaagaggctattgagaacccgttaacaagaattgccagcagcatctggacaatcttgttaacagagttccaaaggttcaattccaagcggatacaatttccgagttggatcgagaagagtgcgtgcatacgtccgtccacgttcgtggttcgtataagctaggtttcatcaaccatgggcac

SEQ ID NO: 50085 - DNA, 378 bp, Zea mays
  Clone ID: LIB3067-021-Q1-K1-D11
gtcctcgaccatccctgcaaattatcgttatggctcccaagatcctagtcatccttgtgttccttttcgaggcctcaccggctgctctggccgacttcgatgtgatagagatgctggccgacaagcccacgtactccacgttcctgaagctcctgcaggacaccaaggtcgcgggcgaggcgaatcagctccggtcggcgacgctactggtcgttcccgacaaacttgccaagcctctggcgtcgctgcccgccgataaggtgcggccggccgtggagaaccacgtccttctcagttacttcgaccccatcaagctggacgagatgaaaacacgcaccgacatcctacccacactgctcttcgtcaccgacaagaaac

SEQ ID NO: 50086 - DNA, 120 bp, Zea mays
  Clone ID: LIB3067-021-Q1-K1-D12
cccacgcgtccggtgcgtagcttctctctatatatatacccgtatttaaattctcgacgaaatttgtttgaccacggtgatctgtcatatatgtcgtccattgatttgtgttaatttgac

SEQ ID NO: 50087 - DNA, 430 bp, Zea mays
  Clone ID: LIB3067-021-Q1-K1-E10
cccacgcgtccgatctcccctctccgcctcgcctctgcagccacagttccgttcgctcgacgcttctccaacgccgcttccagcaacaagccggagccactcctctcggaaccggatctggagtcaggtctgtatcttgtgtcaacgccaattgggaaccttgaagatatcaccttaagggcactgcgtgtcctaaaatgtgctaatgtgatactatctgaagacacaaggcattcaggaaagctacttcagcattacaacatcaagacacctcttcttagcttccataagttcaacgaacgggagagagagcccactatcttaaggaggcttcatgaaggtgaagcagttgcactgataagtgatgctgggacgccaggtattagtgaccctggcatggaactggctagactatgtgcaactgagaaaa

SEQ ID NO: 50088 - DNA, 371 bp, Zea mays
  Clone ID: LIB3067-021-Q1-K1-E11
acgcactcgtccgcttgaccaccgaagagagaaacgctagtctaccagcgatcgccccatggccgccatggctgtttccttctacctcgtcgtggcgccccttctcctcctctccctcctcgtctccgccgcggccagtgcgcggaccgtgggcgacaccgtgcatgacgcgtgcagcaagacccagttccccaagatctgcgtggacagcctcgccgccaagccggagagccagaatgcgacgccgcgcaagctggcagagctgttcgtgaacatcgcggccgagaagggatccgggatggccaccttcgtgcaccgcaagtacagcgacaaggaagacagcgacatattcaagtgctacgacagctgct

SEQ ID NO: 50089 - DNA, 410 bp, Zea mays
  Clone ID: LIB3067-021-Q1-K1-E12
caagaacctactcgcctcctacattgaccaacaactaagcctccgtgaccgccacatctgattaggtgcagccatgggtgcctgtgcaacgaagcctaagacgcttgaggggaaagccccagctgaggccaccatctccacacccaaggttgcacctgagaccactgccatccacattgaggttgcggcgaaacaggcagtagttgagaaggtggaggaggacaaggaggaggcactaacagtggcggcgaaacaagagccagcagccaccatcgagcctcaacagattgctggtgaggtgaccacttcggaagtggcggtcgtcgttgtcgagcctgagaacaaagaggaggaggaagttgtggagaagaccgtcatcgagaaggagaagccatcagcagtccatgaag

SEQ ID NO: 50090 - DNA, 395 bp, Zea mays
  Clone ID: LIB3067-021-Q1-K1-E9
ccacgcgtccgggcgaagggcatgcccggctccgttcgttccatgaaggcctaacccgagcgggcagtgtgttaagtagggcgcgagtgagagcgagcggccaatcggccgggagcgaagccagcgctagctgccgcctccctccccggtcctcgggtccgccgcgcgcgcgccggccgtcaccaccgcacgacgccgaccaccacaattagctagcagcggcgtcgactaataaacgacaatggcgtgcatctccctcgaggacgtccgcaacgagaccgtcgacctcgagaccgtaccggtgcaggaggtgttccagcacctgaaatgcaacaaggaagggctctccagcgccgagggagacaatctgctcaagatcttcgggcccaacaagc

SEQ ID NO: 50091 - DNA, 351 bp, Zea mays
  Clone ID: LIB3067-021-Q1-K1-F10
cccacgcgtccggcggcctccccatggctaggtcgggattctgggcgccgccgcgtggagcattgccgatgactgccactctggctgctcctacggtcaggttgggtcgggcggtcgcggcctgggtcgtgcgctggtgggcactgggtgcgaaggcatcggccagatttggggaaattcctcaccgaagatcaacagtgccgccgatccgctgctcacgatgaccgtctctaccactacttcgaccgccattgagcgcgaggacacgtgtcatccgaaaagcaagttggtacctggaatctcaagtgccaggagaagaacaagtggtcgaagaggagccggctaacactg

SEQ ID NO: 50092 - DNA, 349 bp, Zea mays
  unsure at all n locations
  Clone ID: LIB3067-021-Q1-K1-F11
gaccacgcgtccgcttgtgccccgcggtcatccggttttactttgccgagatcgtctacgcggtctcggagggccacttctcgggcgtcttgtaccgtgacctcaagcccgagaacttgctcctncgctccgacggccacgtcacgctcaccgacttcgacctgtcccgcctacttcaccccagcaggtcgtacgcggagtcgtcgtcgcccccgcggccagcgtcgtcccgctgccaccacaaccgacggtcgcgcgtccccgcgcggagcgactcggttctcagccagcacgtcaagtcgtactccaacttcaacaactccaggcccacttaccagccctggtccgt

SEQ ID NO: 50093 - DNA, 397 bp, Zea mays
  unsure at all n locations
  Clone ID: LIB3067-021-Q1-K1-F12
cccacgcgtccgcccacgcgtccgcccacgcgtccgcgaccatctccgtccacctcatggctccggcaagcagttgctatactcatccagggtcagatcagcaactcttgccttatcctgctggctggccgcagcaccggtggtgtggtggaggatggcattgaaatacgtggccagggtaccgtctccatggtgggcgccacaacgtcgtttggctggttcatgggtttccgtctgctcggtaaaatgcggcgcattgggaggacgggatgttgtgtgcgccgctgttagcttcagaccatgcatcgacattcacaaggggaaagttaagcagattgttgggtctactcttcgggattcatccaatgatggcatggaactngtgacaaactttgaa

SEQ ID NO: 50094 - DNA, 338 bp, Zea mays
  unsure at all n locations
  Clone ID: LIB3067-021-Q1-K1-A10
ggtgaaggtgttcagcaggcattgctgataatgctggaaggcacgatagtcaacgttcgtgaaaaaggagcaaggaagcatcctcgtggtgataatatacagatagataccaaagatattctttttatatgtggtggcgctttcgtggatttggagaaaactatatcggagagacggcaggattcttctattggcttcggcgcaccagttcgtgcaaacatgagggtcggtggcacttcaagtgctcaagtgacatcgtccttgttggaatcggttgagagtggtgatctaatagctnatggactttatccagaatttattggacgtttccctatcct

SEQ ID NO: 50095 - DNA, 452 bp, Zea mays
  Clone ID: LIB3067-019-Q1-K1-H7
cccacgcgttcggcagcggtgactgttgcggtgttgccgcatccacgccctagtcgaccacgccgcccccagcagcccgctgctgccgcggctcgcgcccccaggagcccccgccgtcgcggctcgcgcctcgtatccgtaacagctacaccgtgccgcctaccctcgcttcctgctggctgcatcgtcctcaggtcttccgaaggcgagctccaatccccaaccactattcacaagatgactacaaaacttgagcaatcttctgcggagcatcgtccagcaaaattcgcagcaccatcgtctttgacccccaagatctcaatgtttggggcaaaagctggattcatcatacctaagaacaagctggccggctcactcgtaatcctgagcaccagtgacaagaatgaaacaccaactgcatccaacgaagatagcagcaagcatgttcacag

SEQ ID NO: 50096 - DNA, 463 bp, Zea mays
  Clone ID: LIB3067-019-Q1-K1-H8
ccctattccacacgcgcagcctaggaagaagagcaacttgggggcgctacggggtatctcgctgctgagaatcaggacgtaacccgacactcgtccgcgcccagcagcctgtgggggtgaagtgctctgtgcttgcaggcgcctgcaacctctgcaacggtggcatccgcttcgtccgggagcagcaccccaacaggtattgtatagccgcgttgctcaattttcagtcaaatcacatgccgctgcagattgagtctaggagggagctcctgctcccgacggatgaagacagcattcacgccggaggtctgcgtcagccaccccagcgcctcgatggcggcgtcccgctccgcgagctgcttgttccgcttcggcttccccacgaactgcatccccttgaactccaccacggacctgaactcgttcgtcttgaggtgcttcgtcttgtacctgggcggtgtgt

SEQ ID NO: 50097 - DNA, 381 bp, Zea mays
  Clone ID: LIB3067-019-Q1-K1-H9
cggtcccgggttcgaggcacgcgtcacgccaaccttgacacagagctccttatagccgtctgactgcatggccgcctcgaccaagaccgtcgccgggctactcaccgcggggctcctcagcgctggtcgcgtgcgaggcatgccagcgtgaagctggaggaggacacacttctgggaagcctggccccagcccccgcgccggccgtcggcggtgccgcggggctgcccgtcggcaagccaggggcgtgcgccgacgacgatctggtcgatatgagcgacttaatcgggatgtgatggcctcgggatcgagctgcgcatggcgggagatggagaggcgacaagctgcgatctggcatccatgagagagaggagagggggata

SEQ ID NO: 50098 - DNA, 191 bp, Zea mays
  Clone ID: LIB3067-020-Q1-K1-A10
tcgcccacacgtacgcccacgcgtccttaaatatgcatattacgaacacagtaaccatcgacttgcatggccaacatgtccaacatgctatgaaccttctcaaaattcacatgatgatttgcatttgcattccatctgtcttactgagggtaattaccggttgtggttcagaatgttcagggaacgcaaaa

SEQ ID NO: 50099 - DNA, 187 bp, Zea mays
  Clone ID: LIB3067-020-Q1-K1-A11
tcgggcaatcagtgccagtttatctgttgctccacagttacatatcccacccatgggggacgtggagctgcaaagtccgttggaattatcttgtagcagtttctcggcaagatgagtcgcttcattcactgtacgtcggtgccggctactctgaaacttacatactataagaatctggtcccttact

SEQ ID NO: 50100 - DNA, 128 bp, Zea mays
  Clone ID: LIB3067-020-Q1-K1-A12
tcgcttgcaaaatcgcttgaaaaaaatataaatgtcctgccaaatactaacaccaaagggatctgtctacaactactaacaagcaatcatctttctcatgcatcaatattcagcttaaaacatttaaa

SEQ ID NO: 50101 - DNA, 322 bp, Zea mays
  Clone ID: LIB3067-020-Q1-K1-A9
acgcacgcgctctctctatcccctataatcctttgccatatattgatccgtctctgttacttcggtaagggggtcttcttcccttttcccaccgaagttcccccttctttcatcgatatctttttttcctgtcaccggccgcgacagggttccgttttccttgctccggccggctgtaaaagctttcgggcctcttaggtgcctcaaatccggtggtgctcggtcttttggtcctgaatccagtgggaagggaaagggtcgcttcagtgttgggtgactccgagacatgcctgtgctctacgcttaccgagattaccggtgc

SEQ ID NO: 50102 - DNA, 64 bp, Zea mays
  Clone ID: LIB3067-020-Q1-K1-B10
gtcgacccacccctccgcttgcagaatcgcttgaaaaaaatataaatgtcgtagctattattcg

SEQ ID NO: 50103 - DNA, 398 bp, Zea mays
  Clone ID: LIB3067-020-Q1-K1-B12
gactcttgggagggtgggctcacaaaaggtcataggttaacaagctgtggggaataatgtgcatgaactcaccaaaggtgggagctgatgtgtagtgtaaggctgaacaacaaataatggttaaagctgagcattctcttttaataagttggtcaaaaattattatcacttactaaatgtaagtgtatgccaacccaaagtaatagtaaatcaaaattaataataaaccataatgtgatgcaaatgacaaattaagttttacttcacaaattaattatgtgagtgttcgagctatctaggtggcgtctcctattcaggttgatggcgccaatgaataattattagttcttttattggtatccgttattttttttaaactcttccgctatgtaataatt

SEQ ID NO: 50104 - DNA, 189 bp, Zea mays
  Clone ID: LIB3067-020-Q1-K1-B9
atgcgggcaatcactgccagtttatctgttgctccacagttacatatcccacccatggtggaagtggagctgcaaagtccgttggaattatcttgtagcagtttctcggcaagatgagtcgcttcattcactgtacgtcggtgccggctactctgaaacttacatactataagaatctggtcccttact

SEQ ID NO: 50105 - DNA, 271 bp, Zea mays
  Clone ID: LIB3067-020-Q1-K1-C11
tcgtccacgcgtccgctcatgattccttatcccgttcgcgagcgctacacacgctatgagctggtggctgaccaaagcgagttacgaccaactccagctccatcttgattctcgatgcctagcccctgtgcttaagaacctgccatgtccagctataatactgtcttagtattctagcaagtaccacagcacaacgttacttattactgctcaatcattattggcgatacggaacatcaagtaacttcgtaaactgatgagcatcctgacc

SEQ ID NO: 50106 - DNA, 345 bp, Zea mays
  Clone ID: LIB3067-020-Q1-K1-C12
acgcttctaccgagtcgtgaactgctttactctacttctgtgtaatctgtacgacacggaacagtaacatgcatcataactctatatgggtgacacttgaaattgttacacactaagacgcactgaccgtaccctgcgctcaattgctcgatacttgaagcttgtaggtgaatgtatccagtaagttgaagaactggttatctaattatttatgtaccggggatccaccattttggatacgcttcatcaatataaaagagctccaattattaaagttaggagaaaatgacgatctctaaactattcttgagttgtcggccagctgccaagactaatggaattgca

SEQ ID NO: 50107 - DNA, 123 bp, Zea mays
  Clone ID: LIB3067-020-Q1-K1-D9
tcgtccacgcgtgcgcgcgtgattccgcatcccgttcgcgagcgcgacacacgctgacagctgagggctgaccttgccgagtcccgacggccttcagctccatcttgattcttgaggcgaaac

SEQ ID NO: 50108 - DNA, 410 bp, Zea mays
  Clone ID: LIB3067-020-Q1-K1-F10
acgcgtacgcccacgcgtccggtgccctgccaactacgctctgcccaacgacgacagcggctggtgcaggccgccttggcagcacttcgacatggccgagccggcctggctcaagatcggcatctaccgcggcggcatcgtgcccgtcaactaccaaagggtgccgtgtgtgaagaaaggcggtgtgaggttcatcatcaacgggcgcgactacttcgagctggtgctcatctccaacgtgggcggctgcgggtccattcagtcggcgtccatcaaggggtcgcgcaccgggtggatggccatgtcccggaactggggcgtcaactggcagtccaacgcgtaccttaatggccagagcctgtcgttccaagtcaccagcaacgactggcagaccaaaacctttcccgacg

SEQ ID NO: 50109 - DNA, 414 bp, Zea mays
  Clone ID: LIB3067-020-Q1-K1-F12
gaatcgacggacggacccacgcgtacgtgccaagatctgtcaactggaactttcatttcaggagatcattttcggctacaggaaacagcctcagtgcaagccacacgttttccgaagcgtgtatgttcattggcccccaagaaaccgtaacgggaaaacaggagaagaccaccttgacatcatgactttctacaacgaagtattcattcctgccgtcaagtccttgttggtcgatgtaggacctgtcaccagtccaaagaacaaagaagaggaaaaagatcctgctgatatatgtccattcccagaatctaccctgctggctcggttgccgaaccatcccgacatgttttcaaaaaagtttctgcttcccataacgagtacgtcttaccgatcggtcattaaagatggacactt

SEQ ID NO: 50110 - DNA, 152 bp, Zea mays
  Clone ID: LIB3067-020-Q1-K1-G10
tccggaatcccggtggaccaccgtcgccaaatcttaactgactttattcaggagatattttcggctcaggaacaggcctatgctgccacagtttcgaagcgtctatttcatggccccaaagccgtacgaaacaggaaaaccacttacatata

SEQ ID NO: 50111 - DNA, 325 bp, Zea mays
  Clone ID: LIB3067-020-Q1-K1-G12
gcgatcacgcgttcgcagtcttctcgttaggcagcctctttctcgtcgccgccgacgggacccggcgcggctgtcgggatgccggtcagggtggtcgataccgccacgcctttctcgcagcccttcccagggcaagaagcaaatactggacacccatctcctcctagatgttcactcttaagtgctggaagatcttttgctggaactcagaatgtttcaagtctgcagaaggatgaagcatggaaagtgaatgtccgcatccatggttgcgatcttgaacaggggtatctatgtggaacgatgtgaagcgctaatggtccattag

SEQ ID NO: 50112 - DNA, 338 bp, Zea mays
  Clone ID: LIB3067-020-Q1-K1-H11
accacgcgtacgtccacgcgtgctttaatagcatataacgaacacagtaaccatggacttgcatggccaacatgtccaacatgctatgaaccttctcaaaattcacatgatgatttgtatttgcattccatctggcttactgaaggttattaccggttgtggttcagaaggtacagggaagggaaaaataaagcgctcggttatagagcttgcggagaatgaacatattgagtggcgcgaagaagaactctggaactgtagcccttcgacttggtggcccaagagagtatcggttccttgaccatgaaagcgtatctaacctaatggggaactttaac

SEQ ID NO: 50113 - DNA, 402 bp, Zea mays
  unsure at all n locations
  Clone ID: LIB3067-019-Q1-K1-H5
ggcgcgggctgcctgcgcgaccagggaggcagggcacgcggcaaccacgtggggaggcgacgacaccacaccaccctatgctctctgtcctcgcccgcagggtaagattgcagcagcagtgaatttgggagcttgaagctttcatccgagacatggaaaaagtgatctgccgggcatatctccttcaatgcaagcgattcttttcgaaagaaactcttgattggtgtgtcttagcccgtgggaacacccatctctcctctctggtgaactacacatagtggttatatgctcctctatgctccacaacaagcaggctgatgcgatattttcctgaagttattatattccagtctatgccagacatctacatgtaactncaccaccttggtcttcctttggttt

SEQ ID NO: 50114 - DNA, 254 bp, Zea mays
  Clone ID: LIB3067-020-Q1-K1-H12
caccgtcgccacctacagcaccgtcgtagttgcaaattgccgacttcggccggcgcgtgccttctgtcattccccggacgagatctcactcgacgagtagcttactctcaattgtcgctatctaccccagggcaatgctccaggaaggacggcgccgtgtatcaacacagacggggcgcgcagaagccgatcaagtgcttacatgcacccatgcgcgtcagaccagcgcaggtttcggcctcgtgcagactacc

SEQ ID NO: 50115 - DNA, 357 bp, Zea mays
  Clone ID: LIB3067-040-Q1-K1-D1
cccacgcgtccgggaagagcgggtccgccatccttcacaagtccaacacgagcgatgacgagcttgatgagctgagctccccacttaccttcatctccaacacctcatcagacccgcttgcgaagctgaagcggatcagcaactcgaccacagcgaggtataggcttctccatgaggtgtggaagctggatgaccagtaggacttgatcctatcaccaccatggttctcccctctgtatataggtttgtttttttgcatatgattccggctcatgtataagatttcagtctatttgttatgttatgttacaagaagatgaggggcaagcgttgaatcttaataaatccgctgtgtct

SEQ ID NO: 50116 - DNA, 383 bp, Zea mays
  Clone ID: LIB3067-040-Q1-K1-D10
tcgcccacgcgtccgggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggc

SEQ ID NO: 50117 - DNA, 429 bp, Zea mays
  Clone ID: LIB3067-040-Q1-K1-D11
cccacgcgtccgcccacgcgtccggagcgttctgtttctcacatccggccgaccttgttgctgctgcttcctctttgctggcatggcacttggcagggaagctgagcgtggaggtggggaagaccagcgatgtcaaagctgtgtgcctttcgcacccgtacagcgtcactgccgacgacatgaaaggtgcagtgcagtgcagtgtgctcctcctcttcttctatgctgcttcactagcctcaccgcatgtgttcgttcgaaatcgaaacagaggtgaaatggccgatcgagatcctgggggcccagaacgacacgaccacgccgtcgaaagaagtgtaccggttcgtgcatgtgctgcgtgaaagacacgaggtgagctccaagctacgactgattgcaatgacactgtgtggatcggataccggccag

SEQ ID NO: 50118 - DNA, 414 bp, Zea mays
  Clone ID: LIB3067-040-Q1-K1-D12
gttactgattctagccgccgtcgctgctcatctgacattcctcgagaagacgcctgctcggcgccgatcgatacgatggccgtcttctccgacctccacaccggcgacggcctcaagtccctagaggctcacctcgccggcaaaacctatgtgtctggtgactccattactaaggatgacattaaggtcttcgccgcggtgccgtcgaagcctggcgctgagtttcctaatgcctgccgctggtacgagaccgtctctgcggctgtagcctcaagattccctggtaaggctgttggtgtaaatctgcctgcgggatcagctcctgcggcagctgctcctgcggatgaggctgacgacgatgatgaccttgatctttctggtgatgaaactgaggaggacatgaaagcagctgat

SEQ ID NO: 50119 - DNA, 347 bp, Zea mays
  Clone ID: LIB3067-040-Q1-K1-D2
cccacgcgtccgcccacgcgtccggtttactacttacgttgtacgactctattcccccggttcgctactggcttattaagtttggcgtcattgttttcttgatctctgagatgctttgctttcaccacctgcttttttgtcatctgtgtacattgagtcgacggacaatcattttcttgcttcgagcaggcgagagcagcacacgagttgcagacacaacatggaattacactctgtatataggtttgagtttttgcatatgaaatgcagctcatgtataagatttcagtctatactgctatgatatgttacaagaatatgaggggacctcgttgaatcttaataaa

SEQ ID NO: 50120 - DNA, 423 bp, Zea mays
  Clone ID: LIB3067-040-Q1-K1-D3
gaacagcgtcctacctatgtcgaagcgaagcaggtgcaccaggtccaggttactgctggcctcatgaaggctgaggataaccatgatctgcaccagaatgcaagggctactgaaacaggagttttgggagcagatgctgagagcagggtagcagagcgaccacggctgaatctgaagcctcgttcctatgtaacaggacagtctgatgaaattgctgtcaaggaaaggccatctctctttggtggtgctcgccccagggaacaagttctcaaagaacgtggagtggatgttttggccagtgatctcgagaagacttcaccagttggcaagcctaaaggcgaatttgcaaaggttgagcagaaggttgaagctatgtccattaacccttctgttgaaagacatgagaagtttgcagctggtcat

SEQ ID NO: 50121 - DNA, 440 bp, Zea mays
  Clone ID: LIB3067-040-Q1-K1-D4
gaacatggagatcttttgctctcacgcaagacgcaacaaaaggtttggatagaacactctgcttccccgtccttcggtctagcccgagtggacgtaggaagggacgaggggtcttgacgccggcgagccatggcgggggctctcctctcctctccgcacactctcccgagccccacatctcagtccccgttccgccccaggagcaggggaccactccacgctggggcagcgcgtgttctgccaccgaggaggagggcctttgtgctcgcttcgtgctctcgcgagcctgccgctaggaaccgcgggttggaggtggagaggaggcgccttctcatgtccgggctcgtgtcttctttcgcaatcatgctccccatttcagaagcatatgctgtcatggagactgatgaagacgtgaagatgaacacacaaattgatgagat

SEQ ID NO: 50122 - DNA, 441 bp, Zea mays
  Clone ID: LIB3067-040-Q1-K1-D6
cggacgcgtgggggcggcgtcgggcgagatgaagcttaacgtcaagaccctcaagggcaccaacttcgagatcgaggcgagccccgatgcgtcggttgctgacgtgaagaggatcattgagaccactcagggtcagagtacctaccgggcggaccagcaaatgcttatataccaagggaaaattctcaaggatgagaccactttggaaagcaacggagttgctgagaacagcttccttgttataatgttgtccaaggctaaggcatcgtcgagtggagcttctaccactactgctgcaaaagctcctgcaactctggcccaacctgctgccccggtgccccctgctgcatcagttgcaagaacaccaacacaggctcctgttgccacagctgaaacggcaccttcaagtgcccaacctcaggctgctccagctgctacggt

SEQ ID NO: 50123 - DNA, 439 bp, Zea mays
  Clone ID: LIB3067-040-Q1-K1-D8
gatccaaatctttcgaggaagcacttgccgctggattcaccgaagagagcggaagcttgggcgatatttgggaaaccgtctccggcagcgatcttgtgtcgctgctgatatccgatgctgcacaggctgacaactatgagaagatcttctctcacatgaaaccaaacagtatccttggtttatctcatggatttcttctgggacatttgcaatcactcggactcgatttaccaaagaacatcagtgtgattgctgtatgccccaagggaatgggtccatccgtccgcaggctttatgttcagggcaaggaagtcaatggcgctggcatcaactctagctttgctgtgcaccaggatgttgatggaagggcaactgatgttgctttagcatggtcagttgcacttggttcccccttcacgtttgctactactttggaaca

SEQ ID NO: 50124 - DNA, 373 bp, Zea mays
  Clone ID: LIB3067-040-Q1-K1-D9
gaacatcgtcatatctgagtctcacccatttctcttcaaagggttccactagctcactcgggcttgaggtccttagctctacacttactgtactctagaacagccgataataccttgactgctaagatccatcgcttctgctctcctctactatgagacactctcttgaacatcacgtcttaatcctagatgacccgtaagaccagtgcacatctccaccatggttctccactctttatatctgctactagtaccgcatatcatctcggctcatgcattagagatcatgctacttgcaaccttctgttgcaagctgataaggtgctcacgtcgaatctcaacttatccactgtttttaaaattattctagcta

SEQ ID NO: 50125 - DNA, 426 bp, Zea mays
  Clone ID: LIB3067-040-Q1-K1-E1
aaaccagaaatgaacatcgagatgctcccggcccagctcttcttccgattgaatggcagcttcgctgagccatacctcctcccaacaatgtcagcaaaaccatcgccaccgctcatcatcgacaaggagacgatcccgatgggggactcacgccagaagactaaaacgctgaacagcagcaccaggacataatagagtggacctctcagcaattcctctggttttccttcacgtgtcactgattttaccagagcttcatcagtgtagagacggagtccatatatcagaagcctcatggagttcaggaacgggacaaccgcggcgaaataccgtgcttctgtcgaattgctgaacaggggccaagatgacatgaacaggacgccggatagcacgtgcacaacctttctgctcaagctcttttcgatg

SEQ ID NO: 50126 - DNA, 196 bp, Zea mays
  Clone ID: LIB3067-040-Q1-K1-E10
cggacgcgtgggcggacgcgtgggcgaacgtacacgtacgtcccgcgcgctgcacgagtgatgaagccagggaagaaataaaataaagctagctgtattgccaggagcagcatgcagtatcgatctatatatatactgtactgtagtactctattatatatgtatgtgtggcctgcagtgcgagttgcttcgatcc

SEQ ID NO: 50127 - DNA, 422 bp, Zea mays
  Clone ID: LIB3067-040-Q1-K1-E11
cccactcgtccgcccacgcgtccggatttttggcgcaccggacactgttcggtgcaccaggtctggcgccctccaaaccagccactctcgagaattccagggcagtctccgctatagttcaccggactgtctggtgtgccaccggaccgtccggtgagccagcggagcaacggctaactgtcgccaatggtcgactgcaaaagcgttctgcagtaaacagtgcctcaacagaagtcagagcacagaagttagagggcactgaactgtccggtgcagctagaagacaaacatctccaacggtcaactgctccgaaccctaacagttgcgctgacgtggcgcgcaccggacaatgcacagtggatgtctggtgcgcccatcgccagcagcctttgctaacggctaggaagtggttgggggctat

SEQ ID NO: 50128 - DNA, 395 bp, Zea mays
  unsure at all n locations
  Clone ID: LIB3067-040-Q1-K1-E12
cccactcgttcgcccacgcgttcgcccactcgtccgtccacgcgttcgagttgctgagctagttcagaaggttgccgctgccattcaacaagatttgcccaaagtaatgaccaagatgaggttgtatttgcaaaatccatctactcggatgatcttattcaaacctatcaagacaaatatagttgaggctcatatacagctgcattcccttctgaagtcggagtactctagtgaagaaatgcaatccatcggtatgttgccgatacctgacctgcagtctcagcttgacagccttttgtagtttgcatacaccatacagcggcgctgctgtagtccatgttgacgttgcaatgcagttctttcaagtaacgcaagtaaagntgttaccacaattt

SEQ ID NO: 50129 - DNA, 418 bp, Zea mays
  Clone ID: LIB3067-040-Q1-K1-E2
cggacgcgtgggcggacgcgtgggcggtttcaggtatgtggctcccgagtatgccaatggaggtctgttaaatgagaagagcgatgtctacagttttggggtgctactactggaagcagtgactgggagggatccagttgactatggtcggcctgctaatgaggttcatctggtggagtggctgaaaatgatggttggcactagaagagccgaggaggtggtggatcctgacatggagttgaaaccagcgattcgtgctctgaagcgtgctcttctagtggcactgcgatgtgtagacccagatgctgagaaaaggcccactatgggtcaggttgttcggatgctcgaggcagaagacgtgccttcacgggaggaccgccggagccggagaggccacagcagccacgcagacaacgag

SEQ ID NO: 50130 - DNA, 420 bp, Zea mays
  Clone ID: LIB3067-040-Q1-K1-C9
gggcaaagcagaagttgcggttggcctgttcttcttttcttcgtcgcggctcagatctgtgcgtgcggcgatggcgtcgttctcggaggctccccccgggaacccgaaagccggcgagaagatctttaagaccaagtgcgcgcagtgccacacggtcgacaagggcgccggccacaagcaaggtccaaacttgaacggtctttttgggagacagtcgggtaccactgcaggctactcctactctgcgggtaacaaaaacaaggctgtagtctgggaagaagacactttgtatgagtacctgcttaaccctaagaagtacattcctggaaccaagatggtcttccctgggctgaagaagccgcatgagcgtgctgatctcatcgcgtacctgaaggaagcaactgcatagttcattgacat

SEQ ID NO: 50131 - DNA, 282 bp, Zea mays
  Clone ID: LIB3067-040-Q1-K1-B3
agaaaccatagagtttcagtgtgatgatgcatctggcttcgctggcaatgcgtgtggagcatccacatttatggtgccataacctccccttggcccaatagcatttgggcctttgcattaatgccgccatcaaagggtaccataagcgatagcaagcatcccggctggtacatgtaagtctaactgtcagtttagctatctcgtgtgtagctccctgagttttacaacattagtcgattttaccgggagttgcaataccatcatgtgtcacattgtttgtcc

SEQ ID NO: 50132 - DNA, 443 bp, Zea mays
  unsure at all n locations
  Clone ID: LIB3067-040-Q1-K1-B4
gcaagatgaagaggcagatatcggacctgaaatccaaggagctcagcggccacgacatcgttgcccctccggaggatcccaggccacgcaactcggagaacggctcgacctcgcagactccgggcaaaaatgcacacgtaagcaacttcaagttcggcgaggccgacgaggacagcgcggtgaagaccgcgaagaagatccccaccaagaagttcaccgacctcgcgggcaatatcttcaagggcgacgacgaggcacccgggacggcggagaagcaccacctgagcacggcgaagctgaaggagatgaccggcagcgacatcttcgcggacggggaggccccctcccgggactacctgggcgggatccgcaagccgnccggcggggagagcagcatcgcgctggtttaacagcagggacaaacaaccagatggacatagcag

SEQ ID NO: 50133 - DNA, 185 bp, Zea mays
  Clone ID: LIB3067-040-Q1-K1-B5
aaaaaaaaaaaaaaaaaaaaaaaaaaaaatataaaaaaaaaaaaaaaaagacaaacggtaggggatctccaggctcccggcctcctgcctcctacatgctacgctcttctatattgtatcctgacaccaatatactgtccgctggtcgacaacgtacaacactgggaaatccctaaaccttccca

SEQ ID NO: 50134 - DNA, 407 bp, Zea mays
  Clone ID: LIB3067-040-Q1-K1-B6
cggacgcgtgggattgtggggatctcttcttgctgcctgtcgaagccacagttgtgttgagctggctgagttatcagtggaacgtcttgcagatcttggagctgatgattctggagtctatgtccttctgtcaaatatctatgctgatgaaggaatgtggggtgatgttttgaggattaggaaattgatgagtgatgagggaatgagaaaggatattggacggagtgtgattgaagtggatggtgaaatacatgagttcgtgaatggagtcggctcatatattggtaaggatgaaatgtacttgatgctgtggaatttgtctaacatggtggcatctatttgatgctactttgtctaccaaaacaaagtactaatcctctagattaaaaccttacaaaattaataac

SEQ ID NO: 50135 - DNA, 422 bp, Zea mays
  Clone ID: LIB3067-040-Q1-K1-B7
ctggaagatgagtaccttgagataccaggagacaccgtgaagcgtgtttttgcagggcttatactccgagaaataaaggagttttggcgggtggcgctgcttctatccattctcttctaccgagaaactgaaaccgctgctggcaccctcaacgagcatgacgagctgcgtcggaggaaagagaaatacatcagagtcgagcgttccataaccgagctagatcttgacggggtatggaagctgaagccgatactcgacgggaaatcgattatgggagtcatgcaagtcaagtccggaggtccactgataggaaaatggcaacaacgtgtgctgaagtggcagcttgcgcatccggacggaaccgtggacgagtgcgtcgagtggatgaagcagtcgcagtcaaaacgacagaaagtggagtc

SEQ ID NO: 50136 - DNA, 278 bp, Zea mays
  Clone ID: LIB3067-040-Q1-K1-B8
gcttgtataatactcctacttgttggcacagtgaaggacaaacaaatgtatgctgacttgttatgtcctcttgattgcaatttgttagtatgtgttttcttgaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaacctaaatacaattaactaacaaaaaaatatacaacgtaatgaactaggaaaaccctgctaaaaacccaacttaatcac

SEQ ID NO: 50137 - DNA, 418 bp, Zea mays
  Clone ID: LIB3067-040-Q1-K1-C1
ctccgccatcgcgccctgcctctcctacgcccgcggcacggggtccgccccctccgcgtcctgctgtcttaatcgaccaacaccctttgtgggtctagcgttcaagaggaaatggcagaacaagaggaaggagcaggggaaaccgtgtgacagacccaacatcgtcaccggtgccaacgttcaggtctgctgggagaagttcgcaaggtattttgaggtggagctgaaggaggttaagctatcagaagggtactacgtcatggaccccgtcaaggctgttgagatggtggatgagaacactatctgtgtcgcggcgatcttggggtcgactctcaccggagagttcgaagatgtcaagcagttgaacgaccttcttacagacaagaacaaggaactgggtgggacgtgcctattcacg

SEQ ID NO: 50138 - DNA, 421 bp, Zea mays
  Clone ID: LIB3067-040-Q1-K1-C10
cggacgcgtgggaggcggggagctcgcgaatcggaggccgcggggcgcaatgccgcgtcggtagggatggcggaggcggcgccatggcgaggggcgtagcgcgggcggtgtctttcgggcgccgtgccacaacggggtggtgctcctaccggcgcgtcaccgtggccgtctgcatcggcaaccttgtcgccgtgctgctcgtgctccgctccctcaccgtccccgcttccttcgcacccaccgctcccaaccgcggggaagtggtgcagtacacggaggagcagattaggtgggtggaggagtcgatccggattcgccgcgaggctgagcccgtcgagctcgttctggcggtaaagaagctgcggaagaaactcgcccaggaggtgaagcggcgggaggagctgtcgctggtgctgaagca

SEQ ID NO: 50139 - DNA, 424 bp, Zea mays
  Clone ID: LIB3067-040-Q1-K1-C11
ggcacagctatcatccgcgacacagtcgacgtgctcacgaaggtccaggcaataaccaagcggatgcggtgggagagccgcatcatggaccacgaggacggccccttcaacccggagaaggtcctcatggcggtcaagacgtactggaccgccgaagccgaggaggagcactagcacacgagtgacaccgagctcacttgaaagcgtgaaccaagcctgttctacacttctactaccggtcgagagggatggcgtcagcgttttgcgtctcagtgtagtatgtatgtcccttttcaccttttctctagttctttgtagctagctacaatcagatgggaaggtaagggagagttttgagacgggggggggggggttgttggtcctctagttgagatacaggaagcggttttgtagcaggggaagg

SEQ ID NO: 50140 - DNA, 405 bp, Zea mays
  Clone ID: LIB3067-040-Q1-K1-C12
ggactggtggaacaagatgcacttctccggaactttcccacacgctaactcgtctttgtcaatacaagatatcaagaaattggttctgcaagcactgcgaagcaaagagcaagcactgcaacaccaggatactgatttgaactcaagaggcagctttatactgaaacgtatggaggcctacaaggactttgctcgctggagcgtcaacattgacttcgacgagagcatccttgtttggcacattgcaaccgaggtgttcatcaggaaatccaaggccagacatgcaaaagaactccttgaggctactgaggtactatccaactacttgatgttcttgcaggaggtgagatgtatgttatgccgcgcagcgcctggtagcatgttaggttttacgttctagatcgc

SEQ ID NO: 50141 - DNA, 368 bp, Zea mays
  Clone ID: LIB3067-040-Q1-K1-C2
cccacgcgtccgtccacgcgtccgcaccacaacatttccaagctttgtgttcaactctcaagtagaggatgcgtgaggtcccagcgtctacggcaccattgaagcccctggggcacagcagatcaggttctgtgggggcacttagttgtttttgtttccttgaaaatgtaaattttatgtggtggcatgttctcctgtatagtgagtattgctattgtgcacagaattggggcatgaagcgtttcttgtctgtgtttataaaatattcttcaaacatattgctcataaaaactactcaaagtaagaatcaaattgagtacaaaactactcaaagtaagaaaaatacgaagatgttaagcaattgaaca

SEQ ID NO: 50142 - DNA, 392 bp, Zea mays
  Clone ID: LIB3067-040-Q1-K1-C3
gatggaaaccagttaaattccttgcccaattgcgcaacttaatttagagtagagacacagttgctatataactttagtgcctatcattaaaaatatagtttgtctacttcgatagcaacggtatcaaaatctgactaccttatgaagtttggagtcttctcatttcttttggttagtgagggaacttgtagggggttcctttttaagaattgtcccagaagtttcttgccataaagctaggtgtatgtttcaatttccctggttctttgatgactagatatttttatttcaatgcaaacaggtagaattccgaacttcattttcagcaaaatgtgtacaagcaagcagcattctgcctgaactttctatcacgtactccaacaagaacatct

SEQ ID NO: 50143 - DNA, 419 bp, Zea mays
  Clone ID: LIB3067-040-Q1-K1-C5
gggccggaagagcccacacaccaccaccaccactagatagccagcgacgatcgagccgcgcgccggtggacgcgcacatacacgcggtagcttccttctcaagcctagctagccccatcctgcgcgcaggcggcggcagcgagaattgacgtgcgacgacgagcttgtgcttgctagctagagagcgaggatgtcgagccggaggccgtcgtcgcgtggcaacatctccgaggacgagatcaacgagctcatctccaagctgcaggccctgctccccagctcccgccgccgcggctccggccaggcgtcgacgacgaagctgctcaaggagacctgcagctacatcaagagcctgcaccgggaggtggacgacctgagcgaccggctgtccgacctcatggccaccatggaccacaaca

SEQ ID NO: 50144 - DNA, 423 bp, Zea mays
  Clone ID: LIB3067-040-Q1-K1-C7
cccacgcgtccgcccacgcgtccgctcattgtgccggctgatggcccacaccatgtacagatcttgcatgagccaattggtgttgcaggtcagatcatcccatggaactttcctcttctgatgtatgcctggaaagttggccctgctttggcatgtggaaatactctcgtgctcaagactgctgaacaaacccctctatcggctttgtatatctccaaattgttgcatgaggctggactacctgagggtgttgtgaatgtcgtttctggttttggccctactgctggtgctgctcttgctagtcacatggatgttgataagatcgcatttactggatctaccgatactggaaaaattattctcgagttggctgcaaagagcaaccttaagacagtgacactggagttaggaagcaagtcccct

SEQ ID NO: 50145 - DNA, 445 bp, Zea mays
  Clone ID: LIB3067-040-Q1-K1-C8
ggttgatggtgcgggtgatcctcagggtggtggtggccttgccttcatgcaagctggttttgggggcatgcctgatggctccatgaatacaggcatgcccgatagaggtgatggaaggggtgttcgagcacagatgcccacgccaatgcaaatgcagatgtcacttcccccacctccgcctacacaacctccatcaggctcgcagcaaacatttaacaggacttgatatattttgttttgcacgaattgatggttcctctcaaaattccatgtcaattcattgaggaaactgtaattttatcgtcgttggcaaaaaaaaaaaaaaaaaaaaacagaaaaaaacagatcaaacataaaaaataaaacaaaaaaatgataaaaagcaacacataaaaaaaaaacacatacaattgcccaaaaaaaaaaagggggggccgttttaaaa

SEQ ID NO: 50146 - DNA, 428 bp, Zea mays
  Clone ID: LIB3067-040-Q1-K1-B2
cggacgcgtgggcggacgcgtgggcggacgcgtgggcggacgcgtgggtgagatttgaagcctaaggccgatggggatggaggcgagatgcggtgacctggccgtagctgccggcgcccgcgtccggcgcccgctacaaccgcgggacaccaacgtggcggcgtccacggtagtggtcggcaaggctgcgccgaagcccaaagctcatccaaagggggcgacgaggcccactttgccttcgctgccgccggcaccgctgttcccggtggtgaagccaaccccgcccgtgaaggaccagtgcgacgcgtctgttgcgggcgtggccgaagtgtcgctggcggaggagctcgagagggcgcgggagcggcgcgctcggctccgcgcggcgcgggaacagacggaacgggagatggtgagccgtgccgaga

SEQ ID NO: 50147 - DNA, 340 bp, Zea mays
  Clone ID: LIB3067-039-Q1-K1-H8
cccacgcgtccgcccacgcgtccgctcagctcgatgagaaagatgcaaggttgcaaatgcgtaagtgtatgcctccctggtgataacaactgctcctgtacgcatcgaaatgctggtgaccttccttacagtgcttcaggcatacttgttagccgaatgcccgttttatacgagtgtggtgattcctgcacatgttcacaaaattgccggaaccgagttgtacagaaaggtacgcagatccgttttgaagtttttaagacaggagatcgtggttggggccttcgtagttgggatccaattcgagcaggcacatttatctgtgaatatgcaggtgaaatca

SEQ ID NO: 50148 - DNA, 412 bp, Zea mays
  Clone ID: LIB3067-040-Q1-K1-A1
cccacgcgtccgttttattgcagagaaccctcagtgctggtaagctgacagagaaagtgctcaagttgtttctagcaaccggctgtgaggatatcatattggctgttcggttgctcaacattaagcagccactcgtaccagtccttcccacaaggtgctctgagagattctagacctgctgccgctcacatcgttttgattacctgagaagatgcctttggaaattcaagatagtgaggttgacattgtgattgcagcactccagcccaacctgaccactttctttgaggcatggcgaccatttttctcccgtttccacatcattgtcgtcaaagatccagacatggcagaagatcttcaaatccctgcaagttttgatctcaaggtttacaccaagtcagatattaatggg

SEQ ID NO: 50149 - DNA, 429 bp, Zea mays
  Clone ID: LIB3067-040-Q1-K1-A10
cggacgcgtgggcacaaacctaacaggattgatgagcgaaagagaatagaaaatgctggtggtattgtcatttgggctggtacttggagggtaggtggtgtattggcgatgtctcgtgcatttggcaatcgtttactgaagccatatgtggtggcggaacctgaaattcaggaagaacagttcagtgatgagctggaatgcctggttctcgctagtgacgggctttgggatgttgtggaaaatgaggaagccgtttcccttggcaaatcagaggacacgccagagtctgcagctcggaaattgacagagatcgcttattctcgtggcagcgctgacaatatcacgtgtatcgtggttcaatttcaccatgacaaaaccggatgaaccatgtggcggccaatttcagttgtaccctgcttcaagctatta

SEQ ID NO: 50150 - DNA, 286 bp, Zea mays
  Clone ID: LIB3067-040-Q1-K1-A11
attttactgcatctaatcgctgtggctctatctaataactgcgttgcgttcctgctttcaggtctcggtggagaatactcgacggactccgcaaccggcgtactgtcgacgctgttcgacttgggcggcctcgtggtcggcatcctcacgggccacatctacgaccatgtggacgcccgggctctgacggccgtgagcttcaccttctaggcgattcctgcgctcttcttctaccgcgtctacgggaacctcttgctggcctggaacatcgacctcatgctcatca

SEQ ID NO: 50151 - DNA, 429 bp, Zea mays
  unsure at all n locations
  Clone ID: LIB3067-040-Q1-K1-A12
gccagactcggctgtggaagttcgagggcgaggcgcgggagcaggcgaagaaggacctggtggaggtcctggagaccctggagggggagctcgccgacaagcctttcttcggcggcggcgccctcggcttcgtggacgtggctctggtgcccttcacgtcctggttcctcgcctacgagaagctgggcgggttcagcatccaggagcactgccccaggatcgtggcctgggccgcgcgctgcagggagcgggagagcgtggccaaggccatgtccgaccctgccaaggtgctcgagttcgtccagttcctccagagcaagttcggtgccaagtgatcgatcggaagcactgtgtgtgctgctatgcangccangctggtgctttgatcagctcgatcagcttcatgcccatgctagcgttgcatatcgc

SEQ ID NO: 50152 - DNA, 429 bp, Zea mays
  Clone ID: LIB3067-040-Q1-K1-A2
agcgaatccctcgcatcgcattcgcagcctttgctgcatcacaccaccgcgaaaccccagcagccgcatcgatggcgcctaaggcggagaagaagccggctgcgaagaagccagcggaggaggagcccgctgccgcgaaggccccggcggggaagaagcccaaggccgagaagcgcctcccggcggccaagtcgtccggcaaagaaggcggcgacaagaagggtaagaagaaggcgaagaagtcggtggagacctacaagatctacatcttcaaggtgctgaagcaggtccacccggacatcggcatctcttccaaggccatgtccatcatgaactccttcatcaacgacatcttcgagaagctcgccggcgaggctgccaagcttgcgcgctacaacaagaagcccaccatcacctctcgggagattc

SEQ ID NO: 50153 - DNA, 363 bp, Zea mays
  unsure at all n locations
  Clone ID: LIB3067-040-Q1-K1-A3
caagtttcgtgggtagaggaggcactagatactgtgccagatcggggtctggtagtggcagttgggtgattacgacggagtgggatgggcctcctcgacaagctgtgggacgacaccgtcgcgggcccgcgcccggacaccggcctcggccgcctccgcaagcagcccgcgcgccccgccgccgttaagatcagtgatccggccggggacgctgcagcgctcgtgccgccctcgccggcttcgggtagcgaggagacgccggtgaaggtgacgcgcagcatcatgatcaagcgtcccgcggggtacccgtcttcgccgaagagcgcggcaagcacaccgncggcctctccactagggactacc

SEQ ID NO: 50154 - DNA, 442 bp, Zea mays
  Clone ID: LIB3067-040-Q1-K1-A4
caaatctccaccagttgataaagcctctccagctctgccaaaatcattatcaggtgctaaagatgcgctttttccttctaggtcgctgcagattgataagtttactccagccgccccaaggttatcacaagatgataaggctgctctgccttcttcagaacagtcacatatatctccagctactagttctgaagctcaaggggcaactactaggaaggtcacaaccaccacctcactttcagaggctgctgcagcatggaggccttcaagtgctcctgtgttacccacaccaagatcaaccgggccagctgcttcacatattcaaacttccacattgctttcccgctctatgagtgaagcagctgggagaaggccagtaaatgatccttcattttctgccccatcttatactccacagacctaccggaatgcaataattggt

SEQ ID NO: 50155 - DNA, 404 bp, Zea mays
  Clone ID: LIB3067-040-Q1-K1-A5
ctagactcgccgccgtcgcaactcccacccgatccccaaattctccggcggtgatggccagcctgtggcgcgccgtgatggatagcgtcagcggctcctccccctcggcgctggacgcggccccaggtagcggcgtcgagttctggcacggcgcagagcgcgctgggtggctaaataagcagggcgagtacatcaagacgtggaggcggcggtggttcgtgctgaagcaggggaggcttttctggttcaaggaccctgcggtgacacgggcctcggtgccccgcggcgtcatccccgtcgccacctgcctcacagtcaagggcgccgaggacgtgctcaaccgccagttcgccttcgagctctccacgcctgccgagaccatgtatttcattgcggactccgag

SEQ ID NO: 50156 - DNA, 411 bp, Zea mays
  Clone ID: LIB3067-040-Q1-K1-A6
ctagactcgccgccgtcgcaactcccacccgatccccaaattctccggcggtgagggccagcctgtggcgcgccgtgatggatagcgtcagcggctcctccccctcggcgctggacgcggccccaggtagcggcgtcgagttctggcacggcgcacagcgcgctgggtggctaaataagcagggcgagtacatcaagacgtgtaggcggcaggggttcgtgctgaagcaggggaggcttgcctgggtcaaggaccctgctgtgacacgggcctcggtgccccgaggcgtcatccccgtcgccacctgtctcacagtcaagggcgccgaggacgtgctcaaccgtcagttcgacttcgagctatacacgcctgccaagaccatgtatttcattgcggactccgataatgaca

SEQ ID NO: 50157 - DNA, 397 bp, Zea mays
  Clone ID: LIB3067-040-Q1-K1-A7
cccacgcgtccgcccacgcgtccgcggacgcgtgggcaagccttccacacacccgacgccgaagccgaccccaccgacgtacaccccttccccaaagcctccgacgcccaagccgaccccaccgacgtacaccccttccccaaagcctacgacacccaagccgaccccaccgacgtacactcccacaccgaagtcgccggccaccaagccgtccacctacactccgacgccgccggtgtctcacacgctcagcccgccgtcaccatactactagaaagcgatgcctaccataccacactgctgtcagtctctggagcatttaggtggtctggatcaatggaaagggtgggtcctagtcaggcggcaaagatgagctggtgatgggtatgatgatgat

SEQ ID NO: 50158 - DNA, 431 bp, Zea mays
  Clone ID: LIB3067-040-Q1-K1-A8
cccacgcgtccgcccacgcgtccggtggaggcggaggatctggtggaggcggcagcagcggtggaggcggcggatctggtggtggtggaagcggtggcggcggcggatctggcggcgggccgacgagcggtcgttgccccgtggacgcgctgaagctgggcgtgtgcgccaacttgctgaacgggctgatcaacgcgaccctggggacgccgtccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtaccctcgggcttacagtgcttctgactatcacacgcccatcgatcgatcgatctggaggctaaataa

SEQ ID NO: 50159 - DNA, 125 bp, Zea mays
  Clone ID: LIB3067-040-Q1-K1-B1
aaaaaaaaaaaaaaaaaaaaaaaaaaaaaataaaaaaaaaaaaaaaaaaaaaaaaaaaaggagaaaaaaaaaaaacaaaaaaaagaacaaaaaactacaaaacaaaaaaaaaaaacaacacaaaa

SEQ ID NO: 50160 - DNA, 340 bp, Zea mays
  Clone ID: LIB3067-040-Q1-K1-B10
aagagctctgaagttgaataaagagcgtcgtctagctcaggagaggaagcagcagaatatgttgaacgagcaatatggatagaacctacccggaagactggagttttgtacagtcgaactgttaccagatggtgagtgctgtgtgtgtatatgacggtattgatgcatctgtgaggtgtattgctccggtggcggtactacaacacagttttgcataccgaggagcagaggcatgtacagcgtcatgtgttaaaattgctccgaaatattattgagttttgtagaaaaaaaaaaaaataaaaaaaataaaataaaaaaatataaattataaaataaaaat

SEQ ID NO: 50161 - DNA, 220 bp, Zea mays
  Clone ID: LIB3067-040-Q1-K1-B12
gttcgttcagttcatccgtgttcttgttcgcgaggtcgagagagaggatgtcgtgctgcggaggcaactgtgggtgcggctccggctgcaagtgcggcaacggctgcggagggtgcaacaagatgtacccggacatggctgagcaggtgaccaccaccaccacccaggctctcgtcatgggtgtcgcaccatccaaggggcacgccgagggcgggttcga

SEQ ID NO: 50162 - DNA, 450 bp, Zea mays
  Clone ID: LIB3067-039-Q1-K1-H7
cggacgcgtggggtgcagacgacgcagcagcaggcggcggtgacgacgacgaccttgagggcacaagggatcctacggtggtcaggggctggcgacggttgaaggccgtgtccatggtggtcttcagcggcggcgcccgacccaacaccaccaccaccacgacgactatggaaatggagccgctgtatccgccccatgaggctcgaagtgacgcagatatcaggttgagaagcccacagcggaaggcacgtgaggtagaagaagccagcgtggtactcaagagtccacaccgaaagaccgctgttgcggctcatgtatcatcgcaggtacaacagccctcgctaccttcgcagcaacctgacgtggttggaaccaaaaattcagcagcggaagttgtaatggacgtcgcatcaccgaaaccacttcagggggcgttgtccatggcaaccc

SEQ ID NO: 50163 - DNA, 313 bp, Zea mays
  Clone ID: LIB3067-032-Q1-K1-G3
aattccggtcgaccacgctccggtcgcccaggtcccaacgccaataggctatcctatggattggaacctaggtgagaactaaggagcagatcaggaactggaaggaaacaggcagagatatggaaatgcagaagaacgagctaccagaaatgttaaggatccatcgacggaagaagcgtctgtgcttgcgaagaacattgactgggccttggtgatgactatctgaaacagcagacgagtcgctgcatacctgcagtggtgcctgggatctgtacacaatttgtctcctatagactagcgatggacgtaacgt

SEQ ID NO: 50164 - DNA, 159 bp, Zea mays
  Clone ID: LIB3067-032-Q1-K1-G5
cttgtacttgtaccaaaaaaaaaattattaaaaaaaaaaaaaaaaaaaaacaaacagagggatcatataaaacattaaatacgcaaacatacaacttactaaactaattatattgtatcacctaaattcaatatctcttgtcaatttctaacaacttca

SEQ ID NO: 50165 - DNA, 315 bp, Zea mays
  Clone ID: LIB3067-032-Q1-K1-G6
gttcattaggattattgtcatgccgcttaccgatgatctatgaatgtggtgaatcttgcaactgttctacaaattgccggaacagagtgacccaaaaagggcccaggctacattttgaggtcttcaggaccaccaatcgaggctggggtcttcgttgctgggaacctgttcgtgctggttcatttatatgtgagtatgctggtgaggtcattgatgaactcaaagttaatttgaatgacaccgaagatgattacatttttcaaactgtatgccctggtgagaagactttaaaatggaattgtggacctgaactat

SEQ ID NO: 50166 - DNA, 279 bp, Zea mays
  Clone ID: LIB3067-032-Q1-K1-G8
cggacgcgtgggcggacgcgtgggctgtacggccgcaacatcaccgtcaacgaggccgagtcccgctgcggccgcggaggcggcagcagcggctacggtggtggccgcggaggcggctgctactgcggcggctggcgccatgatggccactgctgctacagcggtatcggcggccgctacagtggcatcggcggctaccgtgttgttgatggcggctacggcggctgctaccgtggctgctgctaccgcaactccgacaggaactggaggaactgagcg

SEQ ID NO: 50167 - DNA, 348 bp, Zea mays
  Clone ID: LIB3067-032-Q1-K1-G9
cccacgcgtccgcccactcgtccggccactcgttcggaagcagcagccaattcgctcgaggtcagatcgagcgctcgccaagcaagtcttccggccggccgctaagagagcaatcaagcaagacaagatggtgaagctcgccttcggaagcgtcggcgactccttcagcgtcaccttcatcaaggcctacgtggccgagttcatcgccaccctcctcttcgtcttcgccggcgtcggttccgtcatcgcctacgggcaactgacgaatggcggcgcgctggacccggctggcctggtggcgatcgcgatcgctcacgcgctggcgctgttcgtgggcgtgtacgtcgc

SEQ ID NO: 50168 - DNA, 314 bp, Zea mays
  Clone ID: LIB3067-032-Q1-K1-H1
ggaacctgctccatatgggtgggatgttttcaatcaaaagaccttgtatgatgcatacaaaaagaggaccaaggatatagaagttgacatggaggcgtacaataaagccaaggaagctgatcctgaattctaccgtgacgcctccagtctccagtacgggaaggtgtccaatgtccctgaagaaaacattgacaagatggtcaaggaactcaaggagcgggaagagaagcggaaatcgttcagcatgaggcgcaagtttaacgaagacaaggacattgattcgatcaacgaccggaatgagcacttcaacaaga

SEQ ID NO: 50169 - DNA, 222 bp, Zea mays
  Clone ID: LIB3067-032-Q1-K1-H10
aaaaaacatacagaaacaaaaaaaaaaacaagataaaaggaagaacaaaaaaagaaaaaaaggaaagctagaaaccagaggtggggaagaccaacagcttgaccgtgactgcgagcccagatctccaggccggtctggcctaagatgacgtctgcaaagagcctgctggtcccacagacaaattgacatcgctggcgatgccagtgcaccagctggtgagac

SEQ ID NO: 50170 - DNA, 313 bp, Zea mays
  Clone ID: LIB3067-032-Q1-K1-H11
agctaacgttggtgctggatatgctgcttttgttcaacacacgagacacgatgctgaggaaaagagatgcgatcataagtcagacagaaaatcgtagcaccactgtggtcgctctcattctgagcagtcagcgtatcatttagtgcctcagcaacatacttgtacattgcgggcgaggaaaagaaggaaacatgtaaaatcagtccgagggaaatggctccagaaaagcccctcagagcgacttgttgcctgatacaggtatcagaaacttaacgctttaggccaagaaaaagagaacagtgagcgttctgcc

SEQ ID NO: 50171 - DNA, 314 bp, Zea mays
  Clone ID: LIB3067-032-Q1-K1-H2
ggagcagcaggctcaactgcgggatgctctaaacgatgcgctgaagcaagaagtggagaggctcaagatagcgactggcgagatgccgaagtccaacgaacaattcaacatggggatgcagcacgtctcgtacagcggcccttctttcttccatctcccggagcagcacgtagacattcagctgccgcaccatttccagcagcctgcgcggaacgtccagatgctgtcccaccccaactccctctcggatatggcgcagcaagactcgcttgggcggctccgggggctggacattggaaaagggtccatggcta

SEQ ID NO: 50172 - DNA, 324 bp, Zea mays
  Clone ID: LIB3067-032-Q1-K1-H4
ccatgcgtccacgcgtccgcggacgcctggctcttgattaatgctgaagtgcgcaagatttctagcaggttaaatgatcttgatctgcagctaacgaaggagaaagaggaatgccacaggatgacctcaaaaattaaaaagttccttaaagcccatgctcgctttttgaaagcacaggaagaattgaaaaggtcacaagctcgttttgagagactcggtgatttacttgcttcagatattctgaagcgtggtgctaatgaagaagtttctagtatcaatgttgatgaagatccaaatgttccttatgaaaggagcccaaatgct

SEQ ID NO: 50173 - DNA, 316 bp, Zea mays
  Clone ID: LIB3067-032-Q1-K1-H5
ggggattggagatattaatgcagttaagctgatatctaagtttggttccttggataatgtactgaaatccgtggacgaagttgaggatgaacgaattaaacaggctttgatttctcactcggaacaggcaatcctttgcaaaaacctggccacgctgcgttctgatcttcctcattatatggttcctttcaagacagccgaccttgtatttaagaagccacaggatgatggagagaaattcataaaactcttacgagcattggaagcatatgcagaaggttcctcagtaaatccaatcatcagaagagcagcctat

SEQ ID NO: 50174 - DNA, 315 bp, Zea mays
  Clone ID: LIB3067-032-Q1-K1-H6
cccacgcgtccgcctgttggtacaatggcttacatgggcaatgtacaatatctgatgcaatgcaaatgtgctgttaacacagctgaagattggcttaaccctgttgccatacaagaggcgtttgaagccagggctctcaggatggcagtaaactgtgcccagaacataggccaagcagcaaaccaagaagaaggtttctatgagcggtcccctgatttgctagaggctgcagtagctcacatccagttggtcattgtaaccaagttcatttcgaaggtgcagcaggacattcctggacctggagtgaaggaacag

SEQ ID NO: 50175 - DNA, 314 bp, Zea mays
  Clone ID: LIB3067-032-Q1-K1-H7
ccgacgcgttcgtctgtaggtacattgtctgacatgggcaatgtacaatatctggggcggtgcaaatgtgctgttaacacacctgaagattggcttaaccctgttgccatacaagaggcgtttgaagccagggctctcaggatggcagtaaactgtgcccagaacatatgccaagcagtaaaccaagaagaaggtttctatgagcggtcccctgatttgctagaggctgcagtagctcacattcagttggtcattgtaaccaagttcatttcgaaggtgcagcatgacattcctggacctggagtgaaggaaca

SEQ ID NO: 50176 - DNA, 316 bp, Zea mays
  Clone ID: LIB3067-032-Q1-K1-H8
cgctcgctcaacagccgcgcgtcgtctgcggcggaccggcaggccacctgcaactgcgtcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataat

SEQ ID NO: 50177 - DNA, 206 bp, Zea mays
  Clone ID: LIB3067-032-Q1-K1-H9
cccactcgtccggtgacgaactcgaagcttgcgttctggtagtacaggtctgcagcaagcggtggtagagcgagaggtcgagaagatcaatagcatcactgtgtctgcgattctagttatccaggtcactctggtctctgatgacagctcctaaggacctgctggtctctctacgtattagctgggctgttgctgccagtgcacta

SEQ ID NO: 50178 - DNA, 251 bp, Zea mays
  Clone ID: LIB3067-033-Q1-K1-A1
gccttgtgtattaggatttgagcttcactctggatgtagatgatccagccactgcctgatagtgataataataataatacgccctctcctaagccatgtactcgggtgttgttgtggagtgtgtggatgtgatacattccctagctgtattaaaagtgtaactgtaatatcgaaaggcacactccatcatgccacggggggcaattcttccgtccacttgctcatacgactcaccatcataaaaacaagca

SEQ ID NO: 50179 - DNA, 431 bp, Zea mays
  Clone ID: LIB3067-033-Q1-K1-A10
gagcagctcaagttcgtcattgtggatcttcaaagtgcagaaaaatgctaggctcaacagagtattcaggaagctcacagaatcatcgtaccaagaagaaaaagaggaaaacaagttgtgagaattgcatacagcagtttcttcgtctgtggcatccacgacaaaaaatgtatgttggatgttggatagttgacttcgatcaaggaactaaaatgcatactctccagttcattgatcaccatactgaaaagtttgatttgaaagaagaagaatggcacttattggaggtcgactctgatgaagattgatcatcgaagggttgtcatggtttgctgtccagccagctagttcgcggttcatttgcggtcgcagcatagactgacggatggccaatgctataccatttggagtctactgcaagcctgaattgt

SEQ ID NO: 50180 - DNA, 426 bp, Zea mays
  Clone ID: LIB3067-033-Q1-K1-A11
caaagaccttattcgtacccggcatcagttaacaaagttctaccaactcaaatcggagctccaaggagtttctctaagagttcagacactaaaatcaactcaagctatgggtgatgccatgaagggcgttacaaaggcaatggctcaaatgaacaggcagctaaatctgccagggttgcagaggataatgcaagagtttgagcggcagaacgagaggatggagatggtgagcgaagtgatgggagatgccatagatgatgctttggaaggagatgaggaagaagaagaaactgaggagcttgtgaatcaagtacttgatgaaattggcattgatatcaaccaagagcttgttggagccacgtcagccgctgttgctcaacctgcttcagcgggaagggttgcccaggctgaaagtgctgggaatgc

SEQ ID NO: 50181 - DNA, 400 bp, Zea mays
  Clone ID: LIB3067-032-Q1-K1-G12
ctcagcgcatatgtgacatgtttcttgctctagataaggatacgaacggtacactgagcaaacaagagctcaaggaatatgcagatggcacgttgactgagattttcattgaaagagttttcgatgagcatgttcgccggagcaaagttggaggtggaaacagtcgtgagatggactttgaaagctttcttgattttgttttggctctagaaaacaaagatacccctgaaggcttgacatatttatttaggtgccttgatctcaatggaaggggtttccttacaactgcagatattcatactctatttagagacgtacaccagaaatggattgagggaaggaactatgagctttgcatagaagacgtgagggatgaaatctgggacatggtgaaacccgc

SEQ ID NO: 50182 - DNA, 315 bp, Zea mays
  Clone ID: LIB3067-032-Q1-K1-E2
cccacgcgtccgcccacgcgtccgcggtgaggtgatgccagggcagtgggagttccaagtcgggccttccgtgggtatttcttcaggcgaccaggtctgggtcgctcgctacattcttgagaggatcacggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacaaggagcacatcgcggcctacggcgaggg

SEQ ID NO: 50183 - DNA, 314 bp, Zea mays
  Clone ID: LIB3067-032-Q1-K1-E4
ctcttcctctgggcccccgctcctagatcacaatgcccagcaattctaccagcaggaatcagcaaaactgcgcaaccagatccagatgctgcaaaacactaacaggcacttggttggtgactccgtgggaaacctgtcactcaaggagctgaagcagctggagagccgccttgagaaaggcatctctaagatcagggccaggaagagtgagctgctggctgcggagatcagttacatggccaaaagggagactgagcttcagaatgaccacatgaccctcaggaccaagattgaggagggagagcaacagctgc

SEQ ID NO: 50184 - DNA, 268 bp, Zea mays
  Clone ID: LIB3067-032-Q1-K1-E6
cccacgcgtccggcgcagtcttcatcactcacaccaatcgcccacaagagctctcaggagaggtcttaaccctagcttttgcagctgctgagagaagatgatctacgacgtgtactccccccttttccgttccttcctcagccagaatggctgctcctacaagagggaaatggaagagcattaaccaaatgagcagatgcccaaagctaacgagaacaagcctgtgattaaccaatgaatatttacagaagctttggtcaaagtgcaa

SEQ ID NO: 50185 - DNA, 311 bp, Zea mays
  Clone ID: LIB3067-032-Q1-K1-E7
attgacccaattggtgcaatcgaccaggcgaagctcacgatttcgaactggtctggagcagtgtgggaaaatgcagcatcgctggtaggtgaatcagctcctacagacatgcttcagaagttgacatatctggctatcagacaccatactcagattaagcgtgttgacaccgttcgagcatacacctttggggtgctttactgtgctgaggttgacattgagcttccagaggacttgccacttaaggaggcacacgccattggagaatctctccaaatcaagattgaggagctacctgaagttgagcgagc

SEQ ID NO: 50186 - DNA, 170 bp, Zea mays
  Clone ID: LIB3067-032-Q1-K1-E8
cccacgcgtccggcgacggcgcggtggctgcaggttgccgccatggcggtggcgctggtggcggagtgggcgacggcggcggcgcctcggaagcccgtggacgtgccgttccagaagaactacgtgccgacgtgggcgcaggaccacatccactacatcgacggcgggcg

SEQ ID NO: 50187 - DNA, 348 bp, Zea mays
  Clone ID: LIB3067-032-Q1-K1-E9
tgggttggcttctcctccccctccggggcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggc

SEQ ID NO: 50188 - DNA, 275 bp, Zea mays
  Clone ID: LIB3067-032-Q1-K1-F10
acagagaggcctgcgaataatgttccctgcttcgctgagacaggatctggtccatctgggctgctacaagcatgccgacactgcgagagatggataaagagggccctgtcgtcgctgagggcagctgtacatcctgatccctagcccgagccacaacactcttcgcacatggagctgtgcatgtactaggctgatgcatacgcgaagctgcctgtgctaccgtcgcgtctgcacaagttcgtcagctacaagtccgcgttcgcgcacttaggcgc

SEQ ID NO: 50189 - DNA, 392 bp, Zea mays
  Clone ID: LIB3067-032-Q1-K1-F11
cgagatcgccggcgtggttgtctccttcgtaccccaagccaattccgggggactggaatggcgctggtgcacacaccaactacagcaccaagtcgatgaggagtgacggcgggtacgaggtgatcaagaaggcgatcggcaagctgggcctccggcaccgggagcacatcgccgcgtacggggacggcaacgagcgccgtctcaccggccgtcacgagaccgtcgacatcaacaccttcgtctggggcgtcgcgaaccgcggggcgtcggtgcgggtgggccgcgacaccgagaaggaaggcaaaggctacttcgaggaccggaggccggcgtccaacatggacccgtacgtggtgacctcgctgatcgcggagacaaccatgctgtgggag

SEQ ID NO: 50190 - DNA, 389 bp, Zea mays
  Clone ID: LIB3067-032-Q1-K1-F12
gagcaagcagagcgagcgagctgtcctttcaaaccctcacggtcgcctgcacaatgccgggccatctcgcgctgctactgcccctgctactgctggcctcgccggcggccacgcgcctggcgtccgccgcctgcgcgggcgagaagttcccggcggggcgtgcgtactcgtcgtgcgaggacctgccgaagctgggcgcgtcgctgcactggacgtacgacgcgtccaagagctccctgtctgtggcgttcgtagcggcgcccgctgcggccggctggtgggtggcatggggcctgaaccctacgggcgaaggcatggccggcgcgcaggctctgagagcgctggcagcggccggagccgctgatcccgtcgtgcggacatacaacatc

SEQ ID NO: 50191 - DNA, 311 bp, Zea mays
  Clone ID: LIB3067-032-Q1-K1-F2
ctcgggggcaatgttcgaacgatcgaccttggcgacgccgaggatgtcagggaagtctcgggaacatacggcgcatttgaaggtgccactacgctgacctcgctcaggctcgtcaccagcagcagaacctggggcccctggggtgtcgagaacgggacgcgtttctccgtcacggcgcccatcggcagcagcatcgtgggattctatgcgcgggcgggaaccaggctcgtcgatgctatcggtgtttacttgcgtcagatttaattcgaataatagcaggggagctactgctagctacgtacctgctccat

SEQ ID NO: 50192 - DNA, 312 bp, Zea mays
  Clone ID: LIB3067-032-Q1-K1-F4
attatctttgcttgagaactcagttttttattgaaataataaacatgcaattaaatgaacggtctttagtgtcatgcataaggtaactaacagtcattatcatgcaaacatgtggcaagccatgaaccatttgaagcgctacttgcttaatgtctctcttgatcatttgtgttagtggcatttgtcgaccttgtttttctgtgcactttctgccttcattgcaaaatgtcagtttttttatctgcattgtcgtctatgactggttaacatggttatgttgggagcacgctttagcacctacgcaacaaggtg

SEQ ID NO: 50193 - DNA, 314 bp, Zea mays
  Clone ID: LIB3067-032-Q1-K1-F5
cccacgcgtccgatattttgtaccatatctatctgctgttcaactcttcagtcaacctgaaagaaccagtggtggaagcattgataaggaatcaatccatagggatgtgacatgtgaaacatctccacagctgaacctgcccccaatatttgcaaagctttttccaaaacaatctgttccagtaaataaaccatctactctgcgtactgaagatgatcaacagtcagcagatggggagctggtatttgaattttttgaatatgaacagccatactcacggcgacaattatttgacaaggtaaatgagctgattg

SEQ ID NO: 50194 - DNA, 315 bp, Zea mays
  Clone ID: LIB3067-032-Q1-K1-F6
agcgagaggcgaagcagataaggaagctcagccggcaaggggagccactccggcgtcgggaaacctagggcgagcgcctcgacgactcctatcaccccatggcggccttcgctacgggcagcaccacagcgcgcgcgacgctggcatcgccgacttcgtgccagccggccgcgcgccgggcgccggcccgatggatgccgctgcgctgctcgcctgcggccctgggcctcaggggaggagcgcgttctcggcggagcgccacgctacgggtggaagctaagaagcaaactttttcttcatttgatgagttgctgg

SEQ ID NO: 50195 - DNA, 305 bp, Zea mays
  Clone ID: LIB3067-032-Q1-K1-F7
cggacgcgtgggctgcgacatggcgcacatcagcgggctcgtcgccgcgcaggaagctgcaaatccttgtgaatattgtgatgtggttaccacaaccacgcacaagtccctcagagggccaagggctggcatgatcttctacaggaaaggccctaagccccccaagaagggccagcctgagggtgctgtttatgattacgaagacaagatcaactttgcagtgttcccatctctccaaggtggccctcacaaccaccagattgctgcacttgctgctgctctacagcaaactatgtcgactggct

SEQ ID NO: 50196 - DNA, 313 bp, Zea mays
  Clone ID: LIB3067-032-Q1-K1-F8
cggacgcgtgggctgacgcgtgggcgtgtcgcgtgggcggacgcgtggtcactggcggggtcgacggggctggagcagaagcagatcaacaactggttcatcaaccagcggaagcggcactggaagccgtctgaggagatgcagctcgcggtgatggatgggttccacccggtcaccgtcaacgccgtcgcgttctacgtcgacgcacgcctagtgggagcaacgccggcgatgttctacgcccggccagatcatggggctcatcatggtctctggcacaatagattcagcccactcacgctaccatgaagta

SEQ ID NO: 50197 - DNA, 80 bp, Zea mays
  Clone ID: LIB3067-032-Q1-K1-F9
ctcagaaaaaaaaaagaaaaaaaaaaaaattttatataaaaaaaaaaaaaaaaaaaactaaagatgggttttaagccaaa

SEQ ID NO: 50198 - DNA, 262 bp, Zea mays
  Clone ID: LIB3067-032-Q1-K1-G1
acagggcacacgcacggcacgcagatacatatagagagaggttagctatagcttgcacatctatttaactaactaactaactggctagctagctcgatcggcagagcaaagcgaaagcagcaagaagcaaagcaatggagaaccctgcgagtgtgctagttctaccagcgcaagtcaacaaacttaactttcgaaaactgtacattcggcgggcccggcccggccacaaggagattacccaagaaggcaagttccaactgga

SEQ ID NO: 50199 - DNA, 380 bp, Zea mays
  Clone ID: LIB3067-032-Q1-K1-G10
ctagacgtacgcagaaacctccaaacacctttctacctatctactaactacctgccgtcggaaaaccctagagcgctcgaccatggatccgcagcagccggagcctgtcagttacctctgcggagattgcggagctgagaacaccctgaagcccggagatgtcatccagtgccgagaatgtggctaccgaatactctacatgaagcggaccctgcggattgtccaatatgaagcgcgctgaagagtgaagacaagggtaaacactgaagatggtggatctattactcgccacattacctatgtatacagtcttttggtggaaatgaaaatgtgagacaacgtttgcatgtcctgtgcctgctctgaacctgagctggata

SEQ ID NO: 50200 - DNA, 430 bp, Zea mays
  Clone ID: LIB3067-032-Q1-K1-E12
tcgaaagcagcacaaatgcttagtgggattgacttggattcaggaatcaggatgcttgatgacgccaacaaattatccaagtgtgttcaaattgcacgactctatttagaggatgatgatgcagtgaatgctgaggcttttataaacaaggcttcatttttggtcaccaacagccatcaggaggttctaaacttacagtacaaggtctgttatgcaaggattttggatctgaaaagaagatttctggaagctgcacttcgatattatgacatttctcaaattgaacaacgcaagattggagacgaagagattgatgaaaatgcacttgagcaagctcttagtgctgctgtgacatgcacaatattggctggttgctgtccacaacgcttccgtgttcttgctactctgtacaaagatgaaagatgctcga

SEQ ID NO: 50201 - DNA, 361 bp, Zea mays
  Clone ID: LIB3067-032-Q1-K1-G11
tcggatggctgggaaagtaggtgggtcaagtctgagtggaagaaggatgagaacaatgggctggggaatgggaaccacacctcgggaaaagggaatggagatgccgaggacaaaggttttcaaacctacgaggattacaggttctatgccatttcagccgaataccctgagttcagcaacaaggataagaccctggtgctgcagttctctgtgaagcacgagcagaagcttgactgcggcggtggctacgtcaaattgctgggtggtgatgtagaccagaagaaatttggtggagacacatcttacagcattatgtttggaccagatatctgtgggtacagcaccaagaaggttcacacta

SEQ ID NO: 50202 - DNA, 311 bp, Zea mays
  Clone ID: LIB3067-032-Q1-K1-C7
cccacgcgtccgcccacgcgtccgccctcgcgtccgcacctctgcccctatcctggccaacggcactgtcggaggagacgccacgactgttcctcaggatgcttcgccgcagcctgagtgccaggtggccgagcctgcacttaatccaaaggaggaagttctgaacggggaggtttgtaactcgctaagtgatgtggagaagcctgttgctgaggaaacgccggttcctgatgtcataaatgaagtgccaaataatgttgcagtggctccaccaatttcatcccctgctgtaccattgaaggaggcaccaa

SEQ ID NO: 50203 - DNA, 316 bp, Zea mays
  Clone ID: LIB3067-032-Q1-K1-C8
ggaggaagttcaagggatgcaccttgatgcccaacattggttatggttctgacaagtggaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcaccaacaagcttgctaggctccgcagccaggaggacgagtagtctggtttcttgtcttaacgacgaactggatgttgccattcctt

SEQ ID NO: 50204 - DNA, 383 bp, Zea mays
  unsure at all n locations
  Clone ID: LIB3067-032-Q1-K1-C9
aggcgtctcgcacaacagcagctcattttcctaacacacctcaccaagcagagcagagacccggtattcgccggcgcggtagcgagagcgagagatggactggaggatgttcggtctcgagacccccctgatggtggcgctgcagcaccttctggacgtgcccgacggcgacgccggcgcgggctgcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcaaggtgcangttgaggacgagcgggtgctggtgatcagcggcg

SEQ ID NO: 50205 - DNA, 302 bp, Zea mays
  Clone ID: LIB3067-032-Q1-K1-D1
ggagagaatgctttttcaaaaataggggtagcactagatcacttgaatagccgcggtgctggctctggttcaagtatacttggcataagacggatacctcccgattcaggacagtcaaatgcatcttatcatgacgactgcacagcggcccctgcagcaaacagcagttcaaggttgccgaacggctgtgattcggaagctcaatttcccaaagagttgatatcatcctgcgttgctatgatgcttatgataaagaactgcacggagaagcagtatcaccctgctgaagtcgcgcacattct

SEQ ID NO: 50206 - DNA, 429 bp, Zea mays
  Clone ID: LIB3067-032-Q1-K1-D10
cccactcgtccgcggacgcgtgggcttatatcaattgaggaggactcgttggtggcacattttgagtaccacaagaaagcaattacatctatcgagtggagtccacatgaagcatcatcattagctgtaacatctgaagatcatcaactaacaatctgggacctttcactggaaagagatgcggaggaggaggctgagttcagagcaaagatgaaggagcaggcaaacgcacctgaagatttgcccccacaacttctctttgctcatcagggccagagagacttgaaagaactgcactggcacccacagataccgtcgatgatcatatcaacggcaattgatggcttcaacgtgttgatgcctagcaacattgatacaaccattcctggcagcactgatgcagcaatgccatctgctgagccacagcac

SEQ ID NO: 50207 - DNA, 412 bp, Zea mays
  unsure at all n locations
  Clone ID: LIB3067-032-Q1-K1-D11
agggtttctacatccagccaacgattttctcagatgtccaggacggcatgaagattgctgangaggagatatttgggcctgtgcagtcgatcctcaagttcaaagacctcaatgaggttatcaagagggcaaacgcgagccagtatggattggccgccggcgtgttcaccaacagcctggacacggtcaacaccctgacgcgcgcgctcagggccgggaccgtctgggtgaactgcttcgacgtcttcgatgctgcgattccgtttggcgggtacaagatgagcggcatggggagggagaaaggcgttgacagcctgaagaactacctgcaggtgaaagctgtcgtcaccccaatcaagaacgccgcgtggttgtagacgctgcaagtgtggccttgtgcacgagaaccacg

SEQ ID NO: 50208 - DNA, 349 bp, Zea mays
  Clone ID: LIB3067-032-Q1-K1-D12
accgggccgacccactcgttcgacggctcgtacattcactcatcgactgtttcatatgtacaagacggcatgaatatcgcagaggaggagatatatgagcctgtgcagtcgttcctcatgttcaaagacctcaatgaggtcatcaagagggccatctcgagccagtatggattgaccgtcggcgtgttcaccaacagcctgtacacgggcaacaccctgactctctcgctcattgccggcaccgtctgtctgaactgcttatacgtcttcgatgctgctattccgtttggcgggtacaagataagcgacatagctaggcagaaaggcattgacagcctgaagaactacc

SEQ ID NO: 50209 - DNA, 319 bp, Zea mays
  Clone ID: LIB3067-032-Q1-K1-D2
gaggaatgccagggactcccatgttcctatccttgccccactgccaattgggttcgcggtgggcctggtccaccttgccaccatccccattactggcactggcatcaacccagctaggagccttggcgctgccatcatctacaacagggatcacgcctggaacgaccattggatcttctgggtcggccccttcattggcgctgccctggctgccatctaccaccaggtgatcatcagagccatcccgttcaagagcaggtcttaagctgccgtggccgtgccgagacatgccagtccgaagaacgggcgtcttcctgtg

SEQ ID NO: 50210 - DNA, 315 bp, Zea mays
  Clone ID: LIB3067-032-Q1-K1-D3
gttggttgctaagcaccaggctgagacttttggcttaacacatgcattacacggtacgagtgatttgtcaagaaatccggaaatgcatagcaagcgatacccacatgaagattatgattttgtgacacccaggagcagtaggtacgattcgtcagcccatcatccttcaacatactacgaagacgatccaccagtgtctgagtcaagggttagaagatatgctgaagaaaggtccaccattgtaagaagcccagaaccacgtccgcgatatgacgaaacagacataagaataaacccagaaccaagattaccata

SEQ ID NO: 50211 - DNA, 316 bp, Zea mays
  Clone ID: LIB3067-032-Q1-K1-D4
cggacgcgtgggcggacgcgtgggtgctgatcgccatcgagggcatgaacggcaaggagctggactgtcgcaacatcaccgtcaacgaggcccagtcccgcggcggccgtggaggctgcggctgcggctacggtggtggccgtggaggcggcggctacggcggtggcgggcgccgtgatggcggctgcggctacggcggtggcggctgcggctactgtggcggcggtggctactgtggtggttgtggcggctactgcggtggcaaccgtggctgttgctactgcaacttcgacgggaactggaggaactgatctgt

SEQ ID NO: 50212 - DNA, 311 bp, Zea mays
  Clone ID: LIB3067-032-Q1-K1-D5
gagagaaggaaaaatatccccaaaccctagctcccgatctcgatggcgaaccctggcgtgcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagt

SEQ ID NO: 50213 - DNA, 316 bp, Zea mays
  Clone ID: LIB3067-032-Q1-K1-D6
ccggggtcatacccgccacggtgcacgtccaagtgcggcgactgcagcccgtgctacgcggtgcacgtggccgtgccgccgggcgtgcctgtcaccaccgaatactacccggaggcgtggcggtgcaagtgcggcaaccggctctacatgccatgaccatgagcgagcaaggaggcggccagccggtgaagaatctctcgagagcgccggccgctggggccggcgctgcattattgcgccgggccgggtgcctctcgcctgcgcgcggtgtcgtcgtggtcctcgccgcgcgcatgggcgggatctgcgctctgca

SEQ ID NO: 50214 - DNA, 305 bp, Zea mays
  Clone ID: LIB3067-032-Q1-K1-D7
gctagcactacgccactaccggtcagggcaagactcgcagcccggacaagtacggcggcgatggcgccggtggtcatgatgagcatgtgcgtcgtcgtgtcgctggtggcggtgcagctgcaggccacgagcagcgacggcgccacggtcacaccgtccgtggtgctgccgccgatgacggtgccccgtgtgcgcggtcggttggaggccggtcgtaagctgcaggccgtcgacgccgtcgggatgggcatggactccgtggtgcgtcggacggtggtgctcaccacgatgcagacgagcaactc

SEQ ID NO: 50215 - DNA, 242 bp, Zea mays
  Clone ID: LIB3067-032-Q1-K1-D8
gcaggctgttccacaaggcggctcatgtctagactaaccgtctgcacgtgccatgaggggatggtaagcgtggatataagcagcatgcacgtaggcatgacgagcttgacagtgcatctgctgctcacaaacagctactgtaccactgtcacatccttcgacctgataccgaaattgacaactccacgtacgctcggtcgagagtgcacgcaaactacagcacagaagaaactacgccgcct

SEQ ID NO: 50216 - DNA, 405 bp, Zea mays
  Clone ID: LIB3067-032-Q1-K1-D9
cggactcgtggtcggactcgtgggcggactcgtgggtgagatctgcggtggggccagggatctgatgtaaatagattattcaggttttttttcccctttgagcaacaccccggaggcgctatggcagctatttgtgcagtgatcagctaagcacctattgctgtattatttgtttgttgcagcagagttgaatgtgcattcttcgccttatggaggaggaatttatacagtgtggggttgccttcccctgcactttggcaggttagtgaagtgtgccctagaggaaagtggcatgtttgagagcaatgagattgcagggggctaaaatcccctttgttatttaaaattaaatagaagaggaatttatcctctcggatcccctcaattccctgtatcccaaacaaa

SEQ ID NO: 50217 - DNA, 315 bp, Zea mays
  Clone ID: LIB3067-032-Q1-K1-E1
agccactcccctgaagcagttgttgctactgagctctttgttgatttgttagtagattattggaatgcttatgcttatgatgctcaaattgctggtttattctattcaatatatgttacttcagctggattccaggtttctttaggtggttacaatgacaagatgagagttctcttaaatgccatactagtgcaaattgtgaaatttgaagttaagccaaacagattttctgcactgaaggaaacttctgtcaaggactaccagaatttcaatttccgacaaccttattctcaagcgtcatactatgtctctttg

SEQ ID NO: 50218 - DNA, 122 bp, Zea mays
  Clone ID: LIB3067-032-Q1-K1-E10
gaaaaaaaaaaaaaaaaataaagagaagagtttaaattaaaaaaaaaataaaaaaaaaagaaaaaaagaataaaaaataaagaaataaaaaaaaaaaaaataaaaataacaatacttaaata

SEQ ID NO: 50219 - DNA, 430 bp, Zea mays
  unsure at all n locations
  Clone ID: LIB3067-032-Q1-K1-E11
gcttgctggagagatgctacttttatcacctaggaagactttgcagcctgagcaagcatgtcaccctctggaagaggactcttgttctgtgacttcctcgactacaacatcatcaagagctggcagaactaagacaactgttcctgttgccccatcatttgtgtgtgctaaccgtgctgacaagaggaaggagttctacacaaaattagaggagaaacataaagctttggaagcagagaaggacgaggctgaggccaggaaaaaggaagagcaagacgttgctataaagcaactaaggaagtcattggtgattagagcgaaacccatgccaagcttctatcaagaaggccccccaccaaaggctgaacttaagaaggtgcctnctactcgtgccaaatcaccaaagtttacaagctcaaggagaaagagc

SEQ ID NO: 50220 - DNA, 318 bp, Zea mays
  Clone ID: LIB3067-032-Q1-K1-C4
ggagctgatagaaaggacgctgctgatatctcgatggtggcatacaaggctgcccagggcggtgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagatt

SEQ ID NO: 50221 - DNA, 436 bp, Zea mays
  Clone ID: LIB3067-029-Q1-K1-F11
ctcagtactgcacactgccatcgctctcgtcccttcgctgccgctctatctcggccggagccatgggcggcggtggcgcggcgctgctgctggtgatgtgggcgggcgtggcgtcggcggccgtgtacgaggtgggcggcaccattgggtggaccgtcatgggcaaccccgactacgccgtctgggccagctccaagcagatcgtcgtcggcgacactgttgtgttcacgtataacaagcagttccacatcgtgctggcggtgagcaaggcggactacaagaactgcatcgtcaccaagccgacggacacctggtccacggggaacgattccgtcgtcctcaacaccacgggccaccactacttcctctgcggctacccgggccactgcgctgccggccagaaggtggacatccgcgtcgcctactctgctgcccc

SEQ ID NO: 50222 - DNA, 320 bp, Zea mays
  Clone ID: LIB3067-029-Q1-K1-F12
attatctgtttcacagatgtgcagagcatggagtaaatgctccatgtgctgctcgtggagacaataaaaaagtaatctcagcaaataataatgaataaggaggatgcaatgacgactagctgaacaggactaaaagccaagcaactcatcttgtaaacattaactaagctaccccaactacaaacatcttccattcatagatgccgacaagactatacttagagtattgtgtaccttgataataccatgagaaaggttaacattactgagctgaagaaattgctacgagcttagtcatgtgtatagatcgatgtatactc

SEQ ID NO: 50223 - DNA, 348 bp, Zea mays
  Clone ID: LIB3067-029-Q1-K1-F2
gtacaagcttgcttagctgcttgatgttccccgggttggaatctggcatcaggctggctgtgatgcgattatgactgcactgtccctcatgaagcttatagaggccttcttaaacgggttaactgataaatattctggtgagtaacatggtcttggctttgatgctgtcaagaccacctatgctcaatgtgtcatggattattcaattaaagatgaactatttatgaaaattgagtaatctgattggagtcttcgtctgactgatctcaaaggcatacttgggttattgacataacggatttgatcactattttgctaaccaaaaatgccagtcgctatttgaggtcc

SEQ ID NO: 50224 - DNA, 460 bp, Zea mays
  Clone ID: LIB3067-029-Q1-K1-F5
cttacaccttgcttctacgatgtctaggtcgcgtcccagtgcgaagagaccatgagggaggtagtcagccactgggtccggccctaggtgtacccgctgttcgcggcaactgtcgtggtcgtcggcatctgcggatatcaactctttcggaacatcaccgtctaccaggaagtcagggtaaactatgcatgtagggctactcgtgtgcttgagaaccataaggaggggagacgtttcaccatgcatagcctaagaagctttgtgcacgacatgactcctgagatcatgcctgcacttaacaagttctttactgaccctaactgaatcatgttgattgacatactactactactactacttgctactgtggatgttacactttgctgtcaactcaatatgttgtggacatgcatgacctataaaagtactttgagcgcttggtgatgacttggtctatgta

SEQ ID NO: 50225 - DNA, 458 bp, Zea mays
  unsure at all n locations
  Clone ID: LIB3067-029-Q1-K1-F6
ctggtaccagatatccagcctgacgtggaagttgcttcagatctagtcacaatcacaaatgaagaaaaagttgatgagacaccgtctgttgttgctccagcggctgaaattatgccactgcaagacatcaacagcgaagaaaatgctttggtgaatgatgtggaagagagatccaaagaagaacattcatctactgataacctgaaaggcagcaagaggaggtcttcattctcagctaaacctgaatatccagaaaatggctccaaaaattctccagccctgccaagctacatggctgctacacaatctgcaaaggcgaaactgcgggggaatagttcaccaagacttagctctgattcagcagagaaaaacgggttcactcgtcgtcactcccttccgtccnctaacaatggtaggataatttcacattcttcacgtacgcataggccaacccatgc

SEQ ID NO: 50226 - DNA, 461 bp, Zea mays
  Clone ID: LIB3067-029-Q1-K1-F7
ctggtaccagatatccagcctgacgtggaagttgcttcagatctagtcacaatcacaaaggaagaaaaagttgatgagacaccgtctgttgttgctccagcggctgaaattatgccactgcaagacatcaacagcgaagaaaatgctttggtgaatgatgtggaagagagatccaaagaagaacattcatctactgataacctgaaaggcagcaagaggaggtcttcattctcagctaaacctgaatatccagaaaatggctccaaaaattctccagccctgccaagctacatggctgctacacaatctgcaaaggcgaaactgcgggggaatagttcaccaagacttagctctgattcagcagagaaaaacgggttcactcgtcgtcactcccttccgtcccctaacaatggtaagataatttcacattcttcacgtacgcaaaggccaacccatgctgg

SEQ ID NO: 50227 - DNA, 457 bp, Zea mays
  Clone ID: LIB3067-029-Q1-K1-F8
cggacgcgtgggttttttggtaccaaaggagtctgggcagattcgatgaacaaatagagctacaaactggatccaacttggctgagtcggaggaggtcttcgcaggatcgtgaccaacgccggacatgttggtcgatgcgtcggaggagtctgagacggctactgcggcgtggcacaaaatcaagagggagtcgcttggttctcttcgtcatagctgggggaggtagtaggtagcttacttctttggttacctcggccacaaatgcttggacaggggtgcttttctcaagcgttgacgtatcggtcatccttgtctacaatgtctcattagtaaggatgaaaacgatcggtaaacattaaaaccattttcgttttcatatttttcctcaaaaatgagatcgaaaacggtaacttcagaaacgaacacgacatcggtaattcggaaacatcgaaaaca

SEQ ID NO: 50228 - DNA, 445 bp, Zea mays
  Clone ID: LIB3067-029-Q1-K1-F9
cagtactgttagagcatgatgctgtactggaatgtgctgtccttggcttgcctgatgaaggctatggggaggttatatgtgcaataattgtgcctaaggaggatgcaaagaaaaaggctggacaggactcaaagccagcgctaaccttggaagcattaacaagttggtcgaaagataagcttgctccatacaagattccaacaagactatacttgtgggattctcttcctcggaatgccatgggaaaggttaacaagaaggagctgaagaaattgttaggagcttagccatgtgtatagatgtatttatctcttcatttccttcttaaagtttagcaagtcgggctcattatattgattagcgaataagtgctttcgttaccatggaccaataatcttcgaaacggcccgagttatactgcgcacacatttatttatcagaaaag

SEQ ID NO: 50229 - DNA, 426 bp, Zea mays
  Clone ID: LIB3067-029-Q1-K1-G1
ctgatccttccaatgaagcaacaggctgggccatcaatgatcgtggggttggattcacatttggtcctgataaagtttctgaatttcttgagaagcatgatttggaccttatctgccgagcacatcaggttgtcgaagatggatacgagtttttcgctagccgtcaactcgtaacaatattttcagcccctaactactgtggagaattcgacaacgctggtgccatgatgagtgtagatgatacattgatgtgctcgttccaaatattgaagcctgcaaggaagatgatgggtggttcaactaataacaaatctggcttcaagtcattcaggggatggtgacaacggcctgatggtgggcacgctgcgttcgacagggggtacatcttacagcggctgcaactaacaggcatatgcattttcgcgg

SEQ ID NO: 50230 - DNA, 450 bp, Zea mays
  Clone ID: LIB3067-029-Q1-K1-G10
atctattccagagaagaacgttacttgcctgacccgtctggaccacaacagggctcttggccagatttctgagagacttaatgtccaagttagtgatgtgaagaatgttatcatctggggtaaccactcgtcctctcagtaccctgatgttaaccatgccacagtgaagacttccactggggagaagcctgttcgtgagcttgtctctgatgacgagtggcttaatggtgaattcatcacaactgtccaacagcgtggtgctgcaatcattaaagcgagaaagttctccagtgctctctcggctgctagctctgcttgtgaccacattcgtgattgggttcttggaacacctgagggtacatttgtttccatgggtgtgtactctgatggttcatacggtgttccttctggactcatttattcattcccagtaacatgcagtggtggtga

SEQ ID NO: 50231 - DNA, 449 bp, Zea mays
  Clone ID: LIB3067-029-Q1-K1-G11
cttcaagacaaggaaggtgatgagttgcataggaactccgatgtgctagaaatcctcatgaataccaggtttctaatggtctatgtgcagtatgagcgttcactagaaacaatcataggacacgagtaagcaaagaaccttacaacggattcatgaagtttactccatatgcatttggtgtgacattggttcctttgttttgcctttcattacagtcaaatcatctggctcgggggcctaaattaccgaatcatgctttcccatcagttagtgaaggcccttgtcgagatgcgcaattctagagaaagattaggtgagagcttggtaaccctcaggtttcttttggttacccagtagtccagctaccaacacttgaaacaagctcttcagatgagaagcagcagaagcaacttttctttagaatctacttggtttctaaggattgtcag

SEQ ID NO: 50232 - DNA, 448 bp, Zea mays
  unsure at all n locations
  Clone ID: LIB3067-029-Q1-K1-E9
cccacgcgtccggcgccccgtagtgcagtgcagtgcagcagtgtgctaccctcctcagtcgtctcactccatcacaaacgctagtcttcctctaaagagatctttggcaacgaccgacagctcggagcgagtctcagaagcgatggcgtcaaagaggctgctgctggcggcgctgtgcgtggtggcggcggcgctgctcgccgtgcggtcggagtcccacggcctggaggacttcgcaagcagcgacgcgacgccggagatgcagaccttcttcaagcccgaggccgcggcgctcccggaggccctggacgcgtcctccatgcccgccgccaccatggccgcgaagccggaggccacgtcgatcccgaccaccaccaccggcaccacgccggcggcggcggcgggcacctccgccgcggcaggcactactgctgcgtcgccgncgcgc

SEQ ID NO: 50233 - DNA, 405 bp, Zea mays
  Clone ID: LIB3067-029-Q1-K1-D5
gcagaagttacacttactactccactacttttcatacgccgatcccctctcctaggccggggcgcatcacacgaatgtagcccactaacactcacactaacgacgtttccagtgcataactaagacatcgtcgccaacatcaacttcaacttcacccgctacctctgcatctagcacaactaccacattgtaaagaccgacctgaccgtcaatatggataatgaaaagctccgcgtacgccacgaccacgacgtacgtcaaagcaccatacacagcgataacgactgacatctggtatcgcagtacatttcacgcacacgtattctggctacatcgacgattcataccatctgctgctgattgtgcgatacactgctactatgcatacatgtatcgtgctactat

SEQ ID NO: 50234 - DNA, 407 bp, Zea mays
  Clone ID: LIB3067-029-Q1-K1-D7
gcgagcgccgcccttttttttttttttttggtggagaatttaagttattatccgtttgctgcaaggtttgccgtctcattttatgcgttgggatgttggcaagaaagggcagatgtcatgtgagaatttaagttaagtgaaatcgattcagggttttcttggtttcagtttctaaaaaaaaaaataaataaaaaaaaaaaaaacaaaaaaaaaaagaaaaaaaaataacaagaacaaaagcaaaaaaaaaaaataaaaaaaaaacgaaaaaagaaataaaaagggggggctcttttagaggttcaaagtttacttacgcttctatgcaatgtgaaaacttttatatgaggtaccttaaattcaattcatgggccccgttttaacaagctcggaattgggaaaaccct

SEQ ID NO: 50235 - DNA, 432 bp, Zea mays
  Clone ID: LIB3067-029-Q1-K1-D8
cggacgcgtggggaaaatgacagtcatcatggccaaataaccaccaagaactacttcttggcgcgactggtcgacgtggcacgctctggagagtcttcctcggctgaggtcatttggcttctgaacattaacagtgactgaaagcctttggtggatgatgtggatgaaagttccaaggaagaacattcatatactgataacctgataggcaataagaggaggtcttgattctcagataaacctgactatactgaatatggctccaaaaaatgttctgccctggcaagctacatggctgctccacaatcttcataggccatactgcagtggaatagttgacacatgacttagctcttgattagtatataaaaacggtttcactcggcttcactccgttaagccctctatcaatggtgagataatttcacatta

SEQ ID NO: 50236 - DNA, 448 bp, Zea mays
  Clone ID: LIB3067-029-Q1-K1-D9
cggacgcgtgggcggacgcgtggggtgccaattgcgtggtttttgccgaggaagttgttgactggttaatcttcagctaggatggtgggcgcgcctccgcaaggaccacaatgcctgttctggctacgcgctgatgaacaatgaaaatgaaccactgttacctgcaacagcatcagcagcagcatgtgcaacccaaaaggagccgtattccccagtagaaattttgtactggacagaggcacggttccaaaaggttcggccctaaaaattgctctgcaatgtcagtggtccagcgtagatgatgatgatcgcttctaacatagtctataaaaaatgcatactggagatttggtactagataacaagaggaccttgagtaccgagttttttccggtgaaagattgatgggcgatgccacagcctgaagacgaagaggatgtaaagaaaa

SEQ ID NO: 50237 - DNA, 441 bp, Zea mays; identical to SEQ ID NO: 32663
  Clone ID: LIB3067-029-Q1-K1-E10

SEQ ID NO: 50238 - DNA, 448 bp, Zea mays
  Clone ID: LIB3067-029-Q1-K1-E11
cctgtataatccgatcgaccttgcgcagttgctccgatgggcaaggactcgaagccgaaggacgccaaggggaagggcaagcaggcggccggttcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtcca

SEQ ID NO: 50239 - DNA, 450 bp, Zea mays
  Clone ID: LIB3067-029-Q1-K1-E12
cccacgcgtccgcccacgcgtccgcccacgcgtccgaattttaatcatgtgcagcatggttcaatgggtgctgctttgcaacaggaaaggactggtcccatgcagggtgcattgaatgcacagcagcagtccagtagcaacatgatatccaacaatgcaatgagtacaatgcagactaataacaatgcaaatgcgaattcattgcagcagttaaagcagcaacgtcaggagcatcaaatgatgcaaagtcagcaaatgaagcagcgccagcagatgatgcaacagatacaacaaaagcaaacgcttcaaccgcagctcccaatacagcaactaaagaaacaacagcagcaagggcagatgcagtttccacagcttcattctggaaatgatgtgaatgagctaaaggttaagcaaggagctgcaatcaaatctggaatgtatcaacagctg

SEQ ID NO: 50240 - DNA, 446 bp, Zea mays
  Clone ID: LIB3067-029-Q1-K1-E2
atcgcgagcggcgccctttattgttgctttttgtcgtagattggcacctgaagatatatgggctcagtggatcaatgtttcatggacataaaaaaatgtataacacgtagagcacttatactggcagaggctgcacccaggctcaatacaggaccactcactaatcgttactgcactcccgatgtcatattttgttcgtcaggtgacggtgagcaagatacgcaaaagaatgtggcttctctccaatgtctcttctatttttcgggtcttgtaacttcaggaagcaggtggatacaacaacagctgtattggacggaactgatgtgtcatgtgcctacttgtttgccatagatgagtccataacactgcacgatttgtccatgaattttttcattgaatgtagttcccgtccaaatggctctaggaacttcatatctatatcaacg

SEQ ID NO: 50241 - DNA, 321 bp, Zea mays
  Clone ID: LIB3067-029-Q1-K1-E3
accacgcgtgcgaaaaaaaaaaaaaaaaatttagaaaaaaaaatgaaacctaaaaatataaagagatgagaaaatcaaatgaaacgtagacataaaaaaaatagataaacaaaaaaaaaactggtcctccgtttaagatgctccaagtttcaatacacgtccattcactaatagacacttcacttagggacgcctaatttcaatccactggccatcgttttcaaacttcgcaactgaaaaaaccttgtcttcacccaatttaatagctttggatcaaatccctttttgacaccatgggatactaacacaaagtgccttacc

SEQ ID NO: 50242 - DNA, 456 bp, Zea mays
  Clone ID: LIB3067-029-Q1-K1-E4
gttcaacagggtgcttttggcaaggatgctttgtttggatttggcctcacaacatattcgttgcttggactaggagtgcttggagggccactgtctcttccttggggtttgtacgtgctaatatgtcagagaacacccgagaaaccatgcttgaacgacgtgagcgatgttggaagttggaggagagcggccttgatagcttcagtatttcttgttgttttgacgctcattccgttgtgggatgaacttgcggaggaactaggtgtagggcttgtttcttcgttctgagatgcggtgcttaccgatagaattaggccgtgatgtagttcagttttgtgttgaaatgtagcttcccacggtggaattgttgtaaaggtatgtggaatttccggattaggtgagcaatgatatcgcttatgcgagtgtaatgaaattgtgccaactgccaagtataga

SEQ ID NO: 50243 - DNA, 465 bp, Zea mays
  Clone ID: LIB3067-029-Q1-K1-E5
ggagaagctccacatggggggcgaccacaagaaggaggatgagcaccacaagaaggccgaggagcaccacaagaaggaggagggggagcaccacaagaaggacggcggggagcataaggaaggcatcgtggagaagatcaaggacaagatcaccggcgagcacggcgacaagtccggcgaccacaaggaaaagaaggacaagaaaaagaagaaggagaagaagaagcacggcgagggccacgaccacgacggcggccacagtagcagcagcagcgacagcgactgagatctggtgtcgcagcacaggtgcaacacaagtatgcttgctggatggaggattcataccagctgatgctgatgtagtgtttcactggtgtcatgcatgcatgtatcgtgctattataatcaaaaagaaaaaagaaataacagtcagggatggtttggttgccatgtgatcttgtacac

SEQ ID NO: 50244 - DNA, 270 bp, Zea mays
  Clone ID: LIB3067-029-Q1-K1-E6
ctaacaccttcttttctctatcgctttaacattcacacatcaattcaaacatcagggtaggcttaacctgatggttagatatcatacaagatcaattacatcaacgagctctgtaagggcctcactaagcgtcaccataacgttctactcaacatcattcacgatatcatgaatcctaatatcattacgcttactaataggcatgacatgaaacacatctacaatctcatctactatcagacccactacttgctcaacatctttctcaag

SEQ ID NO: 50245 - DNA, 461 bp, Zea mays
  Clone ID: LIB3067-029-Q1-K1-E7
ctggtaccagatatccagcctgacgtggaagttgcttcagatctagtcacaatcacaaatgaagaaaaagttgatgagacaccgtctgttgttgctccagcggctgaaattatgccactgcaagacatcaacagcgaagaaaatgctttggtgaatgatgtggaagagagatccaaagaagaacattcatctactgataacctgaaaggcagcaagaggaggtcttcattctcagctaaacctgaatatccagaaaatggctccaaaaattctccagccctgccaagctacatggctgctacacaatctgcaaaggcgaaactgcgggggaatagttcaccaagacttagctctgattcagcagagaaaaacgggttcactcgtcgtcactcccttccgtcccctaacaatggtaagataatttcacattcttcacgtacgcaaaggccaacccatgctgg

SEQ ID NO: 50246 - DNA, 460 bp, Zea mays
  Clone ID: LIB3067-029-Q1-K1-E8
ccgaactccatctatctcttccccacgagcgcttgcggcggcggcggcggcggaattaggaggcaatggggcactccaacgtctggaactcgcaccccaagaactacggtcccggatcccgcgtatgccgtgtctgtgcgaaccctcatggactgatcaggaagtacgggctgatgtgctgcaggcagtgcttccgcagcaatgccaaggacattggcttcatcaagtaccgctgaaatcaggtgggaatggaccatgtggtagaggcgaggttgtagttgtatttccagtaatttagatgttttgttcagaagtctgctagtaaagactgctacgtttatgatggagaacttagccatgttggtcatgttggtcatattgatcatgagttacctatgttgagcttaaactatcatgtgtccaaccatcgctgggtagtatgattactggaatgtatgat

SEQ ID NO: 50247 - DNA, 218 bp, Zea mays
  Clone ID: LIB3067-029-Q1-K1-D4
gtgaaggactgagaactcgatcgggaccagtagattaagtgggcatgacgtccataataagtgagtaatcacgtacctagccgcttgtactagtcatgccctactttattactctaaaagatacatttcgttgcgtaatcatcttatggctaccatagtcatgtggtccaatatatactgtctcatatctatattcatgcactggcagaactcaatct

SEQ ID NO: 50248 - DNA, 460 bp, Zea mays
  Clone ID: LIB3067-029-Q1-K1-B6
cggacgcgtgggcgaggagatgagtgaatcatgcagaagtttctttggccgattaagcgagtcgttgttagtctggggaagcaaattacctgttgagtcaagggcatgctactcgaagatggcagaggagctatgcgcgcttctggtggacaccccaagcgagacgctgaacctacccatggggtgtcttctgacgatgctcaacgctccagttccggacgagagcaggtcgtcgtacctgcaggacgcactctccgtcttcaccgaaatcctttgcagcgatccgtaggcgaaggggagtgaagcctacaggcaacacgccgaagagtttgtacgtctcatgtttggtacttgtagaaaattaggaatgtataactatgacctgatgttgctcaggtgaatttgtaatgccgtctgaagacatgtgtcgggattttcgttgtatgtgaatgtgtgtgat

SEQ ID NO: 50249 - DNA, 220 bp, Zea mays
  Clone ID: LIB3067-029-Q1-K1-B7
tcttcctaaaaaaaaaaaaaaaaaaaaaaaatttaaaaaaaaaaaaaaaaaaaaaaaaaaaaaggaaaagtttaaacaacagtcctctacaaaatccaacttcttctcttcttcacttcttctcttttcctcccctttttacttacttcctttttttacatttcttccctctataaccctcacattacccaacttaatctccttcattcccataaaattt

SEQ ID NO: 50250 - DNA, 444 bp, Zea mays
  Clone ID: LIB3067-029-Q1-K1-B9
ggctgcaattcgtgcagagagagattatgtagtccacgaagacttcatgaaggctgtgcggaagctaaatgatgcgagaaagctggaatcaagtgcgcattacagcgcagattttggcaaagagtaatgtatgatgctggacagatgcataaggcgtgtatcatcagggagctctgtcagatgcgatgcaaaagcgaaagaaaccagctatttatgttcaggctccaggcagctccactttttcctgatattcacaattttagtgaggaggattgtcaagctgaccagtgggggaaatcagtcgagaatttagtagttctgcgccagatggcctttgcttctgtaaatcgtacgtaatctgcttccgtgcgtcttagtctggtaataactctggttggacctgttctgtttccatgtacttttggacagtgtgcctgactccgc

SEQ ID NO: 50251 - DNA, 205 bp, Zea mays
  Clone ID: LIB3067-029-Q1-K1-C10
acgacgccacagcgtaccggcacagttcttatgtatcgagaaggcggtcatttcgagtcctatgtgaaatatggatacgtctgttgacgatagaaatcacctacgtgccttacgattctatttagcgatctaggaatacggtgtaatcagtacctgcttgttgacatatcgtatgcctatcgcttatgttgggtacccatgatgc

SEQ ID NO: 50252 - DNA, 318 bp, Zea mays
  Clone ID: LIB3067-029-Q1-K1-C11
cggacgcgtgggcggatatctcggctctcgcatcgatgaagaacgtagcaaaatgcgatgcctggtgtgaattgcagaatcccgcgaaccatcgagtttttgaacgcaagttgcgcccgaagccttctggcggagggcacgtctgcctgggcgtcacgccaaaagacaaacaactaaaaaaaaaaaaaaaaaataaaaaagtacataataataagaatagaaatcaattatcgattcatatcaggtgaactagctgatcatgcgaataaaggatgttcagatactgactcaggcgtatctgtatctgaccgatcagat

SEQ ID NO: 50253 - DNA, 451 bp, Zea mays
  Clone ID: LIB3067-029-Q1-K1-C12
ggaaagggaaaacgccaccacacgcggatcgaattaggctctccgagtctccgggtgcctgctgtcggcggtggctcaggtccctctacatctgcggcgtggcactcggcgtctgacctcaacaagcaagatagcagatggcatgcggcagggtcgcgcatgccaccctcaagggcccgagtgtggtgaaggagatcttcattggactgaccctgggtctgatcgcgggaggcatgtggaagatgcaccactggaacgagcagaggaagactaggtccttctatgacatgcttgacaagggccagatcagcgttgtcgtcgaggagtaaagagttcttcccagatattttcaaagaactctatcgagagcatgacatagtgattgcttgctgtggagatttgtcctggaaataagcacaaccatttgggaacaccagattatgtcgaattt

SEQ ID NO: 50254 - DNA, 425 bp, Zea mays
  Clone ID: LIB3067-029-Q1-K1-C2
ctggaacgagacgtcgccgctcgggtggtggacgctcaagccgcgccccaaggaagaaagagagatggcacacctctacgagcgcaggaagttcccgtaccctggcgatgatgaggcggtcgaggagtttgtaaagagcggaggtgctcttggaaccacaattggacccaggggattcgctgacgccaatatggattctgaaaacatgcagaagcagctgcagtctaagaagttcgagcaggaagcacagaaactgtggattcggatgaggaatgaggtcgtacaggagctccaggagaaggggtttgatatcgagtgaatttgaaacctgcagtatggtcggcgctgaggatgttaaaacttaaaaccacttgccatctaaattggagaactgtataacttaggaataaaaagagttgtagcta

SEQ ID NO: 50255 - DNA, 419 bp, Zea mays
  Clone ID: LIB3067-029-Q1-K1-C4
aaaaaacaaaaaaaaaaaaaaaaaaaaaaaataaaaaaaaaaaaaaaaaaaaaaaaaaaaagggaaataaaaaaaaataaaaaagaaaaaaaaaaaaaaaaaaaaaaaaaaacctttttttaatccgggggcggcccttttgcgggtcccatgtttccttccccctctttgcaacctttacctttttcttcggggccccctaattcaatttcctggcccctttttttacatctcgttctcggaaaaacccctggtttacccaatctaattgcctttcatccatatccccttttgcccctctggctttttcccaagatgccccgccccaattgcctttccaaccttttgcccgccctatttgctaactggaccccccctttaaggggccttttaaccccggcttttttttgggttccccc

SEQ ID NO: 50256 - DNA, 459 bp, Zea mays
  Clone ID: LIB3067-029-Q1-K1-C7
gaaaggtggccttataatgtttgatgtgacagcagattatgtcacctaccatttgattgagttacctccagtaatcactttaggggtttttggaggaatactggggagtttgtacaactttttcctggacaaggttctccgtctctacaaccttatcaacgagaaaggaaaagcttacaaactactactcgctgcaacagtcactgtttgtacatcatgttgtctatttggcttgccatggattgctgcttgcaaaccttgtccaactgacactagagaagcttgtccatcaatagtccgttctggtaatttcaagaaattccaatgtgcaacagatgaatacaatgatttggctagcctattcttcaacacaaatgatgacactattagaaacctctacagtgctggcactgatgatgaattccacatttcgtccatccttgtgttctttattgcatc

SEQ ID NO: 50257 - DNA, 402 bp, Zea mays
  Clone ID: LIB3067-029-Q1-K1-C8
cccactcgtccgcccactcgttcggaagggatggtctgaaaacctgtgagagcatgggcggtattttggagacagattgcaaagtagccaggtggtgtagagaccagtagagagctacaaagctagagaatcggaccttatcatggctaagtttatcgatgtatgtatgaagtatggtgctccagttcgtagtagcaactgggaactgatgtagtcctgatggatggacttggactcaccctgatcggtcactcaggcactctgtactgtagatgtaggcatgtagctgctgctagtagtagtagtaatgcaagtactgctttgcatcgtatgggtgagagagttgaacaactaatggaatgcagatgtgccgtattgttttaaaaaaattatctattatgc

SEQ ID NO: 50258 - DNA, 412 bp, Zea mays
  Clone ID: LIB3067-029-Q1-K1-C9
aaaagatttagagaataaccagaggaatgttgatggagacacttctgcagcacctggagatggatgggtgcttgactcggcgtcaggatattaccatgacaaatctactggactttactacgattcaaactctggcttctattattctgacagtttaggcaagtgggttacccaagaagaggcgtacaagtccgtgcaagcttccaaatcagacgctggccaatcctcagcttcacaaacaaaagctcctgctgccgcagaaacagctgtccccgcgattaaaggaggtgcagctccaggccgggtggtgacgaaaccgttgaacccaatgagaccgattaagggcactcctgctccgtctgctgttgctgttaacaagaggaagagggatgacggcaagcccaaggcggtc

SEQ ID NO: 50259 - DNA, 451 bp, Zea mays
  Clone ID: LIB3067-029-Q1-K1-D10
cccacgcgtccgcccacgcgtccgggaggagttccccaccctctcctatgccgatttctgccagcttgccggagttgtggccgtcgaggtcaccggtgggcctgagatccccttccaccccggcagggaggacaagcctcagccgccacctgagggccgtcttcctgatgccaccaagggttctgaccacctgaggcaagtctttggcaagcagatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggtcttcttcagctcccaagtgacaaagccctgctgagcgaccctgtcttcccgcctcttgtggagaaatatgctgcagat

SEQ ID NO: 50260 - DNA, 442 bp, Zea mays
  Clone ID: LIB3067-029-Q1-K1-D11
ggatctgaagaaggaattctgctgcaatggtactgtagttcaggacccagagctaggccaggtcattcagctccaaggtgatcagcgcaagaatgttgctacttccctagttcaggctgggattgcgaagaaagagaacatcaagattcacgggttctaagggacctgtaaatgcttgtgccctatattgtgtgcctccacatattggggagcttgaagcatcgacaagttactagtcattgcttacttatataagaacataagtagtatttgctattgtcaagtgtgccttgcttgatgcaagttgtgttttcgtatcattattattatgcacggccatcgtacgtgtatggcttgtatgggttattgccaacttaataaaagcacactctgtttgcctaaaaaaaaaaaaaataaataactaaatattaaaaaaaaataa

SEQ ID NO: 50261 - DNA, 449 bp, Zea mays
  Clone ID: LIB3067-029-Q1-K1-D12
cccacgcgtccgcccacgcgtccggggcgccaaggcggacaagaacctgcggttcctgctgcagaaggtgctgaagcagagcgacgtcgggagcctcggccgcatcgtgctccccaaaaaggaagcggaggttcacctgccggagctgaagacgagggatggcatctccatccccatggaggacatcggaacgtcgcgcgtgtggaacatgcggtacaggttttgggccaacaacaagagcagaatgtatctgctggagaacacaggggaatttgttcgttccaacgagcttcaggagggggatttcatagtgatctactccgatgtcaagtcgggcaaatatctgatacggggcgtgaaggtaaggcccccgccggcgcaagagcaaggcagtggttccagcgggggaggcaagcacaggcccctctgtccagcaggtccagggagag

SEQ ID NO: 50262 - DNA, 325 bp, Zea mays
  Clone ID: LIB3067-029-Q1-K1-B5
cccactcctaccaccacacattctccagaattgctaacaaatctagacaagacttgctatgcgaacatccaagggacagcaggtcttacaaaacgcacaatcactccatatacatactacccttccaaggctacttgaacgactcaaacctgacaatacacactcatgactatcgacgacaactataaacagactggtacgacaaacttccacatacatccagactacctgatgcacctactcgccatcataatcaatgttcacatgctgaacaccatcatgcccatcctccgacgatctaactctactgacatccttacatgtg

SEQ ID NO: 50263 - DNA, 383 bp, Zea mays
  Clone ID: LIB3067-029-Q1-K1-D3
cccacgcgtccgcccacgcgtccgctaaagagggcagggcaggcgaatcgaaggaaaagtagtcaggagaggcgtttccctcgcaatcgaccatcacagatcaaatcgctgcaactagctagggtttcgtcgcctcatctctcgtcgatccatcgatggcgtccgagggcgacaacaagaggatgatcacgctcaggagctccgacttagaggagttcgaggtggaggaagcggtggccatggagtcgcagactctccgccacatgatcgaagacgactgcgccgacaacggcatcccgctccccaacgtcaactccaggatcctctctaaagtcatcgagtactgcaacagtcacgtccacgccgtcgccaaacccgctgac

SEQ ID NO: 50264 - DNA, 320 bp, Zea mays
  Clone ID: LIB3067-002-Q1-K1-C11
ggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagtgccatcgagggcatgaacggcaaggagctctacggccgctacatcaccgttaacgaggcccagttccgc

SEQ ID NO: 50265 - DNA, 433 bp, Zea mays
  Clone ID: LIB3067-002-Q1-K1-C12
cggacgcgtgggcgatggcgacggagctgacggcggcgcagctgcgcgcgtacgacggcaccgacccgtccaagcccatctacgtctgcgtccggggcaaggtctacgacgtcacctccggccgcggcttctacggccccggcggcgcctacgccgtcttcgcgggccgcgaggccagccgcgccctcggcaagatgtccaaggacgaggccgacgtcttcggggacctctccgggctcaccgacaaggagctcggcgtcctcgccgactgggagatcaagttccaggccaagtaccccgtcgtcgcccgactcgccgtcgacgcctgaactcgtcagtctcggtctaaatttactctgtcctgcctcttgcggtgttcagtgctgtgcttgcttgcttgatgctagttgctttgctacccaataatctgaat

SEQ ID NO: 50266 - DNA, 266 bp, Zea mays
  Clone ID: LIB3067-002-Q1-K1-C2
tcgcggacgcgtggggacaggacgagactcgcagctagctgacacggccgagaagcagcttgcggtgtgcaggcgtagtacgtacccagcagcagctagcactagcagtccatcggagcgaccatggtgagaaggacggtgctggctgcgctggttgtggccgccgacctagccgtcggcgcgcgtgcgcagctcacggaggggttctacgactactggtgccacacaggctgaggatatcgtcaaggactacgtgaaggcgcaca

SEQ ID NO: 50267 - DNA, 392 bp, Zea mays
  Clone ID: LIB3067-002-Q1-K1-C3
cggacgcgtgggcggcgcgtggggtccgcctcagcccgccgcaaggagagttcaggagacatcttcgagaagctgaaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctcaggtacccccttaccacagaatcagcgatgaaaaacattgaagatgacaacactctggtcttcattgttgaccttaaggcagacaagaagaagatc

SEQ ID NO: 50268 - DNA, 424 bp, Zea mays
  Clone ID: LIB3067-002-Q1-K1-C4
gattggtctgattggaacaagtggatcagcaatcgtggtgggattggtgtgtcaccagacaagagctgggaatcttggtgggaagtggagcaggatcatctaaaatattcaggaacaataggacgctttgttgagataatcttggctatacgttttttcatataccagtatggccttgtttaccacttacatgtcacacataacaaaagcatctcggtatatttaatttcttggctcgtaattgtggcggttctgctcgttatgaagactgtgtcggtgggaaggcggacattcagtgcagatttccagctattcttgcgtctgatcaagtttttgatatttgatgctttcattgctattgtgattgtcttgatagtattacttcatatgacctttcgcgatatatatgtgtgctttctagcat

SEQ ID NO: 50269 - DNA, 400 bp, Zea mays
  Clone ID: LIB3067-002-Q1-K1-C5
cccacgcgtccggtactgcacactgccatcgctctcgtcccttcgctgccgctctatctcggccggagccatgggcggcggtggcgcggcgctgctgctggtgatgtgggcggtcgtggcgtcggcggccgtgtacgaggtgggcggcaccattgggtggaccgtcatgggcaaccccgactacgccggctgggccagctccaagcagatcgtcgtcggcgacactgttgtgttcacgtataacaagcagtgccacaacgtgctggcggtgagcaaggcggactgcaagaactgcatcgccaccaagccgacggccacctggtccacggggaacgattccgtcgtcctgaacaccacgggccaccactacttcctctgcggctacccgggccactgcgct

SEQ ID NO: 50270 - DNA, 432 bp, Zea mays
  unsure at all n locations
  Clone ID: LIB3067-002-Q1-K1-C6
cggacgcgtgggtgagaataagctgagctcggtaaactctaccaaggatcgttcttcgagagaatatacatattcagaaaggacttatgtgtcagatatgcaagtgaaaagtgtttcttcttcagacattcgaatcagtgtttccagtgcccttagcacatccagccatggctctatgaacaagagccatcaagcttctagttctggtcgttcgctctcctatttttctgctcaatatgcataaatgtgatctgatttgtgtagcttgctcgtcttgctaagatggaggttgagtatcgatgtatccagatcatagagattggtcttccaatgggtaaacatattangatgagagacaccccgggggtctaaaatctaatgttgagtccgcattgcaagttctgaattttgcaatataagttgactgatatg

SEQ ID NO: 50271 - DNA, 227 bp, Zea mays
  Clone ID: LIB3067-002-Q1-K1-C8
aatttttcgtcgtatgcgaaactggatctccaaatatggaaatgctgctgaaagcgaggtactagctgtacacagacttcgttctgaagaatcagatctatgatatggagatgccaattcggtgcgagctgattgaccacaatctgcctcatgtgatccacaaggaccgcgttgcgctcctgtgacatggaactcataacgctttcggagctatatatacaatgtat

SEQ ID NO: 50272 - DNA, 360 bp, Zea mays
  Clone ID: LIB3067-002-Q1-K1-C9
gctcctcaacaggatgctctgatctgatctggtctgcgttactgcgtatgtagtcacgtggctccagatcttgcttgggcgctgatgagctacactacactacactagttttttctgcttcttttagtttttttcccccctcaccccttgagattggggaggcctcttctgcttctagcatgcttgcttgctgcttcttgaattgcgtgactgttattggttggttcttgcttccattattttgccctttttttttttcttttttctttcttgcttccagcttgttgttgatgcagtttttttttcaagagacaagattagtataatgtcaagtgtgaatgaagagctctatttattatt

SEQ ID NO: 50273 - DNA, 387 bp, Zea mays
  Clone ID: LIB3067-002-Q1-K1-D1
cccacgcgtccgctttatcaagctactaaagatccttggtacctagaagtgggtgaaaccattgtgaggtcacttaattactatactaaagtggatggaggttttgctagcatcagagatgtttcaacaatgaaacttgaagatcaccagcacagcttctttctttcagaaacgtgcaaatatctatttcttctgtatgatgattcattcttgaggaatcaaaattacctttttacaaccaaaggtcattccctttcaataagaaacacgtggcatgaagaattttctggaacatatgttcccaggcattggacatcttgtaagggttaggttcaacccatttgcgccagcgcattattgtcttaaggtttgcccgagaccattttc

SEQ ID NO: 50274 - DNA, 440 bp, Zea mays
  Clone ID: LIB3067-002-Q1-K1-D10
ggagattttgtccatgttataggggatgctcatgtctatagaaatcacgttcgagctgtggaggaacagattcagaagatgcctaaaccatttccaattttaaagataaatccttcgaaaaaggatatagattctttcatggcgtcagacttcaagctggttggctatgatcctcaccagaagctagagatgaaaatggcagtgtaacggtggcttagctctggagcccccagccttggaacctcggtgggtgaaatcagtcgaacgaactggtactacataaaaaatgaaccggacatcgcactagcttgtttttggtgatggtgctgaatgttgtgcgggaggcgttttcccccgttattagtagcgatctgcgtgctatatatggtcgctgaagtcaaaattgtctctcttttatttttatctactactactactca

SEQ ID NO: 50275 - DNA, 440 bp, Zea mays
  Clone ID: LIB3067-002-Q1-K1-D11
cccacgcgtccggatcttgagtgttcaacaactgtacagaatatgtacacaatactgggatgacaagtataatacccaaagtgtttcatcagacgttcttagtaacatgcgggtgctaatgacagaggattctaacagtgatgaaagcggttcgttcttgttagatgataattcgagcatcccgttctccgtggatgatatcaccaactcaatgcatgagaaggacttcacggatatcaaaccggctgatgagctactcgagaaccctgccttccagtttttacaggattagcgctagtgaagtcctcgagcattttatgctgctagatatcttgtcagatcatttattgatttggtgtatatttattggatcttttgtaccacatgtgcctttatttagttatcttatccttttcagctagcttttgtaaaaattcata

SEQ ID NO: 50276 - DNA, 206 bp, Zea mays
  Clone ID: LIB3067-002-Q1-K1-D12
cccacgcgtccgaaaaaaaaaaaaaattaaaataaaaaaaaaaaaaaaaaaaaaaaaggaaaaaaaaaaaaaaatataaaaaataaaaaaaaaaaaaaaaattaattacaaaataataatttttttattttatattctaaattaatttctatattcaaaattattcaaatttatttttattaaaatcttatcaattacctaattta

SEQ ID NO: 50277 - DNA, 276 bp, Zea mays
  Clone ID: LIB3067-002-Q1-K1-D3
cggacgcgtggggtcggtcccatgagagtaagtctcaatatattgctggttatttctgaggacgggctactggtggctttgctcggttgttttttttttgcaaccaattttataggccgattcttttatttgtacatggcctgggttgtgctgcttgcgaggtcctaagatgctcatagctttgtgttgtgactgtccatatgtgtatatcgatttttttcatcaatttgttacgtatgggcatatcctggtatgttgtcaattgtattggcattc

SEQ ID NO: 50278 - DNA, 418 bp, Zea mays
  Clone ID: LIB3067-002-Q1-K1-D4
cccacgcgtccgatctcggagcttgaacggagcgtcaccagtctccagatggaggtggcggcgctgtccccaaaagggtcaagaggatattggcaaacaggcagtcggctcagaggtcacgagtgaggaagctgcagtacatctcggagcttgaacggagcgtcaccagtctccagatggaggtgtcggcgctgtcccctcgcgtggccttcctcgaccaccaccgctcactgctcaccgtcggcaacagccatctcaagcaaagaatcgcggcgctcgcccaggacaagatcttcaaagacgctcaccaagaggcgctggagaaggagatccagcggctgcgccaagtgtaccagcagcagcaggtcaaggtggccaccaccggcggcgccgacatcgccaccggcgacttcgcgtc

SEQ ID NO: 50279 - DNA, 439 bp, Zea mays
  unsure at all n locations
  Clone ID: LIB3067-002-Q1-K1-C10
gaccggaggagcccactcctgcatgtaactcagatactccacccgagagtccgcaccaactcacatcacacctcaccttccactccagaagaagaagccagaccggaatcccgagagccctgcccctgctccctcggttcctcctccgttgggcgtttggccgccgggggtggtgggccgagaccgagatgatatcgtggaacgatgtatacacggtgctgaccgcgatggtgcccctgtacgtggccatgttcctggcgtacgggtcggtgcggtggtggcgcatcttcacggcggaccagtgctccggcatcaaccgcttcgtggccatcttcgccgtgccgctgctgtccttccacttcatctccaccaacgacccgtacgccatgaacctncggttcctggccgcggacacgctgcagaagctggtcgttctcgc

SEQ ID NO: 50280 - DNA, 449 bp, Zea mays
  Clone ID: LIB3067-002-Q1-K1-A4
gggagatcctcaatttggatatccatattctttcctactgctggtgtgcagagcttataagatccgccttctcatcagccggttgtctagatggtttgaacatacatgcgaacgagttcgcctttgaggaatctgtttcaaccggtgagattgacagaaagatccagtccccgctagacaaggttgagaagttcaagagcatcagaagcgacgtggacagtacggtgccattcctgtctgtttacatcggagactcggtcggtgatttgctctgcttattggaggcagatatcggtatcgtcgttgggtcaagcacaagcttgcgtagagtgggcagacagttcggtgtttcctttgtcccgttgtttctcggtctagtggagaagcagaggcaactgacggatgaagatgcgtccgcgttcaagccgcggtctggagtcctttatacg

SEQ ID NO: 50281 - DNA, 386 bp, Zea mays
  Clone ID: LIB3067-002-Q1-K1-A5
cggacgcgtgggcaagaattgcttcgccctcctcctaaggccccatccattggtattgttgatggccatgagtttgaggaatatgaggagccaccggtacttggaaggaagacttattttgtagcagataaatcaggttcgaaccatcaatgggcccaatgtgaagattgttccaaatggaggaaacttccaatagatgctctgttgccctccaaatggacctgctctgacaacaaatgggatccagagaggtgttcttgcgaatctgcacaggaaataagtatagaggagcttgcagaattcattcctataaaacctgccaaaaagcccaaattgaagatagaatctgatgctatcgatgcttcagatgggctggacacgcttgc

SEQ ID NO: 50282 - DNA, 452 bp, Zea mays
  Clone ID: LIB3067-002-Q1-K1-A6
cacgcagcggaggtctgcactgaagcatctcaaaattgagagagtcaagaagtttgagtactgcatgccttactatatgccgctgcaacctcttgaagacgagaatgacactgttatcagtttcttatatcctctagaacccccgatagtagatgagtttgactgggaaatggacgattacgaggattttgctgatcagaaagttcaagaaggtggcctgccagaggatgagaaagaaaaattcaaggagttcctgaaggagaaggttagagaaaggaagagagagcttaaacaggctaaagaagccaggaggaaagctattgatgatatggatcctaaggtgaaagaggcattcgagaacatcaaattttacaaattttatcctgtgaaaaccccagacacgcctgatgtagacaatgtaaaggctaggtacatcaaccgatactacagga

SEQ ID NO: 50283 - DNA, 376 bp, Zea mays
  Clone ID: LIB3067-002-Q1-K1-A8
gcgattcatggcgttgatacagattttctgaactatggtgacgacgacaacgacgacgacttcgacgacgacttcgagccaaatcccagcgagttccagtctctcgacaacagcggctggtcttctcgcaccaggggtgtcgcgagatatctcaagactctgttcgacgaggactccggtctggggaggaagagcgtcgccatcgaccatgtggtgcgcgggaagacgcggaaggaagcgtggaggatgttctgcgagaccttggtgctgacgacgaatgactacatcagcgtggaccaaccgaaccccttcgacttcgtgagcgtgaagccaggcccggagctggtcatgtcagaattctagatcagcagagtca

SEQ ID NO: 50284 - DNA, 399 bp, Zea mays
  Clone ID: LIB3067-002-Q1-K1-A9
gtccactaaatttagcggatagagtgctcctcctctcgtccaacaatgtccttgaagttatccgctaaattgtaccggcgtcttcagagacgctaaatgtggcggatcacgggcatcccctacacgtcggctcgtcttccttcccgcgacggggcggaattttccccctcacgttctcttcccgtcgcaaaggtcttgtccatggcgccggctagtttccggtgggatttctcggaggcggtctcggagctgggatcgaggggaccactcgggtcgaaggtgcctactcgcgataatcggccaagcgctgtgtgccctcctcgaagctcagtgccgagaaaatgaatcgcagcctggatctggcatcctcgtcgtcttcgattcaatcgacgcttctag

SEQ ID NO: 50285 - DNA, 417 bp, Zea mays
  Clone ID: LIB3067-002-Q1-K1-B1
cccacgcgtccgcccacgcgtccgccctcgcctgcctgccgttccgcgtttgaccaactcccccgcaccgtaaccctagcagcagatcggccatggagagctgggcgacctgtgtggggacaagcgtcacctccggcttcttcgcctgcctcgagcgctgctcctgcatcaacctctccaccgacgacgacgacgacgacgaggaccacgacgaggccaaaggccgggcccttattcttggcggccgcccaagccactacttcggcggcaagcccgatccagacttcggcggccaggaccaggacgaccagaagcaagagcaggcggcgctgccggccgtatgaatcggacccgattccttgcttggactagctgctactgctggtatgtcgccaaataaagtcgtgtgtgcgtgtg

SEQ ID NO: 50286 - DNA, 445 bp, Zea mays
  Clone ID: LIB3067-002-Q1-K1-B11
gcgaagcaaagcaaagcttcaaagcatcctcccctgcgagaagagaggaggacaatggggttcgtgctggtggtctctttgcacttcatcttcctctccatccttctcggcttcggctgcttcttcctcggcaagcacaggggccgggaggagatgcgaaccggcgtcggcgcgcaggtctacggcacgccgctgccgccgcccggcgtcgtcggagtctcatcgccgccgcctgagccgattcacgccaagaaacaagggcccgaagccgtctgattgagatccattcgtttctacctactactgcctatgttttggtgatgttggatttattctttcttctttattttcgtccagaccgtgtcgacgggtgtaagctgagagtgaatatatgtttgtgtctaaaaattgttcattgttacgacttacgaggggagggggtgat

SEQ ID NO: 50287 - DNA, 341 bp, Zea mays
  Clone ID: LIB3067-002-Q1-K1-B12
ggatcacgatacaagtgctgatggtgattgatgaaaaaaaaaaaaaaaaaaaaaacgggaaatataataaataaaaaattaaaacaaaaaaacattctacataattattaaattataatgtaaattaattaaaattcactagttgacggtatacgacttcatgccttgtactaactcacgtataccgtaacttcactaaattgaaccatatgacaataaaacgactggcctagcttagcctaattgatggacctaaataatgtaccaaatgtgtgatatgcatattgattcttctcatcctacttgtctctacatattaagcactatagtattgcatttta

SEQ ID NO: 50288 - DNA, 418 bp, Zea mays
  Clone ID: LIB3067-002-Q1-K1-B2
cccacgcgtccgcaattggagacgtggaattgaaacagaacaaattcctgcctcccgagaagcaaattgtgacggccaatcctgatatcaacgtcgtggagctctgcgatgatgacgactttgttgttgtagcatgtgatggcatttgggactgcatgtcaagccaacagctggtggattttatccacgagcgtataaacacggagagcagcctgtctgccgtgtgcgagagagtgctggacagatgcctggctccatcaacgatcgctggagacggatgcgacatcatgaccatgatcctggtgcagttcaaaaaacctgtcgatcggaacaagaaggccgaagcagcagggcaatctgccagcaatgtggacgaagccaagagtcgtgttgctgaggagtgaagcatggctggcac

SEQ ID NO: 50289 - DNA, 252 bp, Zea mays
  Clone ID: LIB3067-002-Q1-K1-B3
cccacgcgtccgtctatattgtatagaactaagatcatgcttaattgacatatcttgtgatcatatctctttcattttggtacaaatgcatatatcttattattctcgtaccatgactacggctaatatgtttccaagtatatttctatactaagtcgtagattgaaagggaaatggagtcttcggcgaagacaaggcttccactcaactctatgggtgttatctaccctttggcattacttcgtaatctat

SEQ ID NO: 50290 - DNA, 224 bp, Zea mays
  Clone ID: LIB3067-002-Q1-K1-B4
aggagaggctcgccaagatgtacgaggtgaatgaccctaacaccatcttcgacttcaaggtgcgcacccacttaggtggaggcaagtccactggcttaagcctcatctacgataaccttgagtctgccaagacgttcgagcccaaataccgccttatcaggaatggtcttgctactaaggtagcaaagtcctggatgcacatgaaagagcggatgaacagggcc

SEQ ID NO: 50291 - DNA, 261 bp, Zea mays
  Clone ID: LIB3067-002-Q1-K1-B5
gcatcgcgcaggtgtgctgcaactgcagcgtctgcatggaggagtacttctgcgcagcctgcaacttcttggacgatgacgttgacaaggagcagattacattgcgacgattgactgctctgcaggtgcgtgcgtgcgtgtgtctgtacctctttttttgtttcttgggttctttacttcctttcattgaggccactgagttacaggacctgaggcgccggccacaaatcgcgattttagtaggaacccccccgtgggatt

SEQ ID NO: 50292 - DNA, 407 bp, Zea mays
  Clone ID: LIB3067-002-Q1-K1-B6
aggaaccatacctggcactacacttcctcctcctatcacagctagcgcctgatctagggcgtgtgtgatcatgtctggcatcatctgcaagtgcaactgcggctacagctgctgctgcagcagctcatgcaactgcatgtgcaatgacgtggagaccgacgtcgacagcagcatcaagaccatggtcctcactgtgccgaccactaaggccagcaccagcggcttcgacgcgggcaccgagggcggcagctgcgactgcaacagctactgctgcagctccagctgcggctgctgctgctgcagctgcagctgaaccggcccgtcaggcctggcgatcgggcacgagagtcgagaggacaacgacgacgacgcgtataactatgcttaatagcatcgtctatatcaga

SEQ ID NO: 50293 - DNA, 418 bp, Zea mays
  Clone ID: LIB3067-002-Q1-K1-B7
gtttcctgaatctttgtgttctttattggagcacttgtagtttgtacaatgtttaatattggcgtgttcaggtttaggcccgtcggaatcaaatgcacaactgcaggtatagccagataagataatcggtggagctcaatgcaagctcgggattggacgattgtagacatcactaacaacatcagaggagcgagcttgcggtcaaaaacacagatgggcaacaacaacaatgaacacgaaacgaaacaaacggacacgagacgaccacagacgaagataaaccccctctagactagggtgaacacggtagcagaagcgaacaagataactaggcctcagcggaccccaccgctcagttcctccagttcccgtcgttgttgccgtagccgccgacgcggtttccaccaccgtatcccgt

SEQ ID NO: 50294 - DNA, 63 bp, Zea mays
  Clone ID: LIB3067-002-Q1-K1-B8
cccacgcgtacggtcaaaaaaaaaaaaaaaacaaaaaaaaaaaaaaaaagtcagccggggtta

SEQ ID NO: 50295 - DNA, 415 bp, Zea mays
  Clone ID: LIB3067-002-Q1-K1-C1
gtccaaaagctgtaattacacgctcacaatatataaaggaagcaactgaactgggaaagaaggccagggagttaaaaaaagctgctgaagccctacaccaagaagaaagaagtgggaacaagggccgaaaatggcgcaaaaatgtgaaggctttagaaaaggagttattactcctggaagatgacatgaaggctctagaagagatgtatcctcaaggagaacaggctgaggctacttgggcattcacagttcttgggtacatcgggaaacttctatttggtgttgctgggttaataggttcaatagcttgggttgcacatattgtcatatacttgttgatagatcctcctgtatctcatgtcctgaatgaagtcttcataaaattggatggtgtttggggtctgcttgggactgc

SEQ ID NO: 50296 - DNA, 407 bp, Zea mays
  Clone ID: LIB3067-002-Q1-K1-A3
tcggtgcgacgccgctcttggccagaagctggcttctaggctgaacctgaagccgagcatgtaagatcgacgaggaagaaagcaggcaccggtggccaaggatgcaacgcaacatggagcgtgtgatgtttacaccaatataattgaataaacaggggatgtgcgcgtcgttgtacttatgctgatgctgaggtcgtggtcgatatatatactgaacttttggtggatgctcttcttttctggggagacctaatggaacgaaaaaaaatgtgtcattggggcctgtggtacaaaccctgctgtgtatgggcctgtctataagaaacagcgattagctgtgacgttatgtttctgacagtttatttactaatgagcacatctttaatttactaaaaaaaaaataaaaa

SEQ ID NO: 50297 - DNA, 398 bp, Zea mays
  Clone ID: LIB3067-001-Q1-K1-H1
gcgtccacgcgtccgctctcaatctgataccgcagatccgtcgtccggtgagtggaagccgcacgaacccatggcctccggcgagcttgcctgcacctacgccgctctcatcctcagcgacgatggcatcgccatcaccgccgagaagatcgccacgatcgtgaaggcggccaacatcaaggtcgagtcctactggccggccctcttcgccaagctcctggagaagcgcaacgtcgaggacctcatcctctccgttggatctggtggcggagctgctccagttgctgctgccgcacctgctggtggtgctgcggctgctgctgccccggctgtcgaggagaagaaggaagaggccaaggaggagtctgatgaccgacatgggcttcagcctggtcgac

SEQ ID NO: 50298 - DNA, 425 bp, Zea mays
  Clone ID: LIB3067-001-Q1-K1-H10
cggacgcgtgggtccttgagtaccttaaagattgaagaaacaaaaaaacaagtttcagcacaaggttccaagtcagcacaaacatcaagcaaggcccctgcaattacagcgccaaaacctacagcataccgcccacctcatgctaagggttctgcagaacttcaggacaagctctttggtggactagctcctgctgggggggagatgagcaaaaatgcattgcgaaacaagaagcgcagagagaaacagaaggaaaagaaagctgctgaagcgtcaggctctcctgctgatgaaagttgatctgtgccggattactttcagcattgccaaccaccgagtataacagtgacaaatgatttctttcaatctggtgaaacggccatgcaccgattcacgtttacaatatgaaactttttggtagtttg

SEQ ID NO: 50299 - DNA, 433 bp, Zea mays
  Clone ID: LIB3067-001-Q1-K1-H11
cccacgcgtccggtacaccataagggcttggtaccatctccagtttgatgatatgatggaactgttcgctctcttggatcctgtgcatggtgctaaaaaactcgagcagcagaacttcctacctgaggaaatcgacacgcttgagcagaacttcctgtcctatttctttcgggtgatggaaaagagcaattttaacatagtaaatgacgatgaggttgaacttgctcattctggacaatatctgttgaatcttcccattaaagttgatgaatcaaagttagatgacaaacttctgtcgaagtattttaaggagcaccgtcatgaaaacctgcccgacttctcagacaagtatgttatatttcgtaggggcattggattggaccgcactagcaactttgtcttcatggagaaagtggacatgatcataactcgt

SEQ ID NO: 50300 - DNA, 268 bp, Zea mays
  Clone ID: LIB3067-001-Q1-K1-H2
tcgcggacgcgtggggctgcggcggcgttccgtaagatggggaagtacatgcgcaagcgcaggggggccgatggcgagggggtggccgcagtcgaggtctcgcaggttgatggtgtgcggacgaggtccaggtccgaggcggcaaccggtggcggtgtcgctaaagtcgctccgcctgagaggaagaaggcactgctggccgctgtgaacgaaactgcttcagaggagcctggtgccgtaggcggtggtggtggggactgctgaagct

SEQ ID NO: 50301 - DNA, 418 bp, Zea mays
  Clone ID: LIB3067-001-Q1-K1-H3
ggcctttatttgaagaagcaggaattgacttaggaaagagcgaattagatacagaagttggtgaaaaggtttgggaaaagatagcaccaggtctggactcgcaatttgatgccccctattcacttcctttgcttgcaccacggccgctgctacttctaaatggcgctgaagatcctcgttgcccaataagtggtttaggagaagctatttcaaaaactgctaaagcttacgaagaatctggttgcgcggagaagttcatgttcattgcagagcctggagtcggccataaaatcacaatcgacatggtgaaggcagcaagcgaatggttcgatcgcttcctgcatgcatgaatgcaaaagttattgtcgcccatcatttgttctatatcgattgtgatttgtcaacagcatccagtatg

SEQ ID NO: 50302 - DNA, 428 bp, Zea mays
  Clone ID: LIB3067-001-Q1-K1-H4
cccacgcgtccgcagggcttgaaatttccagccatgttctgtcacctatcgtcttccttaagctgaagaagtcgactggttctcctaccactgatctagaccttcttgaaactattgctgacaaggccttgaaggaagactcagttttcgttgtgacatcaaagaaatcaaatctggataggtgcaaacttcccattggaatccgcctgtttgtatcagctggccatactgaattagacatctccaggctttcctcatccttgaagagggtttctgcatcggttctttcagattacttttgatccacatcggattcccttaagacgaaagccatccattttctacgcgctttgtactctaggccgtgtgtgtttggtaaatgtacataacctgtacatttctacatgttatgaattgacctttgtgca

SEQ ID NO: 50303 - DNA, 410 bp, Zea mays
  Clone ID: LIB3067-001-Q1-K1-H5
cggacgcgtgggcattattttaatctgcgagctcacagatttgaaatagcggtgattgagatatatgatcaatctagggcggacaataaagatgtcatgaagctcatacttgggaagcataatctttcagcaccaattacatcatacgcccgccctgaggtggcagtaaaatcccagtcatactttttcacccattcagtaaaagcaatggcagttacacaaacggctaaggggatcacttccaagcagattctgattggtactattggtgaccaggttttggcacttgataagcgctatcttgatccacgccgttcagtgaacccgacacaacatgaaaaagaggacggcattataccattaacagattctttgcctataatacctcagtcctttgtgacgcactctca

SEQ ID NO: 50304 - DNA, 308 bp, Zea mays
  Clone ID: LIB3067-001-Q1-K1-H6
gtgggttggcttctcctccccctccggttcgggttcgggttcgtgagagttctgcggggttcggtttcgtagggtgagcgcatcgagatggcctcgtaggatgttgagtaccgctgcttcttcagctgcctcgcctggaccacggacgaccactccatgcacaatgccttcagcacctacagcgaggtgctggactccaagatcatcatcgatcgggagacgcataggtcccgcggcttcggctttggcacacttctccacgcaggaggtacattcagaacgccatccaggtcctgaacatgacagaa

SEQ ID NO: 50305 - DNA, 381 bp, Zea mays
  Clone ID: LIB3067-001-Q1-K1-H7
ggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgccgccgccttcgccctccgaatcccaatggcgtcc

SEQ ID NO: 50306 - DNA, 351 bp, Zea mays
  unsure at all n locations
  Clone ID: LIB3067-001-Q1-K1-H8
gatcctcttcttcggaaagaagtacggttccggcggtgcttaaatggagaaatatgatgacgaacaagagcagtgtgtgttcccggtcctttccaatcaggatctggtgaagtttttgcctttcatatcgaagaaattaataattcatgtagagggaggattcttccaacaatttgttttggatggagacttagatctccaaacactcgtaactatcctactaggtggtgacatcagtccccaaaaacgtttatggtcatagagtctgcccttcgtttgtcagtcgggcaatttttcttgcatacaatgccttcgtttaagtatcggatgagttgctgcgactaanaaaaa

SEQ ID NO: 50307 - DNA, 422 bp, Zea mays
  Clone ID: LIB3067-001-Q1-K1-H9
gctcctgctggtcccgaggagactcccgcggccgagcaggaggcagccgccgaggaggaggctgctcctcctgctggtgccgaggagcccgccgcggccgagcctgtcgccgaggcagaggctgctgctcccgaggagctcgccgcggacgagccggaggctcctgctcctgctggtccccaggagccggccgccgaggcggaggctgctgctcctgaggagcccgagaaggccagcgagtgaggccgtgcgcacgcagcggcggcggccagggcccaggggatcggcgtgcgcgcgtggcggggtagtcgctcgcgcgcgtacatggcagtatgacacgggattttgctgttcagtacgctacggttactggcgtctctctctgtgtgtgtgtgtcgtacgtagcccggtacgtatctagc

SEQ ID NO: 50308 - DNA, 441 bp, Zea mays
  Clone ID: LIB3067-002-Q1-K1-A10
cccacgcgtccgatcacaacgaacacaagctctcgatctcaccgacaccgaggaagaggagatcaatggcgtccgagcagggagtcgtgatcgcgtgccacagcaaggctgagtttgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaacggcaagacggtcgcgaccatcgtgggtgccaagaaggacgagctcctggccctgatcgagaagcatgccgcgcctgcgcctgcgtctgcgtctgcctaaaggagat

SEQ ID NO: 50309 - DNA, 409 bp, Zea mays
  Clone ID: LIB3067-002-Q1-K1-A12
cccacgcgtccgctccttggacacgactcgccgcacccatccccatccgccgccgctgccatggccgacgagattgacacgaggccggcctccgcgggctcccgcggccgtcctgcgcacgctaccgaggacgacgacagagaggagggcgagatcgccgccgacgccccctcgcctgccctccccgccgcgcacccgctcgagcactcgtggaccttctggttcgacaacccgcacggcaaaaacaagatggccgcctgggggagctccatccgacccatccacaccttttccaccgtagaagacttctggggcctctacaataatatccatcaccctagcaagttgattggcggagctgacttccattgcttcaagaacaagattgagccaaaatgggaagacccta

SEQ ID NO: 50310 - DNA, 422 bp, Zea mays
  Clone ID: LIB3067-002-Q1-K1-A2
cggacgcgtgggcggacgcgtgggcggctccgcgcgctagtatatggaggcgtgagcgccctggtcgtgctctttacctcccgaatttccgtgaaaactccaccgctcgtgcagtcgtgtgtgcagttgtgtcgcgccgctggtgaaacccctccacgccggtgttccatcccctgcgcgtggtcatgtgggtgtaccagcgtccgggagatccgtccgtgccctcgggacgagctaggcgaccccgaatcggggggaattccacaccgtagtgcgagacatgagcagaactacctgtctccgtggtcggctcgcttgcgcaggcaattcctaacgagccagtgactgatgatccaggtgttcagcaggtataggttgctgagcatgagctcattgaaggagaaagaacatgtggcccagga

SEQ ID NO: 50311 - DNA, 387 bp, Zea mays
  Clone ID: LIB3067-001-Q1-K1-G8
cggacgcgtgggcaagaatggagtggaggaagtgcttggtctgggtgagctcaacgagttcgagaagaaggggctggaaaacctcaagggcgagctcaagtcttccatcgacaagggtatcaagtttgcccacgggaactaggcaccttgcgtccttgcccggcttctaacaattgatgcccgcccttgcatttttgtttgactgcctatttttcctgccccccgtatggttggggcaatgaggcgtagtggtcgataataaaacccagcggaacatagaaaacgtgtaccagaaactgtttgcaaacaccggtgcctctttttgtgttgaaccaccattagttgagccgtgagggaatggtgaacaagctttccaaaggataaaaa

SEQ ID NO: 50312 - DNA, 335 bp, Zea mays
  Clone ID: LIB3067-019-Q1-K1-F9
ccctgtttgaacagggtgcaaccacgtctcattattttcgttcttatggtgtccgtatggaatgcctaggtgtttagctgtgcacaaataacagttaaactttgacggctcctatttcaactgctggagaaatgccagtgccctatttttgaccaccagggtgtggaatggaaatcggtaatgcgtccattttgaagggcctgagatgtttaaaagacagaacactaatgaagatcaacaatatctcaaactaaagacttatatccaattaactactctagctccatggtcctagtgagcgtaggtaaaaaagtgcatttactgcataaaggaca

SEQ ID NO: 50313 - DNA, 441 bp, Zea mays
  unsure at all n locations
  Clone ID: LIB3067-019-Q1-K1-G1
cccactcgttcgcccactcgttcggccgatcacagtggaggatcacaggcaacaacgacgacccgcttggtgtgcgttgctctggaaggtaacagaagtttgggagtggcccatcgcactcgttctgaagctcacaataccatcaacccttccttccgagtggagcaaagtttacatcagcgcaaacatcagcctgtgccctctcctaatcctgtactccttcagctcgttcatccctctagacacccgaatagtgttcctcctcccgcaagtccgcttccctctatggtccgtcgtgctcttcgccagcctgtgcctagccctcttccactacctnctcgagaaagaagcccccgaaacagagaccatcgcgagcaccaccatctncttcatcatgagcgtcttctggatctcgaccacngcnggagagctnctgagctg

SEQ ID NO: 50314 - DNA, 310 bp, Zea mays
  Clone ID: LIB3067-019-Q1-K1-G11
gcgtcatctcgtaagtccactcgtccatgctgctttcgataccatccttttgcaaaatctccttggggcccgatttcacggaactcggagtacactccggcgatgagattgcctcaatatgatgaacctgaggccctgatagaaacagttgacaatgggaattatccgtacgcttctaatcttctaccgtggcgataattcgactgctaggcacgctgcttcgacaagaatgggctagactaggtcaaaatatatcgtggtgacgtaccatacctacatcttcatagtgctcaagctgttgatcatatac

SEQ ID NO: 50315 - DNA, 442 bp, Zea mays
  Clone ID: LIB3067-019-Q1-K1-G12
cccacgcgtccgactctctctaccgtccgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaactttcggggtatgaattttaccactgataaactgagatccctagtgaagaagtggcagacattaatcgaagcccatgttgatgtc

SEQ ID NO: 50316 - DNA, 416 bp, Zea mays
  unsure at all n locations
  Clone ID: LIB3067-019-Q1-K1-G2
gtcctcgtcctcgtgcccatctctgtcccaatcaaactgattgatccgtcgcccgcagggccacagcagccgcggcgaggtcgtccgtcggattcggaggctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgaccttcatgctttgatcagccctnctgccaaggggactccgctcccgctgatcctactcgggaagtccaagaacgcgatgc

SEQ ID NO: 50317 - DNA, 388 bp, Zea mays
  Clone ID: LIB3067-019-Q1-K1-G3
ctgaaattggtggagcatttggtggagaaaaagcaactggtggtggacgagaagcagggagtgattcctggaagcagtacatgaggagggcgacttgtacaatcaactatgggagcgagctacctctagcccagggaatcaattttggttaatcctgcagaaatgttgcgcgtggatctcagtgttttctgcagacgtggatgccgtatggaaagaactgatgcaaccgcatttgagatctcagcagacttgagcagcatttattggcgtcagttgtgaaacttaaactgcaggagcatcttgtacataaataaaataagatgtttgttgctcgtgggccgtggcacgttttggtaccggtgtccagtctactaataaaatctaatgc

SEQ ID NO: 50318 - DNA, 398 bp, Zea mays
  Clone ID: LIB3067-019-Q1-K1-G4
cggacgcgtgggggcgaggtcccggcagcgctgttcgagctcaagaaccttgtgaggctggacatcgcggggaacaagttcagcggcaagatctcgcaagacttcaacaagctgatccgcctcggaacgctgtacctcgacgggaacagcttcaccggcgagatccccaagctgcagctgcctgcattggagcagttcaacgtgtcgtacaaccagctcaacgggtccatccccaacacgctccggaagatgccgaaagactcattcttaggcaacacgggcctctgcggcggtccactcggcctgtgccccggcgagtccgcgcccacgccggccggatcgccggagtcgcagccaggagcgggcggtgcagtcgacgtcggtggcggcaagaagaa

SEQ ID NO: 50319 - DNA, 466 bp, Zea mays
  Clone ID: LIB3067-019-Q1-K1-G5
cccacgcgtccgcccactcgtccgcccactcgtccgcccacgcgtccgcccacgcgtccgtgtaggtcttcattatcttctcaaccatggtgtcggtactgcttcagatccttgctttaggttacatgaaagatccttctctaaatcctttgacatcaggaccatatggcctcatctttgcatcttatgtgccattcttctttgacattccaatctcaatgaagtttcgcatatttggactgagcttcagtgataagtcatttgtatatttggcaggactccagcttcttttctcatctggaagacgttccattgtacctggactttctggcatattggctgggcttctgtatcgcctgaatacatttggcgtccgtaggttgaagttcccagagttcgcaacatcgctcttctcgcagttgtcattgcccttttcaagcaatccatatcaagggttaccgatcac

SEQ ID NO: 50320 - DNA, 287 bp, Zea mays
  Clone ID: LIB3067-019-Q1-K1-G7
aaaaaaaaaaaaaaaaaaaaaaaaaaaaaaaaaaaaaaaaaaaaaaaaaaaaaaaaaaaaagggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcggacattttagagccatgtgattgggaaaactgttggggtgacaaaaattttttttattgggtggccttttttttatggcatggtggggtttttaaaaaagtggtccgggggaaa

SEQ ID NO: 50321 - DNA, 425 bp, Zea mays
  unsure at all n locations
  Clone ID: LIB3067-019-Q1-K1-G8
cccacgcgtccgcacacagtacgtacaagcctctcatcagcaatggagtccaccaagctctccgcgctgctggtgctcgccatgctcgcgctctcctcgtccccgctcgctctcgcgtgggagaaggcggaaccggagtgccactcgtgcgagtccggctcgccaccctcgaccggcggcgtccccctgcctcccgtcagcataccgtcagtcccgctgccccctgtcagcataccgtcggtccccctgccccctgtcagcataccgtcagtgcccctgccgccggtgaccctccctcccattccgatcgttgggggaagcccgagcccgacgaagaagggacaccggaaggcgtgcccaccgtctncgtctnccccgacgcccacgcccacgcccacgccgtccttggacaagtgccccattga

SEQ ID NO: 50322 - DNA, 359 bp, Zea mays
  Clone ID: LIB3067-019-Q1-K1-H11
aaccctgctccaccaacccaatccagctacatccgtctgggtgaactccagggccaggagcagttcgccgtcttcgttcgcatcacctacgcggttcaatccaactggcaggaaggaacgtgatggccaagacgagctcgttcaagctggagcacccccttgagaagaggcagtctgaggctaatcggatcagagagaagtaccctgacagaattccagtgattgttgagaaagctgagaggagtgacattcctgacatcgactagaagaagtacctggtccctgctgatcttacggatggacaattcgtgtatgttgctaggaagagaatcaagctcagtgctgagaaagctatcttc

SEQ ID NO: 50323 - DNA, 88 bp, Zea mays
  Clone ID: LIB3067-019-Q1-K1-H12
cgatcggagtcgggaggatgatgcctttttcgacgggggcaccaccgaaaccgactcggacgagtcctcttcgcgtggggtgggggcc

SEQ ID NO: 50324 - DNA, 395 bp, Zea mays
  Clone ID: LIB3067-019-Q1-K1-H2
gggcaaaccaaggagcttcacagcctaggccagagcaagaaagcatcctgctgcaggcacagcagcaggtgcaaatgcagaaactcgtataccaagtcggaggtgccttgccgacaaaagttgtctgcctgacacaggtagtgacagcagatgaactgagagacgatgaggaatacaatgacattgtggaggacatgagggaagaaggacgcaaatatggtaacttggtgaaagttgtaattccacgacctgaccccagcgatgccccagttgctggtgttggaaaggtgtttttggaatatgcagatgtcgaaggctcgaccaaagcaaagacggtgatgcatgggcggaaatttggcgggaaccaggtggtggccgtgttctatcccgaggac

SEQ ID NO: 50325 - DNA, 408 bp, Zea mays
  unsure at all n locations
  Clone ID: LIB3067-019-Q1-K1-F8
gttcttgatgaagctgatgaaatgctttctcgtggtttcaaggatcagatttacgacatcttccagcttctcccatccaagattcaggttggagtcttctctgctaccatgccccctgaggcccttgagattacccgcaagttcatgaacaagccagtgagaatcctcgtgaagagagatgagctgacccttgagggtatcaagcagttctatgtgaatgtggataaggaagactggaagctggacacactgtgtgacctgtacgagacccttgccatcacccagagtgtcatctntgtcaacacccggcgcaaggtggactggctcactgacaagatgaggagcaaggaccacacttgttcttgcactcatggtgacattgaccataacactagagacatcatcatg

SEQ ID NO: 50326 - DNA, 424 bp, Zea mays
  Clone ID: LIB3067-019-Q1-K1-H3
gcgctgccacgccacggtcgacgcttgagacgctccccgccgtctgccaggccgtcaccgcgcgtgacttcgcctcatcctctccggagatggacttccaggtcgtcgtgctcgccggaggcacctgcgagaaactctcgcccctcgtttccaaggacgttcccaaggcgttgctcccggtcgccaatcgccccgtactctcttacgcgctggacctccttgaggccagcgacctcaaggacctcatcgtggtggttgaggggcacgaggcagcgcagcttgtcgacgcttgggtatccagtgcgtacctggatcggcttcgagtggaggtagttgtggtttctgaagaccttggaagtgctggtgcattacgagctatttcaaagcgactgatggcaaacgatattttggtagttagcggtga

SEQ ID NO: 50327 - DNA, 373 bp, Zea mays
  Clone ID: LIB3067-019-Q1-K1-D9
cccacgcgtccgcccacgcgtccgcccacgcgtccgcccactcgttcgcccacgcgtccggtaacagtgatggtagtgagagcagcgatgatgacaagaggacatagactctactcaacagcaatcttttttcggttcagttgttatgatctttacatatagttagctacattgatagcggaatgtggggtcattttttctgtctggcccattttgtgtacatcctttttgacaacaaacaggtaaaagtgacaacgtttgcaaatcgacaaacaatggtgagttattcaatctaaaaaataaaaaagaagcagaaaaatcacccaacatgtttacagatagcaagggagcaccaaagaaaatatgtaacacc

SEQ ID NO: 50328 - DNA, 375 bp, Zea mays
  unsure at all n locations
  Clone ID: LIB3067-019-Q1-K1-E10
tgccgtcttcggtgttctgagacctatccggtacttgagagctggaaaggatatggttgagaacactgaaattggcgattggtaccgacgcatggaagacgcagttggagaaccatcaagaatacaggatgcacaagcaaactagaattttgacaacattcttttaaatatntctatgaggtatctcgtgccctatgcatggaggctattcaaattttttgccagaatcaagtgtatgcaataatgctctgccagattattaagcataataggctaatagcacctgaggaacagtgttttttgacttgggaacttggttgtgttactgcgtaaggttttgctcccctaaaaaaaaaatgtattcattttgatgat

SEQ ID NO: 50329 - DNA, 349 bp, Zea mays
  Clone ID: LIB3067-019-Q1-K1-E11
gcgacgcgtgagccgacgcctgagccgtgtcgtgcgcttcatcaatctaatccaactccaaatagtccggcggtactaacgatctaagcctacgcacaatactattcgatgtcatgtcctcgaatcctggctttatgtccagtgacgaaagcatgatccggtatttcggcccgttcaagccaccgagctacaaccagtagatatgaaaaatcctctaggagctagagctatacaagatggacctgcactcgtacgacgacaaatcagatcggtacagcatcagctccggtgcgtcgtgggagcacgaaacgccgtcgtccaacgcatggctaatgatgacgatttgcct

SEQ ID NO: 50330 - DNA, 435 bp, Zea mays
  Clone ID: LIB3067-019-Q1-K1-E12
ggtgctctctgaatgaagaatcgcagctgatcaaacatggactagtatccaagcagttaatttcatgccttgctgcttcgcttgtgttcgtctctccacctagtcaggctattcctgcagaaacctttgcccgtccaggcttgtgccagattgcaacagtggcagccattgacagtgcttcaggctcctctgaagtttgacaacccttcagatgatgtcagcacagggatgatgatgaggggtatgaccgtcaaaaacttcgatccagttcgctactctggtacatggtctgaggtagcctcgttgaaacgtgcatttgctggtcagggactagaagactgtcactgtactcagggagtgtattcttttgatgagaaggcacgctcaatccaggtggatacattctgtgtacacggtggacctgatggatacatc

SEQ ID NO: 50331 - DNA, 256 bp, Zea mays
  Clone ID: LIB3067-019-Q1-K1-E5
taaaaaacataaaaaaaaaaaaaaaataaaaaaaaaaaaaaaaaaaaaaaaaaaaatgggaagggaaaaaaaaaaaaaaaaattaatacaaacggcctgcctccctcatagttccaaccattccgggactcctgcatgctacttccaacctttcctttggcttcacccaattcaatttccctgcccttcttttccctaattctaaactgctttaacccctttcttccccaatcttatttgcttaacccttcatttc

SEQ ID NO: 50332 - DNA, 286 bp, Zea mays
  Clone ID: LIB3067-019-Q1-K1-E6
gttcatcttcctcctcatagtgctctatgcgatccctgccagcgcagcagtcttgctactgtacatccttatcacggtgctgttcgcgctcccctcgttcctgatactgtatttcgcgtatccgagcctggactggcttgttagggaaatctttgcctgagatttccttgttcggtaaaatctcaatgctgttgttgagtccttgtataactgaaccttccctagatcttgttgcaagcgtggatgctattgcaaagttttggtttttacaccatgagatgtgttt

SEQ ID NO: 50333 - DNA, 394 bp, Zea mays
  Clone ID: LIB3067-019-Q1-K1-E7
cccacgcgtccgcaaagctcttcaatctattcacccagtttaacaatgtgttgactgattttgatagagacatgtggtcctatatatcattaggctacttcaagcagataccaaaggctggtgaagttggttcttccactatgcctcataaaatcaaccccattgattttgaaaatagtgatggcaatttatgtcaggcgaattctatattgtctggtataagcatgaaactaccaatatcccggttgcagcgtgacctaacagactcgactgttttgagaaacctgggtatgggattaggtcattctctattggcttacaaagctaccatgcgtggaatcagcaaggttcaagtgaatgaatcacgtttagctgaagacctggagcaaacttg

SEQ ID NO: 50334 - DNA, 388 bp, Zea mays
  Clone ID: LIB3067-019-Q1-K1-E9
agagaatcaagggttcttgagtttcagcatgcgttggaaccacttgcgtacagaaagatggactttgaagaattctgtgctgcagcaatcagcccgtaccagctggaagctttggaaaggtgggaagaaattgctggaacagcttttcagcacttcgaacaagagggcaaccgagttatatcagttgaggagttagcacaggaactaaatctcgcgccgacacattactccattgtgcaagactggatcagaaaatcggacggcaagcttaactttcttgggttcaccaaatttttgcacggtgtcacgatacggggttcaaatacaagacgacactaaacagatgcaaactgtattcgcttctaatttgaaaccctctcatcgatta

SEQ ID NO: 50335 - DNA, 415 bp, Zea mays
  Clone ID: LIB3067-019-Q1-K1-F1
cagggatctcgctcttgcaagggtggaaacagagaagaggaactctttgatcaaagcttgggaagagaatgagaagacaaaagctgagaacaaggctgctaagaaagtatccgctattctttcatgggaaaacacatagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcttaagaagccttccaagtcagaccgagcagaaagtgaaaaacg

SEQ ID NO: 50336 - DNA, 385 bp, Zea mays
  Clone ID: LIB3067-019-Q1-K1-F12
acgacatactaagacgcatacggataaacatataaatcacaatcaaaaaaaaatcacaaatgcaagaggtaaaagggccatgtcacattcgggggccagcacttcaatatcgagaattccgcacgtttagttccgctgttatgcccgctgactcgacttggccacaaacaaccactgtctccagatctccttaatcacctaccgcgaaatccctgatttcactatcatatcactatcggtatacccataggtccttatggcagcaggttgcgtcaccttaatcagccccatgacgcaaatgcccatgcccaatttggcattatcacaatggtgctggacggccgcaatattagcgtcatgctgaacatgcttgccaacgatcacg

SEQ ID NO: 50337 - DNA, 373 bp, Zea mays
  Clone ID: LIB3067-019-Q1-K1-F3
gatcccacaccgaggaaaggagaagagagggtcggaataatggcggccgacgagggtgccgtgatcgcgtgccacaccaaggacgagttcgacgcccgcatggccaaggccaaggagcagggcaagctggtggtcatcgacttcatggccccctggtgcagtgggtgccagatgatggccccggtgtacgcggactgcgccagcaagtacccttccgcggtcttcctcgaagtcgacgtcgacgaactgctggaagtcgcgaagatctacggcgtccatgtgatgccgaccttctgcttcatcaggaacggcgagacgctcgagagctttgctaccgtcgacgaggacgagctccgggacgccgtcaggaagt

SEQ ID NO: 50338 - DNA, 402 bp, Zea mays
  Clone ID: LIB3067-019-Q1-K1-F4
gagagagaggaggcagcccatagcagtttcctttggacatttctgggcgggtgctctgtggtgctgcgatctgctgcgcaacgacgactaccctttatgatccgctgtgctttacgccttttccctactcgatctcttctccctacttcccaatgcaagcaaacagtcgtgtgtctgcagctttactttcttggtcattcttttcttgctgctacttttacagatgtataggaccgtcaagagcactgataagccgtctgcagcaacctcatcaggagggggagggccaactgttgacggtggtggcgggtccggcgactactaccacccgagcgattggccgctggctccattctcatcagctggtcaggacgtcagcccgcacgcgttcactggacaccg

SEQ ID NO: 50339 - DNA, 463 bp, Zea mays
  Clone ID: LIB3067-019-Q1-K1-F6
aaaatggaagacagagtgtcaaaggttgtggaagtcttcgttggaagaatccggaagatggaaaatgactttataagtttgaacaagagggcctcgatgctagatgtgcaactggagtgccaagatctggagagaatttctattgtaaatcgtctgggaagatttcatggccggagccatgcatcggcagttgagagttcatcagctccagaaatgactcctcggagaatttttcctgaaagacatgtcatgtcttttgccgtgcctggaaatcttcctgaaggagtgtgctgtttgtcactctagtggaatgatcttcagttattttctagccgcaatgatgatcccgggtcgcgccctgtgattcccagtgctccttgtcccatgcaaagcatggccaaacagaaagatcatattgtcaaggggtaacttgagaactgggagcatacagttccacgatgag

SEQ ID NO: 50340 - DNA, 433 bp, Zea mays
  Clone ID: LIB3067-019-Q1-K1-D8
gaaagagttcacctgttacaagatccttaaggatctcaatcacgtattctgctgcaatggtactgcagtttaggacccacagctaggccaggtcattcagctccaaggcgatcagctcaagaatgtcgctactttcctagttcatactgggatcgcgaataaagagaacatcaagattcacggctctctaagggacctgtaaatgcatgtgccctatattgtgtgccttcacatattgtgtagcttgaagcatcgacacgttactagtcattgcttacttatataagaacataagtcgtatttgctattgtcaagtgtgccttgcttgatgcaagttgcgttttcgtatcattattattatgcacggtcatcgtacgtgtatggctcgtatgggttaatgccaacttaataaaagcacactcctgttggccta

SEQ ID NO: 50341 - DNA, 452 bp, Zea mays
  Clone ID: LIB3067-019-Q1-K1-F7
cccacgcgtccgatctcctgatagagactaggaaacaagaagcagacgaatcacttgaagaggaaacgggacggatgacaagcgtggtgcgtcggtggctgggtagaggagcggctaacgccgactgtatgaggctgtccgcgggtggggagctggccgcgtcggtgattggggagctggccacgccggctggggtggatggaggcgcgccagtgactgcccagcagggatcgccgtgcggctcggccgctcgggatcatcagcgtttggggagggaggcagctggcatgtggaggaggctgcgcgatggaagattcgttgcctcgttggtgatcgcgaataggttcgctcaaccgaggcctcatatttacgtcctctacgttggagtcctatgttgatttggatcaaacttataaaataacagctttttttgaatgatccataagcaagtg

SEQ ID NO: 50342 - DNA, 401 bp, Zea mays
  Clone ID: LIB3067-019-Q1-K1-C3
cggacgcgtgggcgaggtcgggcaaccttccccaggttggaagggacacgagcggatccgagcgaagcgaccgcgcgtccgcgccctccgtcgccaccaccatccgctccgccgtcactccatcgtcgtccacattgctgccatccgctctgccgctgctccatcgtcgtccttccccgaagcagtcgtgagcgagacgtgaggcgacggtgccctgcaccactgccaccgtctcggatttgtcgtccttcaccggcatctgtgcctcagtttgctgtcctgcactaccgtcttccgcggcactatagtggaggcaacacatgaaaccaacatggagaagaaaaatgaaatggcattccacataaagcttgtgaaaaagagttaaactcgtaatttattct

SEQ ID NO: 50343 - DNA, 382 bp, Zea mays
  Clone ID: LIB3067-019-Q1-K1-C4
tcgaacgatggcgtccccaagctacttctcgacataagatgtggttctggacttagtggtgagacattgacggagcatggccaccactggattggctacgatatttcaaagtctatgctcgatgttgccttggagcgtgaaacggaaggagacctcctacttgcatatatggggcagggcttgggcttgcggccaggaattattgatggtgcaattagtatttcatcaattcagtggttatgcaatgctgacaagtcttctcatgaaccaagattgctgttaaaggctatcttcggctcattatatatatgcctagcacggggagcaagagctgttctacagttttatgctgataatgtgacgcagagtgaaatgattgtga

SEQ ID NO: 50344 - DNA, 348 bp, Zea mays
  Clone ID: LIB3067-019-Q1-K1-C6
catttcacggtggagttccccgactcgctggcaccagagcagtgcaaggctctcgagacagtacttccaccaaggccttcatccaagctgacagacatggagatagatgaatgcgaggagacgactatgcatgatgtgaacaacatcgaggaagagatgcgcaggaagcaagctcacgctgcccaggaggcgtacgaggaggacgacgagatgccgggcggagcccagagagtgcagtgcgcgcaacagtaagcagactatcatcaaggcaattgggaggggtggtgcccttaaagcatgggagtgatctctggttttgctgtcgccgagctgggaaataggaagctg

SEQ ID NO: 50345 - DNA, 420 bp, Zea mays
  unsure at all n locations
  Clone ID: LIB3067-019-Q1-K1-C7
cccacgcgtccgcccacgcgtccgtccacgcgtccgcccacgcgtccgtccacgcgttcggccacgcgtccgcccacgcgttcgatgcaacggagacagcataccattttttttttaaaaaaatcttctcaggcaaggtgcagcatttgcaacggagatgttgatgaggcctccttatttcctaacctcgctctaagagcggtagctaccgtggtgaagatggaagacgataggaggctctttcacaatgcggcccttcgaaagcgcatgaaagaagtgactgagcatatggatgcccaaaggcgaaatggaagtagcaaggacagtattgagctggggctagaagctgaaagccctagagcgttcaaaggggtgcagtacccgtttgtggtgggtgagagagtnctgatcatgggaaac

SEQ ID NO: 50346 - DNA, 433 bp, Zea mays
  Clone ID: LIB3067-019-Q1-K1-C9
cccacgcgtccgcggacgcgtgggccggcgtggccgacggcggcgtccatggacccatggcgccgccggagcagctggcgatcaagcccgacatggccatttccgtggaggcgtaggttggttaacatgtaatagcagagtgagtcgatatcgatcagtagtagatttgtcgagtcaaggaaggggcctgctgctgctgctacgcgacagcagcggccagatgtactgcctgcctgcatgcatgcatgcagtccctcccgttgactcgacccgtagagatgggatgggaatggaagtagccgggtccttgggcgagtagcggcgccttggcacccacgggccagccgtactggcctgtgtgatgaaccggcgagagagagatgagataatgtgcgagcgagagagggttgggttgggttgtggtagttgaaga

SEQ ID NO: 50347 - DNA, 344 bp, Zea mays
  Clone ID: LIB3067-019-Q1-K1-D1
ctttaaataaacttggggttgcagctgacatttttaaccattggtttgctatgctacaacaagttaaaaaaagtggagcacgggttaatttcaagagggagcatgataagaaagtttgctgcttgggcctgacctctcttatcgtgcttccagctgataagattccagcagaagctttggatcggatcttcaaagcatcacttgagcttcttgttgcttacaaggaccaagttgcagaagctaagaaagaaaatgaagaggctgctgatgatatggatggttttgatgctgatgaagaagatgatgatgaaattgactccgataaggagatgggtgttgatgat

SEQ ID NO: 50348 - DNA, 444 bp, Zea mays
  Clone ID: LIB3067-019-Q1-K1-D10
acgcataggctgagctttgttgagatggttgttccttatggagatccaagtgaaccacattatcgcaagaatgcatttgatgctggagaagatggacttggaaaaaatgctcattctcttaagaagggatgcgattgcttgggctacataaaatattttgatgcacatttcacaaacttcactggtggtgtggagacaattgagaactgtgtttgtttgcatgaggaggatcatgggatcctttggaaacatcaagactggagaactggtttagcagaagtaaggcggtcaaggaagctcactgtttcatttatctgtacagttgcaaactatgagtatggtttttactggcacttctatcaagatgggaaaatagaggcagaagtaaagcttactggaattctcagcttaagggctttgatgcctggggaatccaggaaatat

SEQ ID NO: 50349 - DNA, 355 bp, Zea mays
  Clone ID: LIB3067-019-Q1-K1-D11
gccacgcgtccgtcgtacgctcccggcatggtcccctattccccggctcgcgggtcgacgcccacgcggcttcgattgatcttatttcagtgctggtggcatgcggaccgatcgtgtccttgctaggccggccacatcaggcatggacgactgagacctggacttctgcaacccggtcacgtacctgtgccctggactcgtcactgaccctgccagcagctgctacatggacagatacttcaacgagatcctcaaagacactgagcagcacgcactgctagcacacgcacagctggcatcctgcgttgcacgagctatcgcacacactcacctgcgtccacgtggacaccaagat

SEQ ID NO: 50350 - DNA, 346 bp, Zea mays
  Clone ID: LIB3067-019-Q1-K1-D12
cccacgcgtccgcccacgcgtccgcccacgcgtccgcggactcgtgggttttttctttttcgttttcgtttgattgctttttatgctgtttatgttttttttggtggtaaatatattttcattcaaatgggaaatagtgagttccagtcgtgacaggccaaaattggatcccgtggcattcggccatagtatgataacctttaactcacgattattacgggtcctgaggaggatacaaaagggcttcggatgtacaatcagagcttgtgtgactggacagtttgcaacatggggtgaacaattcaccatattttatccaagttcaattccgagattatgggtcaaa

SEQ ID NO: 50351 - DNA, 407 bp, Zea mays
  Clone ID: LIB3067-019-Q1-K1-D2
ctgtaatctgtgaaatctggtttgcgatgtcctggattcttgatcagttcccaaagtggcttccaatcgagagagagacttacctggaccgtttgtcactaaggtttgacaaggaaggtcaaccctctcagcttgctccaatcgacttctttgtcagtacggttgatcccacaaaggaacctcccttggtcacagcgaacactgtcctttccatcctttccgtggattatccggttgagaaggtctcctgctatgtttctgatgatggtgctgcaatgcttacgtttgaagcattgtctgaaacatctgaatttgcaaagaaatgggttcctttcagcaaaaagtttaatatcgagcctcgtgctcctgagtggtactttcaacagaagatagactacctgaaagac

SEQ ID NO: 50352 - DNA, 426 bp, Zea mays
  Clone ID: LIB3067-019-Q1-K1-D3
ctgacgcgtgggtgtatcgtcaaatgccatgtatacacattcgacggagctcatgccttacatcgaagaaccgatgccatgaattcttccatctttccaactgagcaatcatcggaaaattcggcatgattttgtactttcaaagaaagagtttgccgattcttattgggaaacactagagtgttgttatttaacagctggtttggctgacccgtttagtgccttacctggcagttctgtccctgtagttcgtctcatctgctgtacatgattgatgcatatgattatcgcatacgttgaataaatgtacttagcgcctgaatggttgctccccaacttacataaggtagcttctgggcatgggcagtacggtgagaaacaaccaccttgatgcctaaatgaaggtcccatatttgtgtttaccat

SEQ ID NO: 50353 - DNA, 402 bp, Zea mays
  Clone ID: LIB3067-019-Q1-K1-D4
tcgcccacgcgtccgatcgaccgaccatgcactaggtcgcgcgcgtcctggacagactcgtctgtccagcaggcccgtccccgaagcaggcgcatgcgcatgcacaggcacaggcgtcggataagccgtccaccacggcgccgagctatgtcagcgagtacgtcggcctacgaggcggctgcagcggcagcgccctatactgcaccaactcgtcgagcgcgttcgacgccgagctcttcatgaagtttggcgaggtgatctcgcggagcacggaatagtccaatagatcgacgatcattgtgtgttacagtttacaataggtgtctggccggcgccctgtgatgtgactcgctgcaaatatgctgctgccttatcgttgggactccactaggcactagtagc

SEQ ID NO: 50354 - DNA, 413 bp, Zea mays
  Clone ID: LIB3067-019-Q1-K1-D5
cggactcgtgggcggactcgtgggcggacgcgtgggcggacgcgtggggtcgaatctctgccagttgaaccgttggagcctagtgatttgaagccagagaacagtagatatgatgcacaaattagtgtctttggggctaagcttcaaaagaaactggagcagtcaaaaatcttcatggttggttctggggctcttggatgtgaattcttgaagaaccttgcgttaatgggtatttcttgcagtcaaaatgggaagctgactgtgacagatgatgatgttatagagaaaagcaatctcagtcgccagtttctctttcgtgactggaacatcggacagcccaagtccacagttgctgcaactgctgctatggcaattaatcctaaagctcatgtggagggccctcagaatagagc

SEQ ID NO: 50355 - DNA, 469 bp, Zea mays
  Clone ID: LIB3067-019-Q1-K1-D6
ccctaattacaatcttcctcaacgccgccgctcccagacaccgagcccgactgcccgaccccgatccggcgatccgtctccttcctttccttcgttctgccggccccgatcactcgtcaaccatggcggcggcagcaggcggaggagcggtgcgtgctctgtcccagaaggagcaggacatacagatgatgctcgccgccgacgtccaccttggcaccaagaactgcgatttccagacggagcgctatgtctttaagcgccgttccgacggcatctacatcatcaatcttggcaagacatgggataaactccagcttgcagcgagggttatcgttgccatcgagaacccgcaggacatcatcgtccagtctgcccgtccatatggccagcgtgctgtcctcaagttcgctcagtacactggcgcccatgccatcgctgggaggcacacccctggtacattcactaatca

SEQ ID NO: 50356 - DNA, 449 bp, Zea mays
  Clone ID: LIB3067-019-Q1-K1-D7
aggataacctgcagtcgcccccaaatttccccgaaccaaatcactcccaccgtctccacagcaaccagcacacatttccctttggcggatcgaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtacgcgaattccatatgcaggacgaggatgcaagccggccatacaggaagttcctgtaagcggcgtccagggccgcatgagacgtcgatccctctaccggagctgcgaggaggggagtttccattcagtttgtgtcggtattgttatagtctgaatctgattgagcattttggaatgcttaac

SEQ ID NO: 50357 - DNA, 392 bp, Zea mays
  Clone ID: LIB3067-019-Q1-K1-C2
actagttctagatcgcgatctagaactagtataagaaagatttgtggatgttgacccaacaggaaattgctactgaggtgcaaagtgaatccaagtgaaagtaattaggggagttagctatgtcaaatggaaagagagtggttgctaaaggataggaagctgaagctggatgaaggaagcaactacatgcaaccgatggcaataatgcattgcaaggttgaggctcgttagaaatgtcaagttggtcccggacgtgggtatggtgcccgcaaggccgacagagctgagatcaagcactgagatcgtgccctcgtgcctacggctgcatgtcacacctggccagaggcatatgctaccactactgttctaagaggacaacctgctcgatagct

SEQ ID NO: 50358 - DNA, 213 bp, Zea mays
  Clone ID: LIB3067-037-Q1-K1-F4
tcgcggacgcgtgggcgtgtgctcgcattaccttccattccatcccgcctccaaacccgaactccagttcgccccgcatcgagggcgcccaaagccgagaagaagcccgcggcgaagaagccggcggaggaggagcccgctgccgagaaggcgcctgccgggaagaagcccaaggcggacaaccctgtcccagcaagcttgtcctatctgcaa

SEQ ID NO: 50359 - DNA, 458 bp, Zea mays
  Clone ID: LIB3067-037-Q1-K1-F5
cccacgcgtccggcttatgaaaagagccaacatgcttgtgtagttgcgtgtttctgcaggctgagggtaggatattttgtactgttccataagaaatttacacccaccagtttgatggaaacaaaagctattggcttacaggatcatgcttcggtttatttggcctgcaactttttatattgtgcactttttaatagcagacaacacatattatgatggcaccacagtataggggcagtgcagcatttaagtttttactcctcgtaatattacttattgtgattctgagctatattagggtgaaacaatttcataaattcatgaattataacttataagggaatagaaactggaatgtttctttgtgatgtcctaccttcctcacctgcatatctgtatccttgcacgatagctataatttaacagagaatgcaatagttttaaccatgtatagaaac

SEQ ID NO: 50360 - DNA, 458 bp, Zea mays
  unsure at all n locations
  Clone ID: LIB3067-037-Q1-K1-F6
cggacgcgtgggcagcaatagagaagggttttaaggaagcttgcaattcaggctcgttgagggggtcatcctgttgaaaatttaagaattgtattgactgatggggcttcacatcaggtggattccagtgaacttgcttttaagctagctgctatctatgcttttcgacagtgctacacttctgccaaacctgtaatattagaacctgtgatgaaggtggaactcaaatttccaactgagtttcagggcacagtaactggtgatatgaacaagagaaaagggatcattgttggaaatgagcaggaaggtgacgacaccattgtagtttgccatgttccgctaaacaatatgtttggatatgcaacagctattcgatcagcgactcangggaaaggtgaatttacgatggagtacctggagcataatgttgtatcgcaggatgtgcagatgcaactagt

SEQ ID NO: 50361 - DNA, 448 bp, Zea mays
  Clone ID: LIB3067-037-Q1-K1-F7
ctagttgctggtggtggtggcatcaagtctgtgaaagtgacctatgcatctgcacgggcccgggatgatcttgacacgagacttctccgtgcaatgatcaccaagggattgattgagccaatctccagcgtttttgtcaatcttgttaatgctgacttcaccgcaaagcagaggggagttcgcatcactgaggagaggatcatcttggacggctcacctgagacgcctatcgactacattcaagttcagattgccaatgtcaagtccaaatttcctagtgcgatatctgagactggagagatcacagtggaggggagagtgaaggatggcgttcctcatctaacaaaggttggagcattccaagtggatgtgagcttggaaggaagcctgatcctttgcaggcaagttgatcagccaggtatgattgggtcggtaggaagtggcttgg

SEQ ID NO: 50362 - DNA, 361 bp, Zea mays
  Clone ID: LIB3067-037-Q1-K1-F8
cccacgcgtccgcccacgcgtccggagatccttagcagccgcagtcccacctacccgcggcggctgtctccctccatctgtctcgcctattcctattgtttctctcttcaataatcaagatgagccgtggtggtagtgcctgttgtggtcaaagttctctgggttatctttctggaagcgctgagccttcataaccagcattggcaccagctgcaagcgcttcacttgctgataaaccatctcatgcatatactgattctgccaatcatattgctgcttatgttaccattcatacctataactactacaggggttattttatataacactgcctacttctttacagactgttctttatcct

SEQ ID NO: 50363 - DNA, 61 bp, Zea mays
  Clone ID: LIB3067-037-Q1-K1-F9
tgaattggagtgcaagcaactcgtttagccctatcccattcccgcgcctagccaagagatc

SEQ ID NO: 50364 - DNA, 432 bp, Zea mays
  Clone ID: LIB3067-037-Q1-K1-G1
cggacgcgtgggcggacgcgtgggcggacgcgtgggtgggaagctcagtggtattcagctctgctatgctggtggatttggttaccatgcctatgggaaagctgggtggtcaagaagagcgagggtactgtctgtgcaacttgagaaaacagacagcggtgaatggcgaggagtcaagtccatcaagacatggaagaggcttgatgataaacatctgagcacaattgactctgaggttctctggaacagaggctctaatgggaggcgcgggaaaaatcctgatggtagttaacttttgatgcagacaggaatggtgcttcctaagggatcttttcattgggggggattggtggattgccagtttactatagaatcagaaatatgcccaagtgtgtacatgggggagaaagtcaaatacagacacatacacgc

SEQ ID NO: 50365 - DNA, 134 bp, Zea mays
  Clone ID: LIB3067-037-Q1-K1-G11
gtgcttcttgtacctactggtgtctgtcttggtgttgggatcagagcgcacctaattgtccgtttttgtaccagctgttgtatgcgaatccatctgtgccttcatcacctaatgcactcgctgttgctgctggc

SEQ ID NO: 50366 - DNA, 446 bp, Zea mays
  Clone ID: LIB3067-037-Q1-K1-G12
cccacgcgtccgcggacgcgtgggctggtggctcgaaccgtgctattttcttgctggcgccgatccttctgcttctgaaccaggattcagatatcttcgcagggtttggtgataggcagcgctatttcccagtaacagtttctatttctggctatttattgttgacagcgttgtataggatatgggaggagacttggcctggcaatggaggatgggctcttgatatcgggggcccgggctggctgtttgctgtgaagaactttgctcttcttgtgctcactttgccgaatcacatactcttcaaccgcttcatgtgggattatgtcagacagacagatgccaagctactgctgacgctacctctcaacttgccttcgattataatgacagacatacttactattcgggtgttaggattgctaggagctatgtactctcttgcccag

SEQ ID NO: 50367 - DNA, 453 bp, Zea mays
  Clone ID: LIB3067-037-Q1-K1-G2
ggtgaggctgtcaagtacaagagctcattggacgcattccagcagatccttaagaaggaaggccgcaagtccctgttcaagggtgctggtgctaacattcttcgtgccattgctggcgctggtgtgctttctggctacgaccagcttcagatcctctttttcggaaagaagtactgctcctgcggtgcttaaatggagaaaaatgatgacgaacaagagcagttcgcttccggttcaacccagtcaggatcttggtaaagtttttgcctttcatatcgaagaaattaataatttatgtaggagaattttttcaacattcgtttttggcggagacattgatcttaaaaaaactcgtaactgtcctactaggtggtggcattggttcccaaaacatggtcatagggtgtgtctaatctgcccttctgtgcaaccgggcaatttttcttacatata

SEQ ID NO: 50368 - DNA, 347 bp, Zea mays
  Clone ID: LIB3067-037-Q1-K1-G3
cccacgcgtccgcttcgctctgcgtggcctggggtttctcgtgctgtggatgctgcattgcggaagcgagctcgccgcggcggtgcctccagaggccagccggagccggcgctgtacaacggaggcattctcaagttcggcagcagcagcagcggctgcggcgatccggacgggtaccgcacgacggagaccggcgtcttctccccggcgttcgtggtgtacaacctcaacaagaccaccatgtacaccttctcatgctgggtgaagctggaaggccacgctcttcatgaacgagtacaacgtcatcgagacctgcgacgacccctttttcaccgtcgacacgtacg

SEQ ID NO: 50369 - DNA, 354 bp, Zea mays
  Clone ID: LIB3067-037-Q1-K1-G4
gcaacgggtcgcgaatctagagtcgtaactgctcttacactgctgaagtcacatctctttaggtgtcaaggccatgtcagtgctgcccttgttcttggtggagtggattgtactggaccacatcttcacactgtttatccacacggctccactgatactcttccttttgccacgatgggttctggatcccttgctgcaatgtcagtgtttgaatcgaagtataaagaatgcctcactagggaagagggaatacaactggtgtcagaagcaatatgtgcaggtatcttcaatgacttgggtagtggaagcaatgtggatgtctgcgtgataaccaatgggaagacagaatacttg

SEQ ID NO: 50370 - DNA, 458 bp, Zea mays
  Clone ID: LIB3067-037-Q1-K1-G6
cccacgcgtccgcgactactactacatctatcactccagcagcatcccaagcacctaggctgccatcagaaattgttggcaaaaatgttgaggagattattagggactggaacaatgagcttcaagaccgtactgcaaaattcaggaaacatgccaccgcgatagctgaatgggataagagaattctgcaaaacagaaatgttcttattaggcttgaggctgaggtggctaaagttgttgaaacacaaacaggcttggagcgtcaacttgaattgatagaaactcatcagcgagaggtagacaaggctctacagagtatggaagaggaagctgaacgcgtattccaggatgaacgagtgttacttcatgaagatggagctgcttcagcaagagatactatgtatgaacaagcagaagttgtcgagcattaactgcaacatatgacagaacaagtaaaa

SEQ ID NO: 50371 - DNA, 362 bp, Zea mays
  Clone ID: LIB3067-037-Q1-K1-G7
atcgaactggataaatgtcagaaaagggacctgctgcatatgctgtgagactccgattgacgcccttctgtacagatgtgggcacatgtgcacttgctcgaaatgcgcaaacgaattggttcgaggtggagggaaatgcccgttgtgccgcgcacccataatcgaggtcatccgagcatacttcatcatgtagatacaaaaggaagacagcaagaagatagaagaggcccaaattgtttttggtctgtgtggagtcgttagcgggttgtgtattcaattatgttcattctctctaatgcgtttggttaaggttttttccggcttcattacgttttggtctgcttgccctattgtaagtaatg

SEQ ID NO: 50372 - DNA, 445 bp, Zea mays
  Clone ID: LIB3067-037-Q1-K1-G9
gcagccgtggtgatcggtcttatcaccagtggtgtggttagatgccaaatgcagggtgctcggcacgaggattttgctttctggtgtctgtcccgttggaaccggggatttcctgagtgacgaatagacttcccatggcagctattctgttgaggatgtgcgaaaggtgcactgcagagtctgagaagtgagagaaataaatgacaagtgatgtttaccgctcacccaattttaaccaatgccacagtgatacgattatctctgctaaagggataattgtttcaactaaaccaagcaccacagttggaggtcaaatccttggaaggcaatattgtgaagttattgtaacttgtgtgctaaaacgagattcaattttgcctcgccctgtagtgatgtctctgtggtgcttttgtgactgatcatctctggaagcttttgtgaatga

SEQ ID NO: 50373 - DNA, 439 bp, Zea mays
  Clone ID: LIB3067-037-Q1-K1-H1
gagcgcttggtgcaggtgctccgacgaggtgaatccgcggaagcagccgtacaagttctccgaccggaagctccgggacctggggctgcagttccggccggtcagccagtcgctttacgacacggtgaagaacctccaggagaagggacacctgccggtgctcggagagcggacgacgacggaggccgccgacaaggatgcccccgcggccgagatgcagcagggagggatcgccatccgtgcctgagagggcgatgccacacatgaacacaaagcagtgttcatactgctgccctgcacctgcacctgcttcttcccctgctgtgtaaacaggcctgtgtttgttctggctgatagtgatgtacccttagaactggaccggtatggtccgtcctgggaaccatagcgaggtgattaaactgggtaatgttggatgttc

SEQ ID NO: 50374 - DNA, 397 bp, Zea mays
  Clone ID: LIB3067-037-Q1-K1-H10
cccacgcgtccgcccacgcgtccgcccacgcgtccgcccacgcgtccgcccacgggtccgggaaaatggtgaggatggtttaatttatgtaggaaacatggtaaatccggctaccctggaacaaatattcggtgtctcttctttggctgcattaccagcccagttggcgttggagcaatttgacaacgaactctcgaggaaggttaacgaagttgtaaatgaaataagacgccagaggtgctcatacttgaggttaagacaatgcagaaggggtgaaccatctggtgattttttccggtcatttttagtggaagacaaggcccctggcgtcttcttctacgtcgaagttctttggcatgttcacaggccaatcccaaggcagatgaccttgaggccc

SEQ ID NO: 50375 - DNA, 368 bp, Zea mays
  unsure at all n locations
  Clone ID: LIB3067-037-Q1-K1-F2
cccacgcgtccggttctagatcgcgagcgccgccctttttttttttttttaagaatatgaaggggcattttttttcaggcataaatataaatccgttctcttgccatggtatttagcacgcacaagcaacgcttgaataagtcttgcaaattcaacacaggttctacgaaagtggctttggctaatgaacgactgcaatgtcgagaaacgacactaagttctttcagcgctttccaccaccgtcgcccaacttggggcccttggaacccttctggaccgcaccctttgtctgcgtcttctgggacttgctcacctncgccttcttcgctttcttctcatccttggtcttcttgatgcgctccttgatc

SEQ ID NO: 50376 - DNA, 459 bp, Zea mays
  Clone ID: LIB3067-037-Q1-K1-D8
gatccagcccacatctactccctccgaccctcgtcgcctccgcgctctccagcgatgacttgccgcgcctccatacctcgcaccagctcttttctctggccacttctcgcttgaaccgcctccgccgccccgacctcgccgcctcgctcctcgacctcctccttgcctccgccccgccctccccggggctccttgcgcgggcgctctccctctacccgggacccgacgatgcgctccgggccttctcctcgtctgcccccgccacccgctcccctcctccgcaccttctccgcgctacccggatacagtggttctccaagaaaggcgagacagccaagggggaggagctgcttgatgtgatggaatcaaaggaggtagccccgaattaccttacctacaatgctatcatgcaggggtattgcaaggaggggaatgtcggcgcagcgatgcgtgtgttca

SEQ ID NO: 50377 - DNA, 214 bp, Zea mays
  Clone ID: LIB3067-037-Q1-K1-D9
tgaaaatctgtcctgcctgtgttagtccatctttgtctaaaaaaaaaaaaaaaaaaaaaaaaagaaaaaataaaaaaaaaaaaaaaaaaaaaaaaaaaaaaaaaaaaaacaaaaaaaataaaaaaaaaaagtcttacgatctaaactttccaacctaatttttttctttattgcaacacctaaactcaactaaaatgccacctaatttcaattt

SEQ ID NO: 50378 - DNA, 296 bp, Zea mays
  Clone ID: LIB3067-037-Q1-K1-E1
tcgaaaaaaaaaaaaaaaaaaaaaaaaaaaaaaatttaataaaaaaaaaaaaaaacaaacaataataggggggacacatttacatatcgagtgtatacaaattacaaaagggtcctttccttttaaatgacccatacttaattccccctaattttaaatcaatagcccttgtaaaacactccctttaccaataaaaagcccgttgtaccaaaatctattttctggaaaaacattaccatttcccaaattaattccttttcaaatattccccatttgaccagctttaataacaacta

SEQ ID NO: 50379 - DNA, 354 bp, Zea mays
  Clone ID: LIB3067-037-Q1-K1-E10
aaaagatgtcaatttagatgaacttccatatgatccggccgataggaggagaatcacagatgatcctgggcttaagctgcaagatcagattagaagaaggtacttggttaaaggtcctcacagaccacaacctagttttaagtatccacaaaaaaatcatagtgggcaagccacgtcgatttaacccagcatggtttgatgagtacagttggattgaatatagtgagaaggtggatagagctttttgtctttactgctacttgtttagagattgtattgaaggtcaggccggaaatgatgcttttgtaacaaaaggtttctcttcctggaacaagaaagatagattagatgttc

SEQ ID NO: 50380 - DNA, 393 bp, Zea mays
  Clone ID: LIB3067-037-Q1-K1-E11
cccacgcgtacgcggacgcgtgctctgacgcttgtggtaacatcatagaaaaatgagcatggggatcaattacttttcgatagcaataatgctatctacaaacctccaaaacttattcttttaataataccaatattctattcgtacgtatgccattgtacttccaatatctatatcttctctgtatctaatatagcatgaatcttaattccacttatgtactactccaacttctgtagtctgtaaccacatggatctgcaaggaatactacatgcagtgttaatcatgatcctccttcatttacaatgccaaccttcaataccgcttatgttgacttgatcctgaaacttactgaatatgatttgaagatctggccacatatttatgaatac

SEQ ID NO: 50381 - DNA, 453 bp, Zea mays
  Clone ID: LIB3067-037-Q1-K1-E2
ccgctgcttcgtcggcggcctcgcctgggccacggacgaccactccctccacaacgccttcggcgcctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggt

SEQ ID NO: 50382 - DNA, 194 bp, Zea mays
  Clone ID: LIB3067-037-Q1-K1-E3
cacatcctgttcgtgactcgtgatttcgccttcggaaagccgagggagagggagcgagatggggtgcgtcggcgacacgatggagtcaatccgctccatgcagatccgccaattgctcacgcagatcatcagcctcggtatgattgttacctctgcattaatcatatggaaggggttgatagttttcacaggtt

SEQ ID NO: 50383 - DNA, 426 bp, Zea mays
  Clone ID: LIB3067-037-Q1-K1-E5
cggacgcgtgggcggcatgcacgcctcctgctccgagatgcagagggaaatgatcagcgccgactcgataaagcaggagctgttcaagaacgctggctatggcggatgctgcttgtataggggcatgtcatcatgttatgggaggatgattattatgttgcttttttatattaatcttatattatctttttttgtcttagtttttattttcattgttattttctttttttatttaatgtattttatttttattattttttttttttatttttttttattttattttttcttattacttttctttatttctattatttattatttggttttttaattttattttttttttttatatttttcttttattttatcttaatttatttttttactttttattttttatattgtttttttctatattttttt

SEQ ID NO: 50384 - DNA, 438 bp, Zea mays
  unsure at all n locations
  Clone ID: LIB3067-037-Q1-K1-E7
gtgtgcgccaacttgctgaacgggctgatcaacgcgaccctggggacgccgcccaggacgcggtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgactatcacacgcccatcgatcgatcgatctggaggctaaataatttctccaagctgctagtatacgtacgtacgttgatatatatgatgtagtattatatatatgtccatgcatctngtncgctatcgcatgttgttgttgttgttggtggttttcgatgatcctgtctctggtataaatatcattattattacagtacgtgtgtgacctg

SEQ ID NO: 50385 - DNA, 420 bp, Zea mays
  Clone ID: LIB3067-037-Q1-K1-E9
cccacgcgtccgcccacgcgtccggtctctacagcctcagcacggacccggcctgcctcctcttctctctcacggcgacgactgggcgaccgaccaaccgtcgctgcgctacgccaggtgccaaggtcttcttcgggtccttcgccggcgaccagcagcaccaggcaattgcacttgtgtaagaaatggatgctactgccggttaattgcgatacagatttatatggacatagatattggggccatgtgtaagggcggaagctgttcctaccgcgtcaataaggggagtcctgctggttctaccaggaagatccgttccacagcctctcaaggtcggatggcatctgacacagctagggtaacgaatacagacgcatcaaagctgaataacctgatcttggcatcattcaaactcttgtc

SEQ ID NO: 50386 - DNA, 449 bp, Zea mays
  Clone ID: LIB3067-037-Q1-K1-F1
gcagaatgcgttagccatgtaccaattgcagttggagcagaacctgctcattttgacctcttgttggcaaggagcgcaatatctcaaggcacttatttgtcaaatgattggctagtgcttaaactacaggaactggtctcactttcataccagattagtactgggcaatttgaaggaatgcaaccaataggtgtgaagcttttgtgtttgataatggacaagttcggcaaggcagtagatccggaatttcctggccatatcttgctggaacaatttcaggcccaacttgtttctgctgttagaatggctataagcactgcttctggtccacttcttttggaggctggacttgaactcgcttcaagggttattaccagccacattattggtggggatagactagcttttagtcgcttggtttctctgataacacgcccgttaagtgacat

SEQ ID NO: 50387 - DNA, 445 bp, Zea mays
  Clone ID: LIB3067-037-Q1-K1-F10
gtgccattgagcttctgtcaggcaaggagggtatcatctcccagatggttgagaccacccctcagaaggtttacagcctgacgttcacactgggcacagcgggggactcgtgccaaccaccaatggccgtcatggcattcgcgggggatcaggcccagaacttccactactccccaatgggcaatgccaccagccaggctgcgaatgtgacgttcactgcacgcgctgagagaacacgtgtggcgttctatagcgtgtactacaacacgaggagtgacgaccacagctcgctgtgtggcccggtgattgacgatgtccgggtatgggcattgaacgccgcggctgggttgaaggcaagtattggactggttcttggcattgttggtgtcgttggcatggtgctgttctgaaatctgaatctctcggtgccagtggtcttgggaag

SEQ ID NO: 50388 - DNA, 444 bp, Zea mays
  Clone ID: LIB3067-037-Q1-K1-F11
aataaacgggcagaatctaattgatgttgtaattacgggaaacaatggaacaatcgatggcgagggttctacatggtggaactggtttcgttcgaataagttgaactatagccgccctcatcttgtggagtttgtggactctgagcaaatcgtcatttcgaacataacatttttaaattcccctgcttggagtatacatccagtgtattgcagcaatgtagtggtccatagtgtcacaattcagacttcattggatgctccacttaatcatggaatcgttccagattcttgctcaaatatgtgcatcgaggacagcagtatcagtgttagccacgacgccatatcactaaaaagcgggtgggacaagcaaggcattgctttcgggaggccaacctcagacatccacataagcagactggatctgcagtcctcactgggcgccgc

SEQ ID NO: 50389 - DNA, 413 bp, Zea mays
  Clone ID: LIB3067-037-Q1-K1-F12
cccacgcgtccgctggttcttgcggggattgcgctgttctcatctctgtgtgttgcttctgccggaataagaatgagacattgctatgtggagacttgatggtaaagggggagctgtctgaggaggacggggtgttttcttgcaatgaggtatgtggccgcacgctcgcctgtggcaaccatgcttgcaaggatatgtgccacccagggccttgtggggagtgtgagctcatgccgaggaaggtcagtacatgtcattgcggcaagaccaggctgcaggagaggagggcgagctgcttggacgcaatccccacctgcgataagatatgcgataagaaactgccatgtggggtgcacaagtgcaaggtcaattgcccatgaggaagatgcccaccttgtttggtgctcggtgag

SEQ ID NO: 50390 - DNA, 456 bp, Zea mays
  Clone ID: LIB3067-037-Q1-K1-D7
cccgaccttctggctgtcccgcttcttcgccgacatgtggatgctcttccccaaggaggaagagtacatcgagtggttcaagaaggctgggtttagggatgtcaagctgaagaggattggaccgaagtggtaccgcggtgtccgaaggcatggcctcatcatgggctgctccgtcacaggcgtcaagagagagcgcggtgactctcccttggagcttggtcccaaggcggaggatgtcagcaagccagtgaatccgatcaccttcctcttccgcttcctcgtaggaacgatatgtgctgcctactatgttctggtgcctatttacatgtggataaaggaccagatcgtgccaaaaggcatgccaatctgagtgaagggaatgagctgcatggaagagaggatagccaacgtctgaattttactcttctctatattagacgcttcctgcctgttttg

SEQ ID NO: 50391 - DNA, 443 bp, Zea mays
  Clone ID: LIB3067-037-Q1-K1-C12
gcaagcaggagaattgtaaatgtaatcattgaaactatactataacagtcatatgagaatctgtcagtcattatccatatgtgttttaatgcatatatgtataagaatataactaagttcatgattacttgtggcatcggtctttccgccatttttcctttatgtagccatccattttgccttcttgctccttggtttttcttgttgcattctggtttgaatacgtttaatatttttgtccacttctataatatagctttcaaacagcgctgaaggtggttctctactcaaagatattcctgctaccaaggatggaagggttgattggtcacaggatttcttctgcaaaccagcatttctgacagtgtctggacagcttaatggtgaaacatatgcttcagctctatctgatatttacacatttggtccaacgtttagggctg

SEQ ID NO: 50392 - DNA, 431 bp, Zea mays
  Clone ID: LIB3067-037-Q1-K1-C2
cccacgcgtccgcccacgcgtccgcccacgcgtccgcgacgcacgcagagccgcagagatccgtgacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatc

SEQ ID NO: 50393 - DNA, 449 bp, Zea mays
  unsure at all n locations
  Clone ID: LIB3067-037-Q1-K1-C3
aaaacggggaggctcccctccccaagatcagaccttcgatccgttgctcctccacggcgccggccgccagcgcctccgttcctcaacgcctgtttgtccttgcatggccggagccagacgtcgcaccttgcctccaccctcgcattccgatcacccgcttccagctcctctccgtctcgctgctcctcctccgctcgcagagctgagctgatcgatggaccacgagcagcggcgccagcggcagcagcacagtcccagaggcaatgctcctgggagcgggaggtgcggctcctcgtcgaggaagcacaagggcgggggcaagaaacccatcaaagtggtgtacatctccaaccccgtgcgcgtcaagactagcgccgctggtttccgcgccctcgtccaagagctcaccggccgcgacgctgacccctncaagtacagccccgaggacc

SEQ ID NO: 50394 - DNA, 307 bp, Zea mays
  Clone ID: LIB3067-037-Q1-K1-C5
cccacgcgtccgaaaaaaaaaaaaaaaaaaaaaaaaaaaaaaaaaaaaaaaaaaaaaagggaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattacagaaaattttttaaaaaaaaccttgttataacccaattaaataaaaattaaattattttcttttgtaatctaattattaaataaattgatagattttttaaaaaatgttttttgtaaaatttcgtatttttttctaatttat

SEQ ID NO: 50395 - DNA, 458 bp, Zea mays
  Clone ID: LIB3067-037-Q1-K1-C6
caaggagacacctctacccatggaggatgccttaaatgactacaaaaggctagattacatcgagcgccacatcgctactcttaaggaatcaatagacttgggatcaaatgtgcaaggctacttcgcttggtctctgctggacaactttgaatggttcgccggcttcaccgaacgttatggcattgtctacgtcgaccgcaacaataactgcacgcgctacatgaaggagtctgccaagtggttgaaacagttcaacgccgcgaagaagcccagcaagaagattcttacgccagcttagaaatcgggggcctcatgatgtgggtgcagcccataaaaaactggtgtgtggtttcgaaccgaaaattttctgtttttttccgccacgagaggttctggaggcatactctccagcaccgtggctaataacgcattgttccaattcagtctggccttgtcat

SEQ ID NO: 50396 - DNA, 453 bp, Zea mays
  unsure at all n locations
  Clone ID: LIB3067-037-Q1-K1-C7
cccacgcgttcgcggactcgtgggcttcgccgcgaggaaccccttcacagcgcggaagatggctgaacaggaggccccagtcgtggttgaggcaccaaccccagttcttggggagcctatggacttgatgactgctctgcagctcgtgatgaagaagtcaagtgctcatgacggacttgtgaagggtctccgtgaggctgccaaggccatcgagaagcacgccgctcagctttgcgtgcttgctgaggactgtgaccagccagattacgtcaagctggtgaaggcactctgcgctgagcacaatgttcacctggtcactgttcctgccgcgaagactctnggcgagtgggccgggctttgcaagattgactctgagggcaaggcaaggaaggttgtaggctgctcctgtgtcgtcgtcaaggactacggtgaagaatctgagggccttaacat

SEQ ID NO: 50397 - DNA, 300 bp, Zea mays
  Clone ID: LIB3067-037-Q1-K1-C8
cccacgcgtccgcccacgcgtccggtggtgcccttaaagcatgggagtgatctctggttttgctgtcgccgagctgggaaataggaagctgaatcgacctcgcaagcggggaatgtatccttttttgctgcaacataaaaaatgctacccaggcatagctgggtaccttttaacttctgtttgtgggatttgctagagtgatggtttcgatatatagggggacttgaatgtctggaaaaaaaaaaaaaaaaaaaaaaaaaaaaaaaaaaaaaaaagggcggccctagttctagatcgcga

SEQ ID NO: 50398 - DNA, 440 bp, Zea mays
  Clone ID: LIB3067-037-Q1-K1-C9
cgacgagtgccacaggcagatattctccaccctcttcggcattccccagggcccgatcaacggtgcaccgtcgcagccaggcgaggtgctttcagagctcaccgaggaaacaacagtgccagacaatgccacagatgaggaacatggaaaaccaggcctgccctgattcaagatcggtttcaggacccacaagtatagatacgaaaccttactgctactaaaacacaatacctcaaatagacgggcttttcttcgctgcccatgggagcagcctgtgaatcgagctgctcctcttgcggaagtcgtgaaggcaaagcattggatggaagaagttgtgccgtctcagttcgatgtacaaaaatgctcatcacaaattcgcacggcacctgctcggtgcgcttttagcatagtcggtattacaattcgattaaacctgtatg

SEQ ID NO: 50399 - DNA, 452 bp, Zea mays
  unsure at all n locations
  Clone ID: LIB3067-037-Q1-K1-D1
cggacgcgtgggcggacgcgtgggctcctcttcgtctccgtctccgtcttcctcaatcccagggacgaaatggcagcgactgtcgcctcgtttttttgccaacaaacaaaaacaaagcagcggtgaagggaggggaggaaaggaaacagcaaccacatgcgattatttcttggggattccgcccctccgacctatctaagcggaccataaccacgggcagcaggacattatattcttctgcctgcccttccgttcaatttcaatttcactttccttctctcctctcctcctgctgctactaggttcgggccgtccgtccttgctcttgatctgcattatttaattcggaccattcccccgctgtccttnccgccgcctgccggagatggagatggagaacgggcacgccaagtaccgggtggccgtcattggcagcggcaactggggcagcg

SEQ ID NO: 50400 - DNA, 447 bp, Zea mays
  Clone ID: LIB3067-037-Q1-K1-D10
cccacgcgtccgcccacgcgtccgcaaggcaccacacctcttcctcctcttcctggtcctacgacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggcgtataaatataattaatagcagcgtctaaataagatcctgtcaactgca

SEQ ID NO: 50401 - DNA, 360 bp, Zea mays
  Clone ID: LIB3067-037-Q1-K1-D11
gacagatacaaggtttcttgttctagaatcaagtatttcgctgatgattataggggtgtctccaaaatcagcgattatgtgctatcaaatgagcttgtaagtatggcactagcaatggtagcggaagacacacaaataaacagagttcttgaagaactttctgctgaggagggaaatgagatgtgcattctgtctgctgaattacacctttatgagcaagaggaattgagtttctttgatattatggttagggcgcgtgagagagatgagattgtgattggctaccgtattgctaacaccgaccaggctatcattaacccagaatataagtcttagactaggaagcggtcactagatgat

SEQ ID NO: 50402 - DNA, 338 bp, Zea mays
  Clone ID: LIB3067-037-Q1-K1-D12
cccacgcgtccgaaaaaaaaaaaaaaaaaaaaaaaaaaaaaaaaaaaaaaaaaaaggaaaaaaggaaaaaaaaaaaaaaaaaaaaaaaaaaaaaaaaacacaaacataaaaaaaaaaaaaaaaaaaaaaaaaaaaaaaataaaaaaaatgtacttctccaactaaagtcaccaactttaaattcactgaaattgaacttaaaactttttttctggtaaaactatatcaattcaaaagtcaatcgttttaaaacacatttgcctgaaaaaacctggcgtaccaaaattaaaaccctatctaataaaccttctatacccctgcagatcctatattaaaaa

SEQ ID NO: 50403 - DNA, 339 bp, Zea mays
  Clone ID: LIB3067-037-Q1-K1-D4
gaacgccaaacagtgtctcttttccagttccagactctgaagaaactccgaccggccggtgggcggtggcggcagccggcggcaggatctgtgccgcgatggcgacgtcgaacacggcgcggatggaggacggctgctgcgacctgcggagcaccatcaagaagtggaatatcatctaccctgtctacctcaactccaagaagactgtcgccgagggccgtcgcatcgccgctgccaaggcctgcccggaccccacctgcatcgagatcgctgactgctgttcgcaccttaagatcccccacgccatctagttggataaggcgtaccctctggattttt

SEQ ID NO: 50404 - DNA, 425 bp, Zea mays
  Clone ID: LIB3067-037-Q1-K1-D6
ttccactcatcctgttattttctttgcattctttaatatcatcattttccttgtaattgctgtctcattatatttttttctattaatttatcttttataattttaatattttatatttcttcttttatttatatttttttaattttttttttttatttttatttttatttttttttatttaatttatttatttattttttttattttctttatttatttttttattattttattttttattattttttttattatatttttatttatttatttttatttatttttttatttatttaattttattttattcctttatttatttttctttttttatttttatttttttttctattttttttatttattttattatatttatttttattaattttttattctttatatatttttatttatttttattt

SEQ ID NO: 50405 - DNA, 445 bp, Zea mays
  Clone ID: LIB3067-037-Q1-K1-C11
gtagctcggacccaaaattttcgttcgccgtgcacgtcgagcttcgtcacgtccgcctctgggtcttcgtcacatcacccgtcccctcgcgctccccactcacccccacctcctccgctctcgcaagctagacaggtgggagccgccgtcgtcgtagatgtcgaaggacggccccgactccgactcgttgtcgtcgtcgcagatatcgaaagacggccctgagtccgactcaccgacgttgcagatgtcgggggacggctccggcggcggggacaggtgggagccagatctgagcggcggcagcggctgaagcagcaggcgggcaccgccggaccaggtgctggggaacgtgactcggaggaggactccgactcgccgccgtcataggtgtcggaagacgatccctgctgcggggactggtgggagtattaccctcaaattagcg

SEQ ID NO: 50406 - DNA, 325 bp, Zea mays
  Clone ID: LIB3067-028-Q1-K1-D5
cggacgcgtgggctcaaactcggtctgagcatcgatgaggacgagcctgttgaggcagaggctgagatgcctcagcttgaggacgacgctggtgaaagcaagatggaggaggtcgactaagtgtcgcatcgcatgcttgccgtttatcttatccctagctaagctacctgtgatagcttaattttcactattgttcgaggtttttggcacgttatcggttgtcctgctggccaggctataagtctggtttatctgttatgtttaccctttttaacagtttgtcgttattattcgtaatggtaaaaatgtagtacatgttttgccc

SEQ ID NO: 50407 - DNA, 452 bp, Zea mays
  unsure at all n locations
  Clone ID: LIB3067-028-Q1-K1-D6
ccaaggcgcggagcggcggcggcagcgacgacggcagcgcgcaggtggcgctcgtggggcaggccgccgacgaagggtgctcgctggggaagcgcctcgcgctgtcccagctcccgcagctggcggcgcgggccgggccggcggcgaagggcggggtcgcgctggtgctcaccgcgcaggacgtggccgtggacgggttctgcacgagccgctgcggcctgcacggctccgacgccggggccggggccgcctacgtctgggtcggcaacgccgaaacgcagtgccccgggcagtgcgcgtggccgttccaccagccgctgtacgggccccaagcgccggcgctcgtgccgccgagcggcgacgtcggcatggatggcatggtggtcaacatcgncagcatggtcgccggcgccgtcaccaacccgttccgcgacgggttctaccagggcgac

SEQ ID NO: 50408 - DNA, 431 bp, Zea mays
  unsure at all n locations
  Clone ID: LIB3067-028-Q1-K1-D7
cccacgcgtccggttggcaaggcagccatgaaaccccctcagctgccggcaggggagggggcctcctgggctcacgaggtcaagcaggccctccgtgagaaactccggcgctcctacggcgccggagctgcctccgccacaccggaggccaggccggccggcgaaccaagccgtggcgctgagtgccgcggctcggcggccgaggaccccataaggagagtcatgttcttggctccctggggtcacacataagaacacaaaccggccggccgagatctgggcatgcaagcttgcatggccatgtcttggtcagtcagatctgcaaacaaccaaactgtaaaaaagaactggagcctgtcttgtaaatcatggagcttgctgctgcttgcacccatganaaacatgaacgcatgggagagctggtaactagc

SEQ ID NO: 50409 - DNA, 433 bp, Zea mays
  Clone ID: LIB3067-028-Q1-K1-D8
cggacgcgtgggctcgcggtcgcggtagccggcggcggcggaggaggaaagcaggcaggccatggcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtcctcaaggagctggagctgctcagcgatggggccaacgtgtacaagctcatcggacctgtgctggtcaagcaggacctcgcggaggccaaggccaacgtcaagaagcgcatcgagtacatctccgcagagctgaagcggatggatcgggcgctcaaagacttggaggaaaagcaaaacagcaagaaagaatccatattcagttgcagcagaggatgc

SEQ ID NO: 50410 - DNA, 313 bp, Zea mays
  Clone ID: LIB3067-028-Q1-K1-D9
aaaaaaaaaaaaaaaaaaaaaaaaaaaaaaaaaaataaaaaaaaataaaaaaaaaaaaaaaaggaaggataaataaaaaggaaagaaaaaaaaaaaaaaaaaaaaaaaaaaaaaaaaaaaaaaaaaatctaaaatttaaaaaaaaatacgggcaactttttaaaatttccaagttttacaccatcatctttttaaatgtacaactttttttaaacggcattcttataaaaaccttttgttctggatttaaaaacggtttcaaaaaaaaacccttttaaaaaccatctttaatgccaatgagccattttccctt

SEQ ID NO: 50411 - DNA, 417 bp, Zea mays
  Clone ID: LIB3067-028-Q1-K1-E1
cggacgcgtgggcgagcccgcagtctgccatcccctttcggtggcaaccaaatccggcttgcctgcagcggatctccatctggtcggagtggatcgggtctccggtggtgtttctcgcctccgtggcggttagtggcgccggacggaccacgtccccgcagcagcggtcagcggcggctggcctagctgcggtggcttgaggcggctctcggacgggtgcctcgagctggcaccagcgggtgggtgccgcaactctcaccgctagctggtgtagaggcggcgagtcccggcgccatggagggtaggccgcaagtgtccgcttagagaggggtcaacaaagggacttgtcaagctacgacactgcggtcttcggttgccctgctcagcttgttgttgccgtacatgatccttcatgat

SEQ ID NO: 50412 - DNA, 448 bp, Zea mays
  Clone ID: LIB3067-028-Q1-K1-E11
cacaggcaaggccatccatatatctcatcagtattcgaagagaaatctgatcgtctcatgtgcggtctggccgtccgaagagagtggaaatgatcgctctctccaagatagccctggtgtctgcggtggcgctgctggggctgggctgggcgtaccaggccacccgaccgccgaccccggcgatcttgggcgccccaagatggccgtcgatcagctcacctagaatccggctgaaagacggccggcaccttgcctacagggaggaaggagtgcgcaaggagaacgccaagttcacgatcgttttcatccatggcttctactccaccaatgagagcgggttccccgagtcccatgagcttgtggagcagctgggcatatacatgctcttcttcgacagagccgggtactgccacagcgacgccaacccgaagcgctgcctcaagagcga

SEQ ID NO: 50413 - DNA, 385 bp, Zea mays
  Clone ID: LIB3067-028-Q1-K1-E2
cccacgcgtccggtcaaaacatttgctcccctctaaaagaagtggggaatcagatgtgaggtctgttatccattcggattataaccggaaataaaattggaccagcaagagacaggcgtgttcagatatttaagatgcattgtacatttggttgtattgtttgctcctgtcctagtgaatgcctatggttcattctaagttaccattttgtggtaattgtgttgtaaaaactatatgtatcaaattatattagtactgtagctttacactgttagttctttacggaagatttagtctcctggcctccttttttgtaatataacagtcctatcattgaatgcttgtcagggaagggctgttgcctaacctttggggcttgttttgg

SEQ ID NO: 50414 - DNA, 289 bp, Zea mays
  unsure at all n locations
  Clone ID: LIB3067-028-Q1-K1-E3
cgnntccgcttctggttttggttttccctccacccaaacctctttcaannttccaccatttagacgacnngacgaagagcgagcgcnncgataagaaatctgcgcctgtgcacaanncgacgaagcnggaagggggtacccgtacctnntggagaatcccaagnnnaagctaannngaaatgggtcagccnnncagtttgcnnatccgaagcatggggcttgctatgnnntcaactgcnnaactattgggcaacactttatcctgnngtggtgaaatgggttgccaagc

SEQ ID NO: 50415 - DNA, 410 bp, Zea mays
  unsure at all n locations
  Clone ID: LIB3067-028-Q1-K1-E4
gatggtcgtgagtgtccgcacgaacccatcacacgctccgcccactcccccaggcgcacggccgcacctctccacctccggcgactaccaccaccatggcggccacctccctcgcgcgcctctcccgacgcaccaccatttccgctaccgccgcggcgccctccctccggcgcctcctctcagtcacctccacagcctctgtcgcggcaaccgccccgccgccgccgccgcccagcgcgactggcgccgcggccgtgggcgcggatcgggtgcggtgggactatcgtgggcagaggaagcttgttccgctgggacaatggatgcccaaagtggccgtggacgcttacgtcgcccccgaggccgtgctcgccggccaggtcaccgtccacgacggcgcctncgtctggagc

SEQ ID NO: 50416 - DNA, 201 bp, Zea mays
  Clone ID: LIB3067-028-Q1-K1-E5
aaaaaaaaaaaaaccaaaaaataacataaaacaaaaaaaaacaaccaaataaaaatgagacagcaacaaatctacataaaaaaaaaaatagatcaactcttcaaaaaaacctactttcctccctcaatcttactaacaccttactctcctctttccccccctaacttccatccactgcctttcctttctccacttgctttc

SEQ ID NO: 50417 - DNA, 446 bp, Zea mays
  unsure at all n locations
  Clone ID: LIB3067-028-Q1-K1-E6
cccacgcgtccgcccaccgtccgcccacgcgtccggccgactacaacatccagaaggagagcaccctccacctggtgctccgcttgcgaggtggtatgcagatctttgtgaagaccttgactggcaagaccataaccctggaggttgagagctccgacaccatcgacaacgtgaaggcgaagatccaggacaaagagggcatccccccagaccagcagcgtctgatcttcgccggcaagcagctggaggatggccgcaccctagcagactacaacatccagaaggagagcactctccacctggtgctccgcctccgcggtggtcagtaagccatggttcatttaagctgctgctgtacctgggtatctgcgtcgtctggtgccctctggtgtacctctatatggatgtcgtcgtctaataaacatctgtggttngtgtgtcatgaa

SEQ ID NO: 50418 - DNA, 427 bp, Zea mays
  Clone ID: LIB3067-028-Q1-K1-E7
cggacgcgtgggcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtc

SEQ ID NO: 50419 - DNA, 445 bp, Zea mays
  Clone ID: LIB3067-028-Q1-K1-E8
accaccaccagcagggcaccagcagcagtgggcgctccccttcgccggcgccgggcaggtcaggctgccgccgcagcaggcgcctccggatagaaagggccggggcggcgccggtggcggcgtcatggagtctggctccagatccagcggcggggcggggttcgacgacgacgacggcctcacgacgcgccgcgaggtctcctcttcgctccaagatttgacagtaagggtggaccggaagggtgggagctgcagcgatggtggtacggatcagcggccaaacacaccgcggtcaaaacactcggccacagagcaacgcatacgcaacatgatcaatgataggtttcagatacttatggagctgttgccacacagtgatcaaaagagagacaaagcaacatttctcttggagggtattgaatatatacgggttttgcaagaaaag

SEQ ID NO: 50420 - DNA, 402 bp, Zea mays
  Clone ID: LIB3067-028-Q1-K1-D4
cccacgcgtccgcggacgcgtgggcagtagcaagagggatagagcaaggccacacacacgcacgcaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcccgggttcagcatgcccggcagcg

SEQ ID NO: 50421 - DNA, 443 bp, Zea mays
  Clone ID: LIB3067-028-Q1-K1-C11
tccattcaaggtaataaagtcaataaaattgatgtagtttatactccatggtacaatttgaaggagacgccttcaatggatgtgggccaagttggttttcacaaccctaaattggttcgcactattaaagtggaaaagaggatcaatgagattgtgaaccgcttgaataagacaaaggtggaaccaaaaacctgatttaaaggctgaaagagaggctattagtgctgctgaaaaggcagatagaaaggcacagcttagagacaagaaacgtagggaagagattgagaggcttgagaaagagaagcacgctgatatcaggagctacaagggtctaactggccaagagaagatgacttccaataagcaaatcgcttctggcatcaagaccctgcaagaacttgactaagactttatgtgatatgcggacattataaatgccatgc

SEQ ID NO: 50422 - DNA, 443 bp, Zea mays
  Clone ID: LIB3067-028-Q1-K1-C12
ggaacccatggcagaagacattggttcctccaagcaagctcctcaggcagatgccagtgcaatggccatcgatgaaccaagcaatgtcaagaatgaacctgagagctcaactaaattgcaaggccaagcagctgcgtaccacaagccatagctgcgaccatcaagagttgctgggtttctgctaggcaacttcctgcttgatttggacagtccagaaaacagaagtgaatccgcaatacgtccctgccatttcaaatttgacttggttacacctatctgtgacaatgttaatgtaatgagaacccattgcactagtgaaagtcccaagtgtccacctgggattgcttgccgttgaaagagacgatagtctgatgacccatgtatacatgaagcccatgatctcaagtgtacagtcattagccaatacaaatatgcagtggact

SEQ ID NO: 50423 - DNA, 399 bp, Zea mays
  Clone ID: LIB3067-028-Q1-K1-C2
cccacgcgtccgctcagcttccaccaaatgttcgagggcatgggtctaggcggctgcatcgttcaggccaagttcaagctgcggtcgatcgtgacgatggtgctcttcttctgcctgacgacgccggtgggcatcgtggtgggcgtcgggatctcatcggtgtacgacgaggacagccccacggcgctggtcgtggagggcgtgctcaactcggtggcggcggggatcctggtgtacatggcgctggtggacctgctcgccgaggacttcatgaaccccagggtgcagagccggggcaagctgcagctcggcatcaacgccttcatgctcgtcggtgccggcctcatgtccatgctggccaagtgggcctagtttactagccagccactttttgctctc

SEQ ID NO: 50424 - DNA, 401 bp, Zea mays
  Clone ID: LIB3067-028-Q1-K1-C3
actagttctagatccgagtgatgcatggtgttgtcaatttcttcggacgaatctcattccttggtgaacagaatactcaagcatcctatttcttcatgacagcaatgctgcagctcttcgaccggtccggtatgctctacggcgagcttgcacggtttgtgctgcgtttgctaggagtgagaagaaagccaaagaaggggggcagcattcaggggccagaagcgctggcgttcgagggacctagccggcagtctatcgaggcaccgaaaacgaacaactgggacaacgtctggggaaactgagatcatgcctatgggtgcaacgagttgaatcatatagaagaagtgcaagggctatgacctatgggagtttgcttgccttttgattcatcaaaaagaaga

SEQ ID NO: 50425 - DNA, 432 bp, Zea mays
  Clone ID: LIB3067-028-Q1-K1-C4
cccacgcgtccgcccacgcgtccggccgggaagtggcagcctcgctgcaccgatcgcttgccaagtttatcgtgcctgacaacccagagaaaatcctgtcgcttgtcgctgccaaggctagccatcatagagctcttggctctgcggacctcacatgtgccctgcaggcatgcagggggcgaggcaaccgatggccgcttgtgctggagatccacgcgacatcagtcgtgcgtgggcttggggctgaccgccttataggcaacttgctgatcgatctgtatgcaaagaatgggctcgtgtggcaagcacggcaagtattcaaggagctttcttccagggaccatgtctcatgggttgccatgctgtcagggtatgcacagagtggtcttggaaaaggaagctttcaggctttacagccagatgcattggact

SEQ ID NO: 50426 - DNA, 435 bp, Zea mays
  unsure at all n locations
  Clone ID: LIB3067-028-Q1-K1-C5
cggacgcgtgggcggacgcgtgggcggacgcgtgggcggacgcgtgggcggacgcgtggggccgcatccaccgcatgctcaagctgggcctgagcatcgacgaggacgaggaggctccggaggctgacaccgacatgccccctctggaggatgacgctggcgagagcaagatggaggaggtcgactaagctgggtttattcttatggaggaaagagagagaacatcgggtctgttctgtgggtcttaccacttatgctattatgcaatctgttgttggtatgctagtgctactattgtctctgctgtcttctagttaattttggtgttgttttgcgtggtcagtttctcatcgcatcagtggtagaaaacattcacctgtgggactaanaaaatgtttgactgggaatnggaacgcaatcggcaggtcttctgtt

SEQ ID NO: 50427 - DNA, 342 bp, Zea mays
  Clone ID: LIB3067-028-Q1-K1-C6
ccgacgcgtgagctgacacctgatctgactcgtcatcggactcgtcggctgacgcgtggggccgaatccaccgcatgctcaaactgggactgagcatctactagtactgacaggcaccccaggctgacaccgacatgccccctctgaactatgacgcttgcgacaacaacatggacgaggtgctctaagctgagtgcattctcatctaggaaagagagagaacatcgcgtctcatctgtctgtcttaccacttatgctatgatccaatgagccccaggtatcctaacgctactattgtgtctgctgtcttctactccatcatgctgcttttttgcggcctca

SEQ ID NO: 50428 - DNA, 124 bp, Zea mays
  Clone ID: LIB3067-028-Q1-K1-C7
gcggcaccaaggtaccggtgtcttcgatgcaaagtagtgtgaaacggctattgaggtttgtgaaaatcgactgtatgatgaggaattatgcaaataggaaaattgcgctgccgtggacttgatc

SEQ ID NO: 50429 - DNA, 518 bp, Zea mays
  unsure at all n locations
  Clone ID: LIB3067-028-Q1-K1-C8
cgtctcgtaaatattannngaaacttcacttggtgacccatcactcccgcttggctttcacganntagtgaagaattaccaaggttannattgagcccagtatctgcctcnnaacacacatgcnntcctactcnnacaaggacctgnngtcgctggaacctggagngnnaagttttttcacttttgatcganngatggagatnacttaataagtaccttcaagatatttaaaaataatctgcattaacaagaaatgctatnntatggcacggttcaagggttgacccgaattttgtgggaaattcttaagtcaaagggctttaagaattgcacctnctgaagggcacctgttactggctatantgttcggcaaaaggcctctactttgcaagatctagtaaagcaagagcgcacaatacttgttatgtggataggaataatcctgtaggtttgatgcttctttctgaggttgctttangagacatgtatgaactaaagaagccacgtncatggacaaa

SEQ ID NO: 50430 - DNA, 444 bp, Zea mays
  Clone ID: LIB3067-028-Q1-K1-C9
gttctagatcgcgagcggccgcccacgaatccacatttcctaaaggtgccccatgggttaggtaccatggcaactacaaaggcctccacattgaccttgtattgcctggaaaggatgctgttttaggagtcgacagtgttggtacggtatcggcagctcttttgactagtttttccattcaaacattgaagccagaccttatcattaatgctggcactgctggtggcttcaaggccaaaggggcaagcattggagatgtattcctggcatcagatgtttcattccatgacaggaggataccaatacctgtttttgacatgtatggaattggagcacggaaaacttctgcagttcctaatatcttgaaggaactcaatttgaagattggcgaattgtcgactggggattctctggatatgtctccccacgatgagaaggtgatac

SEQ ID NO: 50431 - DNA, 413 bp, Zea mays
  Clone ID: LIB3067-028-Q1-K1-D1
cccacgcgtccgcggacgcgtgggcacaaattattcaatatcgtcctcctgttcctgaaagcttgaatcagccaataccagcaaatgaagctttctattcaacccctgcacaaccagcttcaagccctgcacttgagatgcccatggatgtagagatgacttcaaacaatgttgatacctttgattcaactggcaatgattttactgacacctctgctctatgtgaatgggatgacatggatatatttggtgacgaacttgagcacattcttcaacagccagagcaggactttcaagtggaccctcctttaacagttgaagattatggttatgatcatccacggttagagcaagactgtcagatggaagcacaacagaattgcaaaaatcctcaatatgctgatgtcataact

SEQ ID NO: 50432 - DNA, 454 bp, Zea mays
  Clone ID: LIB3067-028-Q1-K1-D10
ggaagatgcccccaataatgcagatagtagtagtgaggttggaggtatgctgcataaacacataatggagaaaacagttacagaagcttttcaaattttggaacatgatgaaagaaacttgtacactgaccaagaggaatcagtatcatcaaacgagcaagttgatggatcttcattcctgagtaaaaaaatcagtaaaaccgaagatgcaatttatgaaaacacattcggtctatctgaaggattagaagaaagtgatagaagatgtccccatcatgcaacatgtagctctttctggggtccttgtagaaatgacacagactttactgatcaagtaacttcaagtatatctgattaaccgtttgctggtgctttctacttctctgatggtggttacagactcctgagaactttaactggtggatcaagaattccgtccctggtaataattgat

SEQ ID NO: 50433 - DNA, 227 bp, Zea mays
  Clone ID: LIB3067-028-Q1-K1-D11
cccacgcgtccgaaaaaaaaaaaataaaaataaaaaaataaaaaggtatactatataaacggatggtgcatacaacagcgacggtaacaatataaaaattcttaactagagaaaactaaaatagggccctttcgttctaagtattccaacttatactactagtaaattcatggatttacctcacttattgggctactaaaacatattcaaatatgccattttttaaa

SEQ ID NO: 50434 - DNA, 445 bp, Zea mays
  Clone ID: LIB3067-028-Q1-K1-D12
gcagatgctgcgcacgcactacggctgggagagcgtggacgtcaccgtccctgagatcgaagagatgcggctggcgcactacgtgaccatgggctcggagtgcactgcctccctcgctgccaagtacctggacagcatggacaggtccgaggtcgggtgggacgtgcggatcgcgctcagcgcctacgggtccttcagcagccgagactacctcagcgcgcagcgtctccgatgccggcagatgtacttccacgagaagatcttcgagacggccgacgccatcgtcacgccgatgacaggggtgaccgggtacccccctgaagaacaagcgctgaaggacggggaactggactacattaacggaactgcgctggtgaaggacttgatcgggggcaacttcctggggctggcggcgatcaccgtgcccgtcgggtatgacagggga

SEQ ID NO: 50435 - DNA, 459 bp, Zea mays
  Clone ID: LIB3067-028-Q1-K1-D2
cttatggatcttctgtccattggatcatctccatcacagaatggcacccccgtaacagacttcggtcatcctggacaagagtctaaacctgttcctggtgtacctgaagctgttgacctcctcggtagtttgtcaccagccgagtctaaacccacaccagttgtacctaaggacatggatctgctcgacggtttgtcatcaaatacatctatttctggacatgagaatacaacccacccatcaataacagcttttcagagtgcaaccttgaagatcacgtttgatttcaaaatgaagcttggaaacccacgagagactacaattcatgccacttttaccaatttgacatctagtacttttacagattttatttttcaggctgctgttccaaagttcatccaattgagactggatccggctagtggcaacactgttccagctaatggaagtggttcagtc

SEQ ID NO: 50436 - DNA, 80 bp, Zea mays
  unsure at all n locations
  Clone ID: LIB3067-028-Q1-K1-D3
tcgtctcgtcaacaagggaagagnntggtgagggcttgnatggagtatgtgaaggggaaagccattggttnnngtgtttt

SEQ ID NO: 50437 - DNA, 452 bp, Zea mays
  Clone ID: LIB3067-028-Q1-K1-C10
cccacgcgtccggtgcagggccaaccttttggatccacaagctctatgcgcaaaccaggagacacagtgcatggggtttatacaccaccatctacgtattcaaatggtaccagtgctttatctggccctccaggaccaccattttttatggtgtactcttatgagcaaggctcaaatcatgctgcttcctcatctgaaccaattgaatttggatctcttgggccacttcctgcagcagatggtgatgacataccaaggtcgacacgccaagtaatgcctaatgggttttatgggcaatgacgtggtcgatataggggtggttcctctcattcatctactgatcaaccatcctcgcctcagcctcgtcggtagttgagtcttcgtatgatggcttgatcacttcgtatgaaaccttgcgatagcaatattttggtacaccccttgtgatcaca

SEQ ID NO: 50438 - DNA, 436 bp, Zea mays
  unsure at all n locations
  Clone ID: LIB3067-028-Q1-K1-A5
gattgactcgctgtatgagggcatcgacttctactccaccatcacccgtgccagggttgaggagctcaacatggacctgttcaggaagtgcatggagcctgttgagaagtgcctgagggatgccaagatggacaagagcaccgtccatgacgttgtacttgttggtggctccactaggatccccagggtgcagcaactgctccaggacttcttcaacggcaaggagctgtgcaagaacatcaaccccgatgaggctgtcgcctatggtgctgctgtccaggctgccatcctgagcggtgagggcaatgagaaggtgcaggacctgcttctgctggacgtcacccctctgtccctgggtctggagactgctggaggagttatgacagtgctgatcccgaggaacaccaccatccncaccaagaaggagcangtattc

SEQ ID NO: 50439 - DNA, 406 bp, Zea mays
  Clone ID: LIB3067-028-Q1-K1-A6
gccacgcgtgctcactcactcagtcctttttgaatccgcggtctctcaagcaagcgctggagggctctcacaagcgaggaccaagaagatcgtaattctctacctgaaggtgtgctcaacttctcgatctggtactaattcactacaacgtactgtgcttacccaatatctgatttaatcatcatatatcttctctcgttcctggatgacatcgacactgattcctgtttatcatgatcgagcagcagtacgtacgcgcagcgtatgctcatcttattgcgccatgcatgatcatcatcatcatacatcaacaattgcacacacttcgtttgctgcacatgcgatcgccgtgcttcctatcgtatactgcctgattctggctgacaccaatcacaagcagatggga

SEQ ID NO: 50440 - DNA, 428 bp, Zea mays
  Clone ID: LIB3067-028-Q1-K1-A8
gtcctacaaggacagcactctgatcatgcagctcttgcgtgacaacttgaccctatggggttccgacaccaacgaggacggcggggatgagatcaaggaagcagctgctgcccccaaagaatccgcccccgagggccagtaagacgatccgatctccggacctgatgcgtgtctgctgatgtcggggagtttaccaggactgtgccgttcttgatttcttatagcttatcttctagtacacttcgtgttgttctcttcgtcacggcgctggcgtgccggtgcgcgtgcgccgaagctgcctgccattgccattgccattgccgctgtttttaattaagcacacactctagatgttatgcccgcatgctatgtttcgattctcaagttgataaatgatggctggatgctggttttcgtgctccaagcct

SEQ ID NO: 50441 - DNA, 399 bp, Zea mays
  unsure at all n locations
  Clone ID: LIB3067-028-Q1-K1-A9
ggtggcttggaaaatctccaaacagctaagaagtattatgcatcaacaatccagttaactggaggcaagaatacaagagccctctttggtgtatgtctgtgtacttcggcaatcaatcagttgacgaaaggaaggaataaagaggaagaggactcggagctgcagagcttggctgcagaggtactgctgaagaattacaagcagcaggctccatcaaaggcgccccttatcagcagcatgttgaagaacatgaaactcagctgataccaaccagctccacacattcagagtggcctgatttgatagatagttaagttaaattgatgtggcttaatatatgctntgtttttttataaaaaaattgtggcaccaacattgggcaggcttaaaagtagatgc

SEQ ID NO: 50442 - DNA, 454 bp, Zea mays
  Clone ID: LIB3067-028-Q1-K1-B10
cccacgcgtccgccaagttccatttattattttctccgaggaagccctttccccaggcacagatccggctcctcgccgccgccatggccgcccgcctccccctcctggtcctcgccgttgtcgctgcgtccctcctcgctgccgacgcgcggccgtgccacaccttcttcgtcgccttccgcgccgaccccaaccccagcagaggcgacgacgctgtaccccaccacctcgccgccgcccaggacgccgtgctgcacgctgatccaggggctggcggacctggaagcggcggtgtgcctctgcaccgtcctcaaggccaacgtcctgggcatcaacctcaacctgcccatcaacctcagcctcctcgtcaactactgcggcaggcgcgtcccctcgggcttccagtgcttctgactatcacacgcccatcgatcgatcgatctggaggctaaat

SEQ ID NO: 50443 - DNA, 446 bp, Zea mays
  Clone ID: LIB3067-028-Q1-K1-B11
aattactcgtagatggtccctatggtgcccctgcgcaggattttagaaactacgacgttgtacttctcgtcggcctcggaatcggggcaacaccgttcataagcattctacgggatctgcttaataacattaagatagctgacgagctgatggacttggcaatggagaccagcaggtctgaagacagcgccaacagctttagcgtctcaacggcgagtagcaaccggaagagagcatacagaacaagccgtgcacatttctactgggtcacccgagaagccggatcctttgaatggttcaaaggggtgatgaatgaggttgcagaaatggacaagaagggtgtcatagagctgcacaattacctcactagcgtttacgaggaacgcgacgcacggacaactctgctgtccatggtccaagctctgaaccacgccaagcacggcgtc

SEQ ID NO: 50444 - DNA, 452 bp, Zea mays
  unsure at all n locations
  Clone ID: LIB3067-028-Q1-K1-B12
cactctccccagctcgagtaaccaccgcgagaaccaatcaccaagcaaaagcccgagaaggaaagaacaaacaggagacagatggcggctgcagcgaaggcgtcgtggatggtggcgatgagcgtcggggccgtggaggcgctcaaggaccaggcgggcctctgccgctggaactacgcgctgcgctccgtccaccgcgccgncaaggccaacgctcccagcttcgcgcaggccaggaaaaagctggcgccgcccgccgcggacaaggccgccgcggaggaggggatgaggaccgtcatgtacctcagctgctggggccccaactagctagggcctctgctagtttcggcttcctgcaaccgtaccgagctcggcttcaaatctgatccatgactggttgccttgccgacccactgtaacataggagtatagcaccacgatgatgatgatga

SEQ ID NO: 50445 - DNA, 436 bp, Zea mays
  Clone ID: LIB3067-028-Q1-K1-B2
cacaggcgtacagccacacgtgcagcgtcctgtgcatgcgctgaagtaccctgagcagggatatgacagatgcacggtatgtcatcgacattgtcccgttgctgaactgcatgatggtactgatctaatggactccgaacctacactgatcaaacctctggtaaaatgaactgcacgtgatggaaaaccataggaattgctgagaggtccactctattatgtcctggtgctgctgttcagcgttttagtcttctggcgtgagtcccccatcgggatcgtctccttgtcgatgatgagcggtggcgatggttttgctgacattgttgggaggaggtatggctcagcgaagctgccattcaatcggaagaagagctgggccgggagcatctcgatgttcatttctggtttcctgctgtccgcgatgatgatgctctac

SEQ ID NO: 50446 - DNA, 428 bp, Zea mays
  Clone ID: LIB3067-028-Q1-K1-B4
gtttgctagtgagtcgagaagagagagagaggcgtccggaattcatcgccagcgatgtcgccgtgcgccgacgcccccggcccggcctcctccgcctcggcgcccccgctcgcgcccctcatcgccgcgcagctcaactacctcctctcgcactccaagctgcccattagggtggtacagatctggtccggctgccgcaacggtcgccctgccgatcggttcaggctcgccatccccttctgcctcgactacgtccactgggatttcgtgtacaatgcgctgtctcccaaggtggcaccagacgtggtgttcggtccggaggatgagaggttccagccgctggtcgattacgctgctgctggaaatggcgataagagctgcttggcgcgttgggattgccgcgcccccgagggactccatgcgctcgt

SEQ ID NO: 50447 - DNA, 384 bp, Zea mays
  Clone ID: LIB3067-028-Q1-K1-B5
cccacgcgtccggtcagtctcccctgacctgccccctccgaaccgtcctgcactggatccctctcccttatgccggaatatttgtaattttgtaagcgaagctcctggtgaagttgcctcctccgtcttcgctccctccgcagcgtcagatcggccgtcgctcgccgagccctagcgccgccgatctcagtccgtaccagtcttgcaaatcggggtcgcgccgcggcggcaagaacgatggccgaggaggccaagtatctggagacggggcgggccgaccgctccgtgtggctcatgaagtgccccccggtcgtctcccgcgcctggcaagccgccttcgccttcgcctcttcctccgacgccgctaacgccaaccccgttgtc

SEQ ID NO: 50448 - DNA, 420 bp, Zea mays
  Clone ID: LIB3067-028-Q1-K1-B6
ggtgaaactgctgaagatgttgtacgactactacgcttcgggcacatgacatcggttgagtcatggatagcagggaggcatcatccaaaattctgtcagctcgttgaccactatttatatgttccccttttagattgagactatgaatgatcgtatgctaatgatgtctggtgcacagtacattgcgcttgttaaccactatgtacatggcttatttagtgatagtgtaatcactcaactgtcggttgaccgttcaagttcataacattgaggttctttctttgctgcattggtctctaaagagccacaacatctgggcatctggctctatataaggcggcgttccttgtagcttcacactcaccactagcctcggcttatataacctttctactgttagcacaggcttattgcatgtgc

SEQ ID NO: 50449 - DNA, 441 bp, Zea mays
  unsure at all n locations
  Clone ID: LIB3067-028-Q1-K1-B7
cggacgcgtgggggaagttctgtgggtagaggactagagactgcagatcgagggtctggcagcgggccgtggcagttgggtgattacgacgaagagagatgggcctcctcgacaagctgtgggacgacaccgtcgcaggcccgcgcccggacaccgggctcggccgcctccgcaagcagcctgtgcgtcccgccgccgtcaagatcagtgatccggccggggacgctgcggcgttcgtgccgccctcgccggcttcgggtagcgaggagacgccggtgaaggtgacgcgcagcatcatgatcaagcgccccgcggggtacccgtcgtcgccgaggagcgcggcaagcacgccgncggcctcgccactggggactaccccngccatctcgccgtttgccggcgccggtggtcggttcagaaggaaatcatcgtccgacgcat

SEQ ID NO: 50450 - DNA, 423 bp, Zea mays
  Clone ID: LIB3067-028-Q1-K1-B8
cggacgcgtgggcaagacctcctcagacccgagaagcgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgtcaagccccccaagaaggcataggggttggaggcggatccgattgtgtcatgtgta

SEQ ID NO: 50451 - DNA, 441 bp, Zea mays
  Clone ID: LIB3067-028-Q1-K1-B9
cccacgcgtccgcccacgcgtccgagaagggcttggacgcggatggcgatttgctcgatgtgatattgaaaggtctgtgtagccatgaaaaggttgaagaggcttactctttgtttgttgagatggtggataaggctgagttgaggccttggcaaggcacttgccagcatttaattggtgacttgctgagggtaaacaaacttgaggaggccctggcccttctcaagacaatgaaaacctgcaagttcccaccttttgcggacccgttccctccttacattgccaagtatgggacagttgaagatgcaaggaactttttcaaggcattgacagtgaaaacttctccagcacctgctgcctacctgcatgttctcaagttgttcttttgcggaggaagatattctgaagctcaagatttactgtacaaatgccctatttaca

SEQ ID NO: 50452 - DNA, 270 bp, Zea mays
  Clone ID: LIB3067-028-Q1-K1-C1
atgacgcgtcgcctgacgcaagttctctgagtaggcggactacacactgctgatcgcaggggtgggtatctacctaggcaggtgggtgattacgactaacagagatgggccttctctgcaagctgtggtacgacaccgtcgcaggcccatgcccggacacctggctctgtcggctccgcaagcagactgtgcgtgccgtcgccgtcaagatcagtgatccggccgtggacgcttcggcgttcgtgcctgcctcgacggcttttggtagct

SEQ ID NO: 50453 - DNA, 451 bp, Zea mays
  unsure at all n locations
  Clone ID: LIB3067-028-Q1-K1-A4
cgccgcagccaatccctccccagcagccgtcgtcgccaccgctgcagcgcggaggcgacgccccatcgccgccaagatgcagatcttcgtgaagaccctgacggggaaaacgatcacgttggaggtggagtcctcggacaccatcgacaacgtgaaggccaagatacaggacaaggagggcatcccgccggaccagcagcggctaatcttcgccggcaagcagctcgaggacggccgcaccctcgccgactacaacatccagaaggagtccaccctccacctggtgctccgcctccgaggtggcgccaagaagcgcaagaagaagacgtacaccaagcccaagaagatcaagcacaagcacaagaaggtaaagctcgcagtgctgcagttctacaaggtggacgacgccaccggcaggtgacccgncttcgcaggagtgccccaacaccga

SEQ ID NO: 50454 - DNA, 353 bp, Zea mays
  Clone ID: LIB3067-004-Q1-K1-B5
gcaacagcaagggagcaaggatactagtcagttgcgcaccttctgatggacaggctgaagcgacaagctttctgatgactactggtgctggcacgttcacttctacagcgacgattattacatatgtattgtagtggtagtctgttttctgacgacgctttggttttgaattgtttcatttttgtaattttttattttttttactagattggttgttggtatttgttattttttttttttttttatatttttttttttttattatatttttcttttttgttggattattttattttttttttttttatttttatttatcttatatttttttattttgtttattatctattttt

SEQ ID NO: 50455 - DNA, 285 bp, Zea mays
  Clone ID: LIB3067-004-Q1-K1-B6
gctaaccttccagactcatttcacaacagcaatgttcatgcttacatgcccaaagtcttagtgaatgtcgtagcgttagcaatttttttttaaaaaaaagttccattgaatgactaattcttctcctgttgcatgctacagtaatgccctggagaaacgatcaaaagatatcgcaaacaggatgttacttgaagagggtgtactgcggcgttccacacgtgtccgggctcatccaaaggacatggcattcctcaagtacgtcaacaagtggaaggataactgatg

SEQ ID NO: 50456 - DNA, 52 bp, Zea mays
  Clone ID: LIB3067-004-Q1-K1-B7
aaaaaaaaaaaaatatcaaaaaaaatttaaaaaaaaaaaaataacaaacaaa

SEQ ID NO: 50457 - DNA, 422 bp, Zea mays
  Clone ID: LIB3067-004-Q1-K1-B9
cccacgcgtccggaagatggtgcgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagttgaatgaagtagcctggaact

SEQ ID NO: 50458 - DNA, 304 bp, Zea mays
  Clone ID: LIB3067-004-Q1-K1-C1
tcgagcatctgccttagagaaagcaatctacatacttgatggggacacacatcatgcttggggaatcccttagcatggggacaatttgaatattcaatcgctttgttgggactctgctggtgaatatctgtcttttgtcagagaagactcgttcagaatatggacattcagttctggacgtgatggtgaatttgtgcacgaattgaatcgcagtggaaatcattttcactcatgtgttttacacccaacttatcaaaccttgttagcgattggtctttacgagttcttggaacttttggacata

SEQ ID NO: 50459 - DNA, 140 bp, Zea mays
  Clone ID: LIB3067-004-Q1-K1-C10
gcgtccggccgagtgcaacgttatctgcgaggagggctttgaccacgaccttacccgctacagcgggcggttccgtcgctgccagatggtactcggcttcctcaccttcgtcctccttttcaccgtcttctgtctcatta

SEQ ID NO: 50460 - DNA, 147 bp, Zea mays
  Clone ID: LIB3067-004-Q1-K1-C11
caaagattataagccctaatacggatgatgccaaatatgttataaatgtaaaacaaatcgcaaaggttgaggtcggatcgggagataatgactctccaactgatatacccgaagggttgaggttcgggtatggcatcctatgtttca

SEQ ID NO: 50461 - DNA, 104 bp, Zea mays
  Clone ID: LIB3067-004-Q1-K1-C12
cgaggagacaggcgcaacgtcgaagtacccgacggcatgcctaaacatgttaacgacgagtggtaggtcttctgtcgtttgctgatcgtgagaacttttaatac

SEQ ID NO: 50462 - DNA, 357 bp, Zea mays
  Clone ID: LIB3067-004-Q1-K1-C2
gataagaattgtggagctagattaaaggatacagttcttgactgggatgatgctttaccccctgaggagatgaatttggccacggagcattgtcgatcagctgatcttgttctatgtctaggaactagattactcctgcatgtaatatgcctctgatgtcaatcaagaagggggggacatagggaataatgttctggagatgaagaaacgcttgcgttggcttatctttttttcttttttatttttttttttatttatttttttattttttttattttttctttttttttatttttttatttttgttttttattattatttttatttttttatttatttttattttttattttttta

SEQ ID NO: 50463 - DNA, 162 bp, Zea mays
  Clone ID: LIB3067-004-Q1-K1-C4
accacgcgttcggaaaagtaaacaagcgactcaaaaaatgacatgtgtacactcaactggatcgtgcggtggctacgacagatgaaaaatataaaagcgacctgtggacgtccagcgcgttagctacaagaaatgaataatcatgcgccacacgttatgata

SEQ ID NO: 50464 - DNA, 448 bp, Zea mays
  Clone ID: LIB3067-004-Q1-K1-C5
cccacgcgtccgcccacgcgtccggtccttggcagaaacgctggctgggtcccttggtgcatcaggatcttctggaaacgtggcatactatatgggtcaaatggctatggccatgggaaaacttgtcacactcgagaatttccttcgccaggctgacaatctacgacagcagaccttacatcagatgcatcttatcctgactatccgacaagctgctcgtgcgctttttgcaatccatgactacttttcacgttttgtctctctgagatcttattggtttgctagtgtttctttagttacattatttttattattgttctatttatttttttttattttttatttttttttcttgttttattatttttattattttttttttttattatttttttttttatttttttctattttttatataatattcttattattttatttttttttt

SEQ ID NO: 50465 - DNA, 53 bp, Zea mays
  Clone ID: LIB3067-004-Q1-K1-C7
aggaataggagaagctaaagacgatggtatctcaccaacagtcatcaacatca

SEQ ID NO: 50466 - DNA, 84 bp, Zea mays
  Clone ID: LIB3067-004-Q1-K1-C8
gcgagcatcagatcgtcaccgtcgactgtcagccatcgggtcctcagggaggcatgctcgtcttcgtctccggttccatacgca

SEQ ID NO: 50467 - DNA, 408 bp, Zea mays
  Clone ID: LIB3067-004-Q1-K1-C9
gtctgttgaaatgcaccatgaggctctccatgaggcccttcctggtgacaatgttggctggaatgttaagaatgttgctgtgaaggatctgaagcgtgggtatgtggcctccaacttcaaggatgaccctgccaaggaggctgctagcttcacgtcccaggtcatcatcatgaaccaccctgggcagattggcaacggctatgccccagtgctggactgccacacctcgcacattgctgtcaagtttgcggagctcattaccaagattgataggctgtctggcaaagagcttgataaggagcccaaattcctcaagaatggtgatgctggtatggtgaagatggttcccactaagcccatggtagtggaaaccttttctgaatatccttctcttggtcgctttgctgt

SEQ ID NO: 50468 - DNA, 173 bp, Zea mays
  Clone ID: LIB3067-004-Q1-K1-D1
gaaaaccctaaaccctcgctacccggcggcggctacaagctcttcatagcaccatgaggccaccggctagaggaggacgtggtgggaggggaggcaggttcgatggcggcggccgtgggggcggctgctgctgccgtgggtttggcggtggtagaggctgtagaggggacagg

SEQ ID NO: 50469 - DNA, 202 bp, Zea mays
  Clone ID: LIB3067-004-Q1-K1-D10
cgccacgcgtcccacaagatcgtttgcctcaagattttttctgccctgcatcgtcttaacaggccgggatatttttggatgctcggggcctaaagtgctcgagagcatagctcctaatttccttagtcttacgacattatatcatttatgctttctaatcttcttacttgttaaaacacttttaatcaagaaacttatcatc

SEQ ID NO: 50470 - DNA, 337 bp, Zea mays
  Clone ID: LIB3067-004-Q1-K1-D11
aagatcaacaacccacattatccgtatcgtatgaccacttcgcaagctatttatttgctggctcctgtcatgggtcctgatgtcacatgccaacagctgctacctgtcgtcattgcttcttcaaaggacagggttcccaacatgaaattcaatgtcgctaaagtcctgcaatcacttgtaccaatccttgatcaatctgctgtggagaagacagtgcaaccatgcttagttgagctcagtgaggacccacatgtagatgttagatactacgcacaccaagccctttgggcgtgtgacccaatggggatatctaattgactagcctgtccaagaatta

SEQ ID NO: 50471 - DNA, 456 bp, Zea mays
  Clone ID: LIB3067-004-Q1-K1-B4
cgaccgcggcaccggccagtcgtggactccgaccaacgtcaccgcgcccctggacgccgtcatcgtggggttccgcgacctctgcctgcatgctgactacgctgggttcgtatcctttattgcctttcttgattgttttctattttttttctatttttatttgttttcttcttttgttttttttttatttttttattttttttttttatttttttcttttttttttttttttttttttattttatttatttatttttttttttttttttttttttttttatttttttttttcttattttttttattctatttttatttttttctattcttttgtttcttttttttattttttttattattttttattttttttattttttttatttattttttttttttttattatttattttttatatttttttttttttttttttttttttttttttatttatt

SEQ ID NO: 50472 - DNA, 402 bp, Zea mays
  Clone ID: LIB3067-004-Q1-K1-D12
cgtcacgcgtcgcgtccacacctcattaaataatagcttttctagagattaacaggcccacttcaagaacgtgcaaaggcataaatatgatgcgatttgttcttgcgatgtatgatatatttgccggaagcatcaccacatatatgttggggctttggttagtctcctcgttttttttcaaaggaggttgcatagggtacatagtgtcatcttttctatttcgttcctagatttgtcaagagatggcaattatttgttggagaaagctcgttgccacattctagtcattcttttcttagtggtttcactgctcatctagtttctgtaattctttaaattgaaggccaattgagcaaagtattaatttggagattgaattatgttactactgtcctatctatc

SEQ ID NO: 50473 - DNA, 263 bp, Zea mays
  Clone ID: LIB3067-004-Q1-K1-D3
ctcaatccggaagcgaaaaggaccagaagaaaccagaggcgactccaggttcgtgggcgatgctgcgcgcgggagctaggcagctccttgccccggggctccggcggctcggtctgggcaccggcgccgccggtcaggtgggcccggccgccgcggcggctgtgatgagggcgtaccacgagcgggtggtggaccactacaacaacccgcggaacgtctgttccttcgacaaggaggaccccaacgtcggtactgggctggtc

SEQ ID NO: 50474 - DNA, 245 bp, Zea mays
  Clone ID: LIB3067-004-Q1-K1-D5
ggagaagcttgcgtatatagctcttgactacgagcaagagttggagactgccaagaacagctcctcagttgaaaagagctatgagctacctgatggccaagtaatcaccatcggtgcagagagattcaggtgccccgaggtcctcttccagccatccatgattggtatggaggctgctggaatccatgagacaacatacaattcaatcatgaattgtgatgtggatatcaggatggacctttact

SEQ ID NO: 50475 - DNA, 111 bp, Zea mays
  Clone ID: LIB3067-004-Q1-K1-D6
gactcgacctccgcttccagtcctccgccgtcgccgcgctgcaggaggccgtcgaggcctaccttgttggcctgttctaggttcacctaccttttctccatctcactccaa

SEQ ID NO: 50476 - DNA, 304 bp, Zea mays
  Clone ID: LIB3067-004-Q1-K1-D7
tcgggacggataagcacgccaagatcaagttctgctgcgtgcagtccaaggccgcctagccatacctgatgctgttgggcatggacagggatgattgttctttatttattttttttttatatatatttatttatattttttttatttatttttaattattttttttttatttttttttattttttttttttttttttattttatttttattaattttttattttttttttttttttatttttatttttttttttatttatttatatatattttttttatatttttttttttttttttttttttt

SEQ ID NO: 50477 - DNA, 323 bp, Zea mays
  Clone ID: LIB3067-004-Q1-K1-D8
atcggtctcctgttcctgatccaaaatccaaaggagtgatttatggcttgacacttgatacaagtgagaagcatttagctcttctatacctagcaacaattcagggtattgcttatggtactcgtcatattgtggagcattgtaatgctcatggccacaagatagacacacttcttgcttgtgggggacttgcaaagaattctctgtatatccaagagcatgcagatattacaggatgtcctataatacttcctagagagagcgagtcagtgcttttgggtgccgctgttcttggcgcctgtgctggcaagaagtttccgggt

SEQ ID NO: 50478 - DNA, 446 bp, Zea mays
  Clone ID: LIB3067-003-Q1-K1-H11
cccacgcgtccgcggacgcgtgggcaacacgcaggggtccggccacgacgggccctacaggtacgacatcaagcggtcggggaacaacgtcaacgtgtccacgggggtgaactggatgctgctgggcagccccgtcagcaaggacttcccgctcgccatctaccccgtcgacaaggtgccgctcccctacgagctgttcgggcccaagccgcccacgccggcgcccgcgccggcacccgcgcccgggccggccaaggccaagaccaagaagaagaagaagtccgccgccatcgccgagccgcccacggccgacgacgacgacaccggcaagggcggcaaggggctgggcaagggcggcgcgaaacgccaccgtaaggttctccgcgacaacatccagggtatcacgaagccggcaatccggaggctggcgaggaggggcggcgtga

SEQ ID NO: 50479 - DNA, 340 bp, Zea mays
  unsure at all n locations
  Clone ID: LIB3067-003-Q1-K1-H12
gtgacacagttccacgcagcagatcagagagtctgcaggtacgctagcgatctagctgccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggcggtggaggatctggtggtggtggtggtggaagcggtgggggtgggagtggngggggtggatcgggtggtgggagtggtggcggaggatctggtggaggcggntgttgcggtggaggcggtggatctggtggtggtg

SEQ ID NO: 50480 - DNA, 53 bp, Zea mays
  Clone ID: LIB3067-003-Q1-K1-H4
gtctcactgagggccgcttgaactgagcctgcccctggcacatgcctgatcgg

SEQ ID NO: 50481 - DNA, 77 bp, Zea mays
  Clone ID: LIB3067-003-Q1-K1-H5
ctcagactggccctgaacctgcacgtgatgcattcggatgtactgcttgaacagctacgctgagcgatgccatgagc

SEQ ID NO: 50482 - DNA, 97 bp, Zea mays
  Clone ID: LIB3067-003-Q1-K1-H8
agcagatcaggatgcttcctgatgaatacgtccaaaggtacctggccttgataaatgcggctgttatcctgcgataacaatacctaggggtagcagt

SEQ ID NO: 50483 - DNA, 445 bp, Zea mays
  Clone ID: LIB3067-003-Q1-K1-H9
gctgaacccgcctgcggacttgggtgctggccacccttcctcagccttcagagagaagttgagcgccggctcatcggatgatgaacatggctcggaggaggacaataaccttagctcagatgaagatggagaagaggaagaggaggaggaagagaaaggtgatggaaacaactggaagggctctgtggatccaaactctctggaagctgaagaaaagaacgggagctcggagagtctgatggcgctgcgaagagcaaagaacgctctactgttcgatctcgacaggaggctaatggacctgcaggcagctgatgcagtctcgaaaatggaggcggcgtcacgcttccgcgtccaggtgctcttcatctacacaccgaggcggcctgtcccttcagacgatccagcacagggggacacagtggagctgccgcagatccctggctcg

SEQ ID NO: 50484 - DNA, 259 bp, Zea mays
  Clone ID: LIB3067-004-Q1-K1-A1
tcgcccacgcgtccgctagcaggaaataaaaaatctgtaagagagaaccagtataataaaggagtcaatatccagcaacgggtaccgatgtacgctagacgcaatcgtgctataataccgagacctacggctccagtgcccttagtgattgacagtctcgcacatgtagtcacctatcttgagccatcttaggtgtctaccaaatttgaagccctgcttggatggtgtgtcttcaattattgtatttataatttttctt

SEQ ID NO: 50485 - DNA, 412 bp, Zea mays
  Clone ID: LIB3067-004-Q1-K1-A10
cacagtcctctaagcagatccccttgttgctcagcatcgatgaacaagacaaagcattaggaaaggcaattgaaagtggcgataccgatcttgtgtaccttgtgctattccatatttggcagaaggtagctgttgagaagaaagctcctttggatttttttggtgttataaatgcaaggcctgtggctagagatttgtttatggcatatgcaagacattctaagcatgaagaattgaaggacttctttttatcgactgggagacttcaagatgccgcctttcttttgttgaaggaatcatgggaattggagaagaaccccatggcaagcaaggggtctcctctccatggtccacaagtgaggctcattgagcaagcccatatactttttgctgaaaccaaagaacatgtttt

SEQ ID NO: 50486 - DNA, 439 bp, Zea mays
  Clone ID: LIB3067-004-Q1-K1-A11
gttctttgagccacttagtattgcctttgatacactgcagtctactatggtgcatgggtgtcagttatttgacatctggcagcatcatctaatggaaagtggtgcagacttccttgatttacagaaatcttataagcaagcagcaggatctttttctgaatggaggggcaagcttactaggaactttggttttgccattgatttgataagcttgttgatgtcacttggtcattactcgatgatattttggcttcgtggtatggcgtttcatctggttgatgcagttctcttattgaactcgcgtgctcttatagtttcctttttgaagaggattaaagctcacatcaagttacggaaggcacttagttcactcgatggagcacttccagatgctacgtatgatgaaatttgtgcatatgatgatgagtgtgccatctgc

SEQ ID NO: 50487 - DNA, 78 bp, Zea mays
  Clone ID: LIB3067-004-Q1-K1-A2
cccacgcgtccgaaataaaaaaaaaatataaaaaaaaaaataaaaaaaaaaaaaaaaaagggaaaaataaaagaaaaa

SEQ ID NO: 50488 - DNA, 432 bp, Zea mays
  Clone ID: LIB3067-004-Q1-K1-A4
cggacgcgtgggccgtcccgccgtccgcattctcttccggtgtcgccatcccctccgtcgcccgccgcgtccggccgcggcaacccgacctgtgtcaatctccatgactacctcaaggcgtcttgctgataggaagatatcacgatttgagaagaatatcacaaagaggggcgctgttcctgagacagccaagaaggcaaacgattatcctgttgggcctattcttcttgggttctttgtcttcgtggttgttggatcatctctctttcagatcatcaagacagcatcaaacgctggtctattctgaggagaatcggttgacacatgcaatctgtcactagaaactattcaagtgtagggcgtggctcaatgtcgcctatttaatgttgtaccgtggtgagttttaggtatatatttaatggaagtgcttat

SEQ ID NO: 50489 - DNA, 80 bp, Zea mays
  Clone ID: LIB3067-004-Q1-K1-A6
aaaaaaaaaaaaataaaaaaaaaaatttttaaaaaaaaaaaaaaaaaaaaataaaaaggggaaaataaaaataaaggggg

SEQ ID NO: 50490 - DNA, 344 bp, Zea mays
  Clone ID: LIB3067-004-Q1-K1-A7
ctcgcagctgcgcgtggcctaccagggcgtgcccggcgcgtacagcgagaaggcggccgggaaggcgtacccgggctgcgacgccatcccctgcgaccagttcgaggtggcgttccaggccgtggagctgtggatcgcggaccgcgccgtgctccccgtggagaactcgctgggcggcagcatccaccgcaactacgacctgctgctccggcaccggctccacatcgtctgtgaggtgcagcttcccgtgcaccactgcctgctggcgctgcccggtgtgcgcaaggagtgcctgacccgcgtgatcagccacccgcaggcgcttgcgcagtgcgagcacacgc

SEQ ID NO: 50491 - DNA, 446 bp, Zea mays
  Clone ID: LIB3067-003-Q1-K1-H10
ggccaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcttctgctgaataataatgaagacacgcatgcatgtcgtcgtcaggaacaagagaaataatacaagaccagcacgcatgggcatactctatattatagatggccaaaaagcacgaggcccgtgagcccggcacgaagcccgctttttgggcccggtccgagcacggcacggtagaataagcgggcgggcttgaacaggaaactaggcacggcgggctagcc

SEQ ID NO: 50492 - DNA, 443 bp, Zea mays
  Clone ID: LIB3067-004-Q1-K1-A9
ggaagtctcacatcactagctccatcgcaattggtatgggtggtgcttctgcacaaaagagaaaagatgtgcctgtctcactccccaaccaacttgtgaattgtcatgcatcgatcctagctagagcatctccgagagcaaaaacccttgttacagttttccaactcacattctactatatattaggatgtgttgggcacacatggaagtaaggcaaaatgatgcatcgacatgtgatacgtgagcacgtatttcaaaacccgataggttggttggagtgggcttcttaaaattattactccgaagcgtgcaattgagattgtagtattataatacccacgtatttgtaaatctggtatcgtcgatgctttaaacacccatctatatatagctcactcactgctgctgttactggcatttcttccctaatcccgttcctgaaa

SEQ ID NO: 50493 - DNA, 280 bp, Zea mays
  Clone ID: LIB3067-004-Q1-K1-B1
cccacgcgtccgacttgaaatgattcataggggggaaaatgtaaggctcgagtctatcttctatggcggcctcgacattcatgacagacacagggacatgcgccttgacattgacaatatgtcctatgaggaactattagcacttgaggaaaggatcggaaatgttagcactggcctcagcgaggaagctgtgataaagttgctcaaacaaaggaaattttcatcgtggagactaaaagcatctttggacccagaaccatgctgtatttgccaggaagag

SEQ ID NO: 50494 - DNA, 419 bp, Zea mays
  Clone ID: LIB3067-004-Q1-K1-B11
cccacgcgtccgcccacgcgtccgcccacgcgtccgcaccctcaagggtcacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctataccaccagatactgccatatgatggtatggttgggtacccgtctttctagggagtttcttttctctctctcttttttcttattgttatgtttttcaatagtggagtgtgcgcgtgttgtaatcgtttttacctgcgtttttctctaactagccggtgacctcgcgggaagcgaggtgaagaaataatgcaactaaaattctctgcc

SEQ ID NO: 50495 - DNA, 377 bp, Zea mays
  Clone ID: LIB3067-004-Q1-K1-B12
aaagaggaacaaagctctaaatgagcaagctatttccttactgatgcctcattaccacatggtaattccacactacaagggtagaagcaaagaaacaaatgatgaggctgagggtaaacaatacaatgataaggatgttgatattggaaagccagtcttgacatcacgcacatcatgtcaggatgttccattgctcttacctcaagagcttgaacctcgtgaattatccagttcagatttaagggtgaatgatttagatattaaccattcagatcgtttaaacaagaagaactttaatcagcctttgctcaaccgaaaggcaaaactggattcttctcattaggatttacctattataatgtttgtagacaatttta

SEQ ID NO: 50496 - DNA, 241 bp, Zea mays
  Clone ID: LIB3067-004-Q1-K1-B3
cccacgcgtccgcccacgcgtccgctgtctcgtgggcgataatgcgccggcgctgagatgttggtttatcaagacctgctatctggcgacgagctcctgtcggattcattcacctacaaggagctcgagaacggcgtcctgtgggaggtcgagggaaagtgggtcacccaaggtcctgttgatgtagacattggtgccaattcatccgccgtgggttgtgaggatgaaagcgcttatgaca

SEQ ID NO: 50497 - DNA, 375 bp, Zea mays
  Clone ID: LIB3067-003-Q1-K1-D10
cggacgcgtgggaaaaaaaaaaaaaatataaaacaaaaaaaaaaaaagaaagatgctataagggatactaaaataaagggtggtgctttcaacgattgcaatcttactataccattacttgccttgagttaactgtgctatagggttataacaactgcaactaattaaaccttgttttacaccaacttaattgcctagtcccatattaccacttaattaaaactgttttatacctataatgctttctcgcaattgcccttccaaacattaggactggcttaatcgccaatgagaatcactacgcacccataatgtatattctgacgcacctttaatcactcccttaataacctcttgatttgacgatactctata

SEQ ID NO: 50498 - DNA, 446 bp, Zea mays
  Clone ID: LIB3067-003-Q1-K1-D12
caaatccagcagtgcaattggcaggtcgttaatgtaacaactcctgcaaattatttccatgttctgcgtcgccagatacaccgggacttcaggaagcctttgattgtgatgtccccaaagaacctccttcgccacaaggactgcaagtcgaacctatctgaatttgatgatcttgcgggccaccctggatttgacaagcaggggacacgcttcaagcgtctcattaaggaccagaataatcacaaggacctagaggagggaatcaaccgcctagttctttgctctggaaaggtgtactatgaactggatgaagaaagaaggaagtcggagcgcactgatgttgctatttgtagagttgagcagctctgcccgttcccctatgacctcatccagcgcgagttgaagagatatccaaatgccgagatcgtgtggtgccaagaggagcc

SEQ ID NO: 50499 - DNA, 444 bp, Zea mays
  Clone ID: LIB3067-003-Q1-K1-D9
cccacgcgtccgggccttcagcaatgtgcctactcgtgattggattaaggatgccatctttaagactctgattgcaaatggaatgttcaacaatgctcatataaggctcacgctcacccgtgggaaaaaggtgacatctggaatgagtccagctttcaatctttatgggtgtgccttgattgtgcttgcagagtggaaaccaccagtttatgataactctcatgggataaaattggttactgccaccacacgtcgaaattctccaaatagtatagattccaagattcatcacaacaatcttatcaacaatattctggcaaagatagaaggtaatcttgcccaggctgaggatgccattatgctagataaggatggctttgtatcagaaacaaacgcaacaaatatttttatggtcaaaaagggaattgtattgacacctcatgc

SEQ ID NO: 50500 - DNA, 441 bp, Zea mays
  Clone ID: LIB3067-003-Q1-K1-E10
cggacgcgtgggggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggc

SEQ ID NO: 50501 - DNA, 393 bp, Zea mays
  Clone ID: LIB3067-003-Q1-K1-E11
cttattcatcgattgtataagatgtttacagaacagtgcattgatccattaaatttatattgattgatatttttatagtggtaaaaaaaaaaaaaaaaaaaaaaaaaaaaaaaaaaaaaaaaaaaaaaaaaaaaaaaaaaaaaaaaaaaaaaaaaaaaaccaaaaattacaaacaaaaaaaaacaaaaaaataacaaaaaatattaaggcaccaaaattaaattaaacaagccccaattttaaaaaaatccaaacttgtaaaaaccttaatatacccaacttaaaagccttttaacaaaaccccctttttccaactggggttattaccaaaaagcccttaccaaatcacctttccaacaattgcacatccttaattgctaattgcaccccccc

SEQ ID NO: 50502 - DNA, 275 bp, Zea mays
  Clone ID: LIB3067-003-Q1-K1-E12
cggacgcgtgggcggacgcgtgggctgacgcgtgggcggacgcgtgggaaaaaaaaaaaggaaaaaaaaaaaaaaaagaaaaaaaaaaaaaaaaaaaaaaaaaaaaaaaaaaaaaaaaaaaaaaaaaaaaaaaaaaaaataaaaaaaaaaaaaaaaaatgttggcttcataacttctttattttttaatgcaaggtatttactatttaaatagttttctttaaattaatttaaattatcaatttgtttaaaaagctttttaaatggtaaaacctt

SEQ ID NO: 50503 - DNA, 97 bp, Zea mays
  Clone ID: LIB3067-003-Q1-K1-E5
cagcatcagcaggtggcaagatggctgtgctccactctccggtcggagtgaggagcatcgtgaccttcctggtggctttcttcatcctatccagctt

SEQ ID NO: 50504 - DNA, 444 bp, Zea mays
  Clone ID: LIB3067-003-Q1-K1-F10
cggaactaggaaggcgaagccgaaggcgcggcgcggcgcggcacggatcgagcgatggcggtggcccctcctacggcggcggcgctggagcagctaagcagcagcaagatgttcgacggcttcaatctccgcttccgccaccagagcgccacccttggctgcgccatgactttctccatctacctgcccccgtccccggcgtccaaccttcccgtgctgtactggctctcgggtctcacctgcaccgacgagaatttcatcataaagtccggcgcccagcgcgccgccgctgcccacggcatcgccctcgtggcacctgacacctccccacgtgggttaaatattgaaggagagtcagacagctatgattttggtgtgggtgccgggttttatttgaatgccacaaatgaaaagtggaaaaactggcgcatgtatgactacatt

SEQ ID NO: 50505 - DNA, 446 bp, Zea mays
  Clone ID: LIB3067-003-Q1-K1-F11
cccacgcgtccgcccacgcgtccggaaggttctatcagcctctccatcagcatattcagctaatccaaagactaagttagcgtctcctccatcgctcactgggtcagctatatcattggtttcggttatgcaggcaagaaataatgctcgggtgctgttatctggatcactcgatctgtttagcaaccggttcctgaagtctggtgttcaaaaggctgatagcaaaacaagatatgagagagctggaaacgagcaatttgtggcagagataagcaaatgggttttccatgagaggggacatctaaaggctgttaatgttaggcatcacaaggttggggagaccaatgaaccaggcatgtaccgcattaatgatgacctggaatactctgttgagatctatgaatggtccggaacaagctggaagccgtatgttgctgatgatgtgc

SEQ ID NO: 50506 - DNA, 439 bp, Zea mays
  Clone ID: LIB3067-003-Q1-K1-F12
cggacgcgtgggcggacgcgtgggctgacgcgtgggcggacgcgtgggcggacgcgtgggcgcggactgaccgtgacgctgcaccggccgtccgcgtcggcgcggcttatcggcgacgacgacgaagaccaggcgctgtgctccatctgcatcaccgcgctggtggccagtgagaaggtgaaggtgctcccgccctgcgtctactcatggctacggtcctaccccagctggccgctctgccgccggctactagtactcggcgacgccaatgtgtgatcagcggcgggccgatgccccgaccaggagtgcttaagcagcgcattactaggtaatgtaatggagatggcagcgaccaccgagaccgagtagtgagatctactagtactgagtgcgtatgtaattaaagactatactactaaaagaagcgcttatcaccaat

SEQ ID NO: 50507 - DNA, 76 bp, Zea mays
  Clone ID: LIB3067-003-Q1-K1-F3
cggacgcatggggatatagcgagggctgaccgacgactcaatagaagcaaccgagacatggagcggcagatgaagg

SEQ ID NO: 50508 - DNA, 188 bp, Zea mays
  unsure at all n locations
  Clone ID: LIB3067-003-Q1-K1-F6
ctccattattccatcccggcggctgctgcggctcgcggcgtgcgtgtcacactcactgatcagtatcccctcgggccgtactccttcctttgtccgntccgctgcgcatcttacggctcacggcattgccagtaggaacaaggtgtctgcgctgctcctctgcttgttgttcctggccgcggtcgtcg

SEQ ID NO: 50509 - DNA, 448 bp, Zea mays
  Clone ID: LIB3067-003-Q1-K1-G10
caaacacgtcaatagtagagattttggactacgattcgtgcaaaacactaaaaaagaaaaggccatcgaaaacgccgccgccgcctctgatgctttccgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttggtgcccatctgtgtttttgattgcaaggtcgctctgtgtcagttgttagtgctgtgttcatcctcggctccagcagacccatgcatcaaccagcatggactgtggatcgatggatgctt

SEQ ID NO: 50510 - DNA, 407 bp, Zea mays
  Clone ID: LIB3067-003-Q1-K1-G11
agtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccggccgcaccgtgccctacgtcgccgtcgtgtacgagcaggtctggacccgcacccg

SEQ ID NO: 50511 - DNA, 341 bp, Zea mays
  Clone ID: LIB3067-003-Q1-K1-C9
gcggccctcttccagccatccatgattggtatggaggctgccggaatccatgagacaacatacaattcaatcatgaagtgcgacgtggatatcaggaaggacctctacggcaacattgtgctcagtggaggttcgactatgttcccgggaatcgctgatcgtatgagcaaggagatcacttcccttgcaccaagcagcatgaagatcaaggtcgttgcaccgcctgagaggaagtatagtgtctggataggagggtccatcctagcctcgctgagcactttccaacagatgtggatatctaaggaggagtacgatgagtctggcccggcaattggtcacag

SEQ ID NO: 50512 - DNA, 322 bp, Zea mays
  Clone ID: LIB3067-003-Q1-K1-G12
gtttgttcatcaaaaaaaaaaaaaaagccgctgcttcgatcgaacaaagtacaccaaaggtgcaggacgctctactaacacgccatcagccacacgtacatcatgcctgacctaccagcagatgcatgcatacacaacacatgaaccgtgtacattgaacacaccgtacgattatgcctcccgatcgagtgctagcactaactatcagaccatcacttgcccatatttctgagcaggactaacatgtacccgtcaagcttagctttctttgtccaccatgtacgttcacaagcatgagtagtcattcaggttcataatgaat

SEQ ID NO: 50513 - DNA, 235 bp, Zea mays
  Clone ID: LIB3067-003-Q1-K1-G5
cttaccgcccgagtggtcagagcgagggcatgacgttgcggccatattccaggagcctggggctattggtggacaggagattggtccagagaaagccagcgtcaacttgtcaggctggagcacatgtttgatgggaggcatctaccatacggtctcaccaacacaggacaacagataccttagaacttgtcgaggcaagaagtcttggacaggttgaataggatcgctggactgg

SEQ ID NO: 50514 - DNA, 258 bp, Zea mays
  Clone ID: LIB3067-003-Q1-K1-G9
cggacgcgtgggcggacgcgtgggcggacgcgtgggcggacgcgtgggcggacgcgtgggaaaaaaaaaaaaaaaagaaaaaaaaaaaaaaaaaaaaaaaaaaaaaaaaaaaaaaaaaaaaaaaaaaaaaaaaaaaaaggggatgcctttttagaggatcaaatttaacttacgcgggtatgaaatgttatatctattatatagggtcaccaaaataaaataaactggccggagtttaaaaagatgaagattgaaaaa

SEQ ID NO: 50515 - DNA, 357 bp, Zea mays
  Clone ID: LIB3067-013-Q1-K1-D10
cggacgcgtggtcggcatccggattccgattcgcaccccctcggccccagccaaaagcatcgcagtttctaatcgtttggagagcacacaagaatgtcgttcgtgcagctctctggtgctggagtcgctgcagtggccttcacgaacaagagcctagtctctcggcacgcatcgctacgggtctgctcgtcgaggctctcgatccgtatcctggtcgttaaggctgcaactgtcgtcatctcaaagtacacttcactgaagcctctgggagatagggtgctagtgaagcttggtgccgcattggagaatgacagttggtggctttttgctttcttctactgtccagactaaacctta

SEQ ID NO: 50516 - DNA, 348 bp, Zea mays
  Clone ID: LIB3067-013-Q1-K1-D11
aagtggctcaagtctgtaaactggaagaggctggaggcccggcagatcgagccaagcttccggccgaatgttgctggcaagacctgcattgcgaactttgacgagtgctggacgaacatgcccgtgcttgattctccggtggccagccctgttgcggccaacagcaactttgtggggttcagttatgtgaggcccgcaccgttccttcagaagccgagtcctcttggctaaagaactacttccgtgatctgatatctaccccatagttcaaataactatctttgagtccgaatcctatgtatttcttcaagacattagtgatgggaatctaaccttattgttgtgttg

SEQ ID NO: 50517 - DNA, 151 bp, Zea mays
  Clone ID: LIB3067-013-Q1-K1-D12
cggacgcgtgggcggacgcgtgggcggactcgtgggccgacgcgtgtcgaggggcattacaggtgtcgtgttgaagaactgccttgagagaagagatttcactagctattcctcgaatatgaccttgcatgattctctcatgtcgacctat

SEQ ID NO: 50518 - DNA, 378 bp, Zea mays
  Clone ID: LIB3067-013-Q1-K1-D2
gtctatctctccaccaatcccgtgcagcatcagcgcacgaagcacgtggagaacgacctgcacttcgtccgcgagcgtgtcgctgccggtgacgttcgggttctcagcgtccccaccatgctccagttcgccgacatcttcacaaaggggctaccgacgagtgtatttttagaatttcgattcagtctcaacatctgtacaggacagagttgtgactgcgggggtgttagactatccctttgtaatgggccaggcccaagtactctaatctatcaatacaacttcaaccctggttagggttaggttttgtcacaatccaacatttagttgttatatttggctttttggctaattctaatgattttcttgatgatttca

SEQ ID NO: 50519 - DNA, 397 bp, Zea mays
  Clone ID: LIB3067-013-Q1-K1-D4
gccacaactgcagctcaagtggcagcagctgttgccgggaagctcattgatactaatgcaccagtggatctgggaacagaatcgaatgtgatgcatacatttgaacttcctatatcattgtctgctttgcaagaatttggtggagccaagggcctgtttgatggttacatggcaaggaggcagaagatagaagcttcaatggggtacaaggtgcctgacaacgatggaaggaggcatgctttaaccttgagtgtgagtgattacaaaaggcggcggagtctcctctgaatggtatctctgattgtgctggacgcctaacggattcaactatattcctgtcgtctgcacctatgtgcatttgctgggacaattgtgcagatcatttgcattttgcctt

SEQ ID NO: 50520 - DNA, 130 bp, Zea mays
  Clone ID: LIB3067-013-Q1-K1-D5
tcggacttgttcggcctcttcgacggcgtgcccgtctccccgggctcattcgccatgcattcctcagcctccgcgagaggaggacgagggctcctcttgccggctgctgttgtggtgctactgttgggtg

SEQ ID NO: 50521 - DNA, 298 bp, Zea mays
  Clone ID: LIB3067-013-Q1-K1-D6
gagaacacgagcgccgacctgggcgttcggatccgtcagcagcgatgaagctctactcgagcctgtggaacgccgacgactgggcgacccgggcggcgcgagaagacggactggtccaacgcgcccttcgtcgcctctaccggcttccacgtcacggctgcaggcctcccggggcgcgctttgcgcacccagggcgcgcgctgtgggaccagccggagttcagggacctcgacgccgtcagtaccgtcgcctggccgacttaggcgcctgtcaccatctacaactactgcaccgatcg

SEQ ID NO: 50522 - DNA, 169 bp, Zea mays
  Clone ID: LIB3067-013-Q1-K1-D7
cccacgcgtccgcccacgcgtccgtcacgcgttggtcagcctgccgttgaatctgtactcgggcctgtggaacgccgactactgggctacttgtggctgtcgcgagaagacggactggtttaactcgccttttgttgtctatctacttcggttttcactttgactgttt

SEQ ID NO: 50523 - DNA, 346 bp, Zea mays
  Clone ID: LIB3067-013-Q1-K1-D8
gaacgacaagaacatcatcttccatgtggacgacgtgacggtgcgcgtcttcaagcgctacgatgacctgccgtacccggacgccaagcccatggcggtgcacgccacactgtgggacggcagctactgggccacgcgcaagggcgaggtcaagatcgactggtccagcgcgcccttcgtcgtctcctaccgagactacaccgtcaacgcctgcgccgtcgacggccggaacgggggcggcagctcgtcgtgccccgccggtgccaacgagtggatggacaggcagtccgacgacaccgaccgtcttatcgtggcttgtgcgcgcctgaactgcttgcagtacaac

SEQ ID NO: 50524 - DNA, 363 bp, Zea mays
  Clone ID: LIB3067-013-Q1-K1-E1
cccacgcgtccgaacaaaggtgtaaagatcttgaagggcacgctagctgttggttttgatgctgatgccaatggtgatgtcactgcagttaagctaaaggatggcacagtacttgaagccgatattgttgttgtcggtgttggaggcagaccattgactactctcttcaagggtcaagttgctgaggagaagggtggaatcaagactgacgcttcctttgaaacaagcgttcctggagtatatgccattggtgatgtggctaccttccctttgaagatgtacaatgagttgaggagagtggaacatgttgaccattctagaaagtctgcagagcatgctgtaaaggcgatcaaaggcaaagag

SEQ ID NO: 50525 - DNA, 370 bp, Zea mays
  Clone ID: LIB3067-013-Q1-K1-E10
gaaaaagaccgtcgatcccttctctaagaaggactggtatgacatcaaggccccatcggtgttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcaggaatgtgctcacaaacttctggggcatgaattttaccaccgataagctcagatctctagtaaagaagtggctgacattgattgaagcccatgttgatgtcaagacatccgacaactacatgctgcgtttgttctgcatt

SEQ ID NO: 50526 - DNA, 448 bp, Zea mays
  Clone ID: LIB3067-013-Q1-K1-E11
gcatgttgattttgtgaaggagtacaagcaagattttgaacgtgatcttgacccagagagcgctactacttttcctgcaacccttgctgaacttacggagagattgaaacactggaagaacattcttcagagtaatgtagaggatcggttcccagcagtattaaaactggaggaagaaagtaaaacacttcgggattttcatgttgttgatattgaactcccagggcagtacttcacagatcaggaaatcgcaccggaccacactgttaagttggacagagttggacctgacattccaattgtccggaggcatggcagtagctttcgacggttgacacttattggttctgatggttcacagcgccattttattgttcagacatcactgactccgaatgctcggagtgatgaaaggatgctgcagctattccgtgtgctaaataaaatg

SEQ ID NO: 50527 - DNA, 375 bp, Zea mays
  Clone ID: LIB3067-013-Q1-K1-E12
cccacgcgtccgttttacacgaatgaaccactgacaaatatctacaacccggagcagcagaaattagtacttggtggtgaggtatgcatgtggggcgaacacattgatgcatcagacattcagcagacaatttggccacgtgctgcagcagctgcagagcggctatggacaccaattgagaagctggcgaaggacacaagatcggtcactgcatgattggcacgcttcaggtgcttgctgaatcaaagaggggttgctgctgcaccactagctggttatggccgctcggcaccatcagaaccaggttcctgcttaaggcattagatatttttcatagatgagtatattttacataatttcaggctttcaatttac

SEQ ID NO: 50528 - DNA, 185 bp, Zea mays
  Clone ID: LIB3067-013-Q1-K1-E2
cccacgcgtccgaacaaagtgtgtaaagatctttgtagggctcgctagctggtgcgtttgatgcggatacggagtggtgatgtcactgcaattaagctaaaatgattgctcattacttgaagccgatattgttgttgtctggtgttggaggcagaccattgactactctatttaagggtcaagtt

SEQ ID NO: 50529 - DNA, 421 bp, Zea mays
  Clone ID: LIB3067-013-Q1-K1-C9
gtccattgaatcagtttttctatgttttcagaatgatggacaaggtacaccatgatagtagaattttttttacaccctggttatcttgttttaattcatcttttctgtgctccaattattttggtgaatcttagcatagaacttgaccttctattattttgtatgtttggtttgcatgggataactggcatgggatatatttatgtacattgatatcgtttttatgcttactcacatgggataatctgatcttctaactcaagatatttttcttttggtaatatgatcgtttaacttaagtttgcattcattttagactttaggttatgttagtcataacatgcttgtttagacatatttacattgtttgatcatattttcttttcatgttacgtttgtattatttggatctcggtgggtt

SEQ ID NO: 50530 - DNA, 361 bp, Zea mays
  Clone ID: LIB3067-013-Q1-K1-E4
cggacgcgtgggcggcgacttcgcggagctgtacatgttcaagtggacgacacttctgatcccgcccaccaccatcctgatcatcaacctggtcggcgttgttgccggcatctcctacgccatcaacagcgggtaccagtcgtggggtccgctcttcggcaagctcttcttcgccttctgggtgatcgttcacctgtacccgttcctcaagggtctcatgggtcggcagaaccgcaccccgaccatcgtggttgtctgggcgatcctgctggcgtcgatcttctccttgctgtgggttcgcatcgatccgttcaccacccgcgtcactggcccggatactcgaacgtgtggcatcaactgc

SEQ ID NO: 50531 - DNA, 427 bp, Zea mays
  Clone ID: LIB3067-013-Q1-K1-E5
cttacaaacaactcagagaaatctacttggtgaggacttgggtccacttagcgtgaaggagttagagcaacttgagaaccaaattgagatatctctcaagcaaatccgatcatcaaagaaccagcagatgctcgaccagctctttgatctcaagcgcaaggaacaacaactgcaagatgctaacaaagatttaagaatgaagatagaagaaactagtgaagaaaatgtgctgcgactgtctagccaggatattgggtgtagtggatctagtgggcatggtgatgaagccaaccaagaacaccttcaacttgctctagaaccttcgctgcatatatggtatcaaggctacatggaccacctgtactatgattaagttgcttctttgtgcgctgtgtgctctaatggccaaggttcttctatatatgtt

SEQ ID NO: 50532 - DNA, 330 bp, Zea mays
  Clone ID: LIB3067-013-Q1-K1-E6
cccacgcgtccgtccacgcgtccgttttttgggtgatgagatgctaattgatgcctctgcggatggtttggatgtgcccgtgtaggtatcttgcgtgactcgtatgcacaagcttcggccacccgtggaaagcagaagacttggaggaagaagcgaaagtaatgatctttctcttccctatgtttttgtcatttggattcatttagctttgctcttgttctgtagtttatggtgcttctcgattagatcaccggtcctacgattgttaacttttcatgccgactcattgtggatcttgcagtggttcctacggtattaatttgtctgagt

SEQ ID NO: 50533 - DNA, 140 bp, Zea mays
  Clone ID: LIB3067-013-Q1-K1-E7
gccacgcgtcctcgggaagtcgcgctacgccttcaagaaggctctaattgaagtcgatgcgggtcgattttaatggcccgagcaggttattaaggttactcgtagtacattctagaaccacccgacgaaagcataatact

SEQ ID NO: 50534 - DNA, 189 bp, Zea mays
  Clone ID: LIB3067-013-Q1-K1-B12
gagacgcgtgcgcgcacgcgtccgtctacgcgtccggtcacgcatgcgaatacgcgtcaggtgacacttgcggacgtgtctaatgaatgcacggagctgcataagaggatcttgtgctgcaaactttacactagagaataacgataagggagatcaggaaccacatatggttcatgaggaacactttat

SEQ ID NO: 50535 - DNA, 320 bp, Zea mays
  Clone ID: LIB3067-013-Q1-K1-B2
gattaaaagtctaggagcataggcaggagtttttatgaatccagctactacactcactgcagtggattacattcttgatggcgatgacctgctcttcattacgtatggcactcttgtctacgaagaaatgagctttatgtgtgtgcaagttcggtctgtatgttttctttagatttgtttagtcattaccttatattgggcctttactctctatttttatgcattttgtcttttttttattttttctcttctttattttttacttttgttgtttttttttctttagttttgtctttatttttttttaatgttatttttaa

SEQ ID NO: 50536 - DNA, 320 bp, Zea mays
  Clone ID: LIB3067-013-Q1-K1-B3
attgcgcccaacctgacatcattgattggtgaagtagttttagctcgcctaatctctcatgctggcagtctttcaaaccttgccaagtgtgcagcttccacccttcaaatacttggtgctgagaaggccctattcagagcactgaaaactcgagggaatactccaaagtatgggcttatattccactcctcctatattggccgtgcttcaaccaagaacaagggcagaatggctcgttacctggcaaacaaatgctcgattgctttacgcattgactggtacttggaggctagttcctctgtctttgggcaaaaattgct

SEQ ID NO: 50537 - DNA, 287 bp, Zea mays
  Clone ID: LIB3067-013-Q1-K1-B4
accggtcctgagttaccgggccagcggaagcgtccgcggctatcggagaagattgttcgcatggcgattgttgagttcgacgagcagccgtcggataacttcgacccgaagaacccgtatgccgacccgctggcgatgctcgagtaccgggaacacctggtgcgagagaagtggatccagatcgagaccgccaagatcatccgggagcgccttcgctggtgctaccgcatcgagggcattaaccaccaccagaagtgccgtcacctcgtttaccaatacctataggc

SEQ ID NO: 50538 - DNA, 336 bp, Zea mays
  unsure at all n locations
  Clone ID: LIB3067-013-Q1-K1-B5
cgtggctggaagccccctgttcgaaggcagttcnttcttgactgcaatgagattgcagatctatgtgatagtgctgaaagaatattttcaagtgaacctagtgtcttacagctgaaagctcccattaagatatttggtgatctgcatggtcaatttggtgacctcatgcgcttatttgatgaatatggcgctccttcaacagctggagacattgcttacattgattatcttttcttgggagattatgtcgatcgtggtcagcatagtctggagacaatcagtcttctccttgcactgaaagttgaatattctcacaatgtacatttaattcgaggg

SEQ ID NO: 50539 - DNA, 468 bp, Zea mays
  Clone ID: LIB3067-013-Q1-K1-B6
cccacgcgtccgcccacgcttccgctcacgctttctcttactcgtggtaaaaatacaaaaatataaaaataaaacaaaaaaaatattataaagtatcactcttatatcttacaatattaattctcccatttttatatttctcttatcttcattatttttttccattaccttattctcttatcttatttttatttttcttcttttacttctctttacatttctctcattgattttctttatctttttactttacttttttcttttttttctcttttcttcttacttttcttctctttcttattattcaatcgtttttttttttcttatttttcttttctttctcctctaatcttttatttctttttgttttctttcttttattttttttttcaatttttttatttttttttttatttatatttctctattatcctttttttttttttttttctttatttattttttttt

SEQ ID NO: 50540 - DNA, 361 bp, Zea mays
  Clone ID: LIB3067-013-Q1-K1-B7
cggacgcgtgggcggacgcgtgggcggacgcttgggatttggaattcttgctggatcctgtgtgaatcctcttctattttccctctccattgttcctttattctatttcggttttgatggccagtacttgagtcaggtaatgtgtacaaagttgcgtctgatgctgcctgtcattgaattgtttggcatgtgaggaagatttaaattgaatattcaacttttgtggtcatgatagttgcacttatttttaccaataatattcattattaggattctttttttttcttccttttttttttatgttttattttacgttagtttttttatttttcttatcgttttattatatttctctttattt

SEQ ID NO: 50541 - DNA, 410 bp, Zea mays
  Clone ID: LIB3067-013-Q1-K1-B8
cggacgcgtgggcggacgcgtgggctgtgagccaaaacgcaaggtcatcaagcatagcaagcttgagaaggacaaagagttatttcaactagcccagcaataccacaaagtggttgcagaaagggatcaagccattgcagtcaaagatagactagaatctctttgtagggaatttcagcgtcaaaacaaaatgctaaaggaagagtgccaaagggtatcgacagagggactgaacatgcgtacggaattgtctgaaaaatttgatcatgccatatagggtgtcagtgccaaacttgatgagcatagagttgagcgcatttctcagctagaaagagaacaatacgttgagaagtaaactgaaagaccttgctgatcaatttacattacttagcaaaaatatgctcaccaat

SEQ ID NO: 50542 - DNA, 406 bp, Zea mays
  Clone ID: LIB3067-013-Q1-K1-B9
gaagcagagaacccctcctcgacctcggcctctcctcttcctcctccgctcccaaaatcctagggttttgctcgccgcggcgcgatggagcccacctcgtcggcgtcgatcgcgcggcagacgtgggagctggagaacaacattcccgcggcggcctccgacccggacgcgatggacgcgatctaccgctacgacgacgcgtctcaggcgcgggcgcagcaggagaagccttgggccaacgacccgcaccacttccgccgcaccaagatcttcgcgctcgcgctgctcaagatggtcgtccacgcccgcgccgggggcaccatcgaggtcatggggctcatgcatggcaagtgtgagggcgacgccattatccgtatggacgcattcgcgctccccgttgagggca

SEQ ID NO: 50543 - DNA, 339 bp, Zea mays
  Clone ID: LIB3067-013-Q1-K1-C1
actagctccaagaaggccaaagctgatattcgggagggagatgaagcagaaggttctaacaagtcaaaatctgaggttgaggatgatgagcaggatggtaatgaggatgaggatgagtaaatagtacgatggggaacagcagctttgcatttgagtgtttgctgctttacttatttttctatatgctgttccttttgatgttatatgctgtaaggaaaatctgtacatgatggtaccttagggtatggcatgctggagttcccctttaacccgaagagccggatacttttgccagcctcgtcagcatgtgtaaacagtttgttttcttgttttattgac

SEQ ID NO: 50544 - DNA, 165 bp, Zea mays
  Clone ID: LIB3067-013-Q1-K1-C10
gacctagctagcagtcctaatatccgaccattattatctactagacctaacttgctccgaggtagcattttactctgtgctgaaacagttgcaattcatttcttctgcgatcaaattattttggtgaatgtcatcatagaacgtcaccttctattatcttgtatg

SEQ ID NO: 50545 - DNA, 448 bp, Zea mays
  Clone ID: LIB3067-013-Q1-K1-C11
cgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactgatccgctgccccgttctcgccggcagcgcgggaggactcgtgactttcatggggtccattcaggctgacgacttctgttttcttctgctgttgagctactggagtcatgttacttt

SEQ ID NO: 50546 - DNA, 200 bp, Zea mays
  Clone ID: LIB3067-013-Q1-K1-C12
cccacgcgtccggttgtgccttgcgtgttttaagttgttctagggtgaactcttgagttctcattgtctggatcatctttttctccttggatgtgttgcatcttttgagtgtggaaatggatggtactcctcgccatgaatttgctggctactttatacattgctttgtaactctgtttgatgataaactttgttgtggc

SEQ ID NO: 50547 - DNA, 315 bp, Zea mays
  Clone ID: LIB3067-013-Q1-K1-C2
acccgcctcctctcgagttcgatctgtttgctctccccagacatgtcgggccgcggcaagggaggcaagggcctgggtaagggcggcgcgaaacgacaccgcaaggtgctccgcgacaacatccagggcatcacgaagccggccatccggaggctggcgcgcatgggcggcgtgaagcgcatcttcgggctcatctacgaggagacccgcggcgtgctcaagatctttctcgagaacgtcattcgcgacgccgtcacctacactgagcacgcacggcgcaagaccgtcacagccatggacgtcgtctacgcgctt

SEQ ID NO: 50548 - DNA, 340 bp, Zea mays
  Clone ID: LIB3067-013-Q1-K1-C3
ctctcagaggaactgggtactatcagaaggctaacatggagataaagcaggcagatggaaatggagccatgattgctgaacaagtatttgagaagactaaagagaagttccaaatgtattgaaccgtggaattacttggtgggatgatttaacattgtgatagccctctgattctcaaaaaaagaataacacaacctctggtattatgtaatttatgatgggccacaaattgccattgtgcttccatttctgaaaacaagattgatgtcactccttgatcttcaatgagcagttgattcttaacttaaataattaaattttttttatttgttttattttt

SEQ ID NO: 50549 - DNA, 60 bp, Zea mays
  Clone ID: LIB3067-013-Q1-K1-C4
acttgcttcaagcaggctactaccgatatgctttcgggttaataaacctaatgtactaac

SEQ ID NO: 50550 - DNA, 258 bp, Zea mays
  Clone ID: LIB3067-013-Q1-K1-C5
ctctctccctcggcctcgctggcggcacagctctagcgcttccactgttgggtgtggtggatttcctccgtccccgaacgatcgatcttttgcatggcagcagcggctagctccaaggggcgggcgatcgctgggagcttcgtcagccgcgtcctggccggcaaggccgtctccccgaggagggccgtgcacgcctcgtcttacgacaagaacccgtgtgagcatgtgcgcccggcgttcgtgcctgactatgtgatc

SEQ ID NO: 50551 - DNA, 318 bp, Zea mays
  Clone ID: LIB3067-013-Q1-K1-B11
gagccgccggcccgtccgtctcactctccgcctcctgtccccaatgccattagttttcaagtggcaattgctgaccaggctaccaaaccaacgtcccttcataagctcggtggccagttccacctgcgctcgatcatctctgaaggtgtacggtcccgtaacatatgcccatctgtctcatcttatgaaaggagatttgccacaaggaactacatgacccatagccttttgtgcccttcgatgtctgttagcggtggcatcaatgtcccagtgatgcggaccccgctctgtgctaatgctcctgctgagaaaggaggc

SEQ ID NO: 50552 - DNA, 292 bp, Zea mays
  Clone ID: LIB3067-013-Q1-K1-C6
gcgggcgtgtggacccacgcgtccgcccactcgtccgcccacttgtccggcttgaaggatcataatatcatgcccggcatcaaggttgacaagggtttagttccattgcctggttccaacaatgaatcgtggtgccaaggtcttgatggtttggcttcaaggtgtgctgagtactataagcagggtgcccgcttcgcaaagtggaggactgttgttagcatcccttgtggtccatctgcattagcagtgtaagaagctgcatggtgacttgctcgatttgctgctattgctc

SEQ ID NO: 50553 - DNA, 361 bp, Zea mays
  Clone ID: LIB3067-013-Q1-K1-C7
ggtggagcccgtgcactttgacctgagcgggacggcgttcggtgccatggcgaagcccggccaggccgaccagctccggaacgccggccgcctgcaagtccagtacattcgggtggcgtgcaactggaacggcttggacatcgccttcagggtggacgccggctcaaacgccaactacctggccatggccatcgagtacgagtccggggacggggacctgcgcgccgtggaactgaagcagagcggcgcggcggcgtgggcgcccatgcaacgctcctggggcgctgtgtggcagtacaagtccggctccaccaatctgcaagcccccctgtctgatcgcctcaccttgggcttcggcagg

SEQ ID NO: 50554 - DNA, 442 bp, Zea mays
  Clone ID: LIB3067-013-Q1-K1-C8
cccacgcgtccgattccccgggcctgctgtggaagcgcatcaagctcacgaccacccgcaagaacaacgccaagaagcgccttaagcggctctggcagaatgaggcggttataagggcttgtggtgaatcagaatccagatcagcgtctaacgtggcttccaccactgagaaacaacagtagcctttgactatttcccccagtttgctgtcatcagattgaaagccaagtgcgtgtataaatcttactttcttcaacatcattcgttgctaccatatgcaaccttgccccctcccgaacttcggcgttatttttatttcactggtttcatgttacttctggaaaaactacttgggattggtttccttccttaattattctgcatatgctgaatgatattgcctgccggaatggtatgcattgcaccaaaaaaaaaaataaag

SEQ ID NO: 50555 - DNA, 250 bp, Zea mays
  Clone ID: LIB3067-013-Q1-K1-A1
aataactatctatctaacgtgtgcatcccgaactaggatcaccacaccggtctgtcatgaccatgagaacctacaacaaagcagtgctcctcgtccttgccatggtgatggcggtgctgtcgacagggatctgcacagcgccggcgccggcaccggcaccgagcttggaggagttcccgacgacgacagaagacacgtgtgtgaagatcctcgccgacagcggctgcgtccacaaccacaaggcgtgcca

SEQ ID NO: 50556 - DNA, 450 bp, Zea mays
  Clone ID: LIB3067-013-Q1-K1-A10
aaacccttgtctccttcttatccccacctccctcgcggatcactcgccgccgccgccggccgcagccatcgccgtgatgctgtccctgtcgagggcgatcgggaggcggctcttctcgtccgccgaggccgcgtcgacggctgcggtgaggacggcgcagaacccgctcgaggagttcttcgaggtcgagcggagcaccgaggagggcaagcctcctccccactacggtcgcagctggaaggcttctgaactgcgactaaaatcttgggatgaccttcagaaattgtggtatgttcttctaaaggaaaagaacatgctaatgacacagcgtcaaatgctgcattcagagagcatgaggttcccaaatccagaacgatatttcaaggtaaagaaatcaatgtgccggataaagcatgtcttgactgataggtctatagcggagcccgatcc

SEQ ID NO: 50557 - DNA, 437 bp, Zea mays
  Clone ID: LIB3067-013-Q1-K1-A12
attggccgtgcgtccgtggctttgcatctgcaaccccgcccgatcaatcttcctcgttccgccgctccctcgcctccggcagcgaggtgaggccaccgatcggaccttccctagcggcggcgcctaccaacctcaaggagcgatggctctgtctgcgacgctacggatttctcttagcgtcgcgttctttggggttctggcgttcgtgcttggtgtcatcgccgaaaacaaaaagcctgcttccgggactcctatcctaggaaaggatgtcgtcatctgcacgtttccaagtgatccgactcttgcgatggggagcctgtccattggggcacttgtggtagctgccatcgtatgccatgttgccatcttctttccatacttgggcaagtcagttcctcgtggagcgctgtttcaaagcaccagcttgatagtgttct

SEQ ID NO: 50558 - DNA, 451 bp, Zea mays
  Clone ID: LIB3067-013-Q1-K1-A2
cggacgcgtgggctacatcatcttcattaaaggtagctagcaagatatggtttatttatttcaagagttagagggcaaggatacgatggagcctcaaatatgagagggcagtttcatggattgcaaagattggtattggatgaaaacccatatgcattttatattcattgttttgctcatcaattacagttggtggtagtttctattgccaaatgttgtgactcagtatatgatttctttaattacatcttattgattgtcaatactgttagtgcatcttgcaaaagaaaagatcttcttcttcagagacatcatgataaaattgtggaagaattagatagtggtgtctatattttctgggagaggaaaaaaccaagaaacttgtctcggcaggtcaggggatactaagtggggcccacattataagacattggtgcgtatctttttatgt

SEQ ID NO: 50559 - DNA, 229 bp, Zea mays
  Clone ID: LIB3067-013-Q1-K1-A4
aagaagcgtctatgagatgtttgcattcagatttaggatgaacgcactcgtctatcaagaccaggatatcgtacaccaaaacactactactcgtcctagctcatgtggatgcctgactgtttacagggatctatacagcatgtgatcccgtactatcgccgatcttgtaggagttcttgtattcgactgattgcacttgattgattatctctcatctactgatgctgct

SEQ ID NO: 50560 - DNA, 257 bp, Zea mays
  Clone ID: LIB3067-013-Q1-K1-A5
accagccctttttttcctgtcagcaactacccactggccactgcagccgagtgttcctttctagccttcacttctcagcacggcagccttcgatcccccgactgcagccgccagccgcgccatggagcaagcagccatgccgcaggttccccgcgtcaagctcggcatccaggggcttgaggtgtcgaagctggggttcgggtgcatggggctcacgggcacctacaacgcgccgctcggcgactaggccgtggccg

SEQ ID NO: 50561 - DNA, 229 bp, Zea mays
  Clone ID: LIB3067-013-Q1-K1-A6
cggacgcgtgggtggaaaactttgttgatgtaaagaacattctcgttgaaatgggaacatactttcaagttcaggatgactatctagattgttttggtgatcctgaattcattggcaagatcggaactgacattgaagactacaaatgttcctggctagttgtgcaagctcttgagcgtgctgctgagaaccaaaagagcattctgtttgaaaattacggaaagtctga

SEQ ID NO: 50562 - DNA, 446 bp, Zea mays
  Clone ID: LIB3067-013-Q1-K1-A8
cccacgcgtccgcggacgcgtgggcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcgcctcgttattataggggccgctctccttcacgcagtcaaagctactcgaggtctccaccttagaatccatgacacagacttagagagaggtcctactccggctcacctgtggacagcagatcaag

SEQ ID NO: 50563 - DNA, 363 bp, Zea mays
  Clone ID: LIB3067-013-Q1-K1-A9
gaatgccagcagcacaaacgcatcggaactcttcaaagaagttgcatattcttatagcatctggtcagatcctgagaaaagaaggcagtatgatactgctggttttgaggagttagaaaatgaaggaatggatatggaaattgatttgtccaatcttggaactgtgaacacaatgtttgcagcactttttagcaagcttggtgttcctatcaagaccacagtatctcctactgtgctggaagaggccatgaatggcacagatacagtgagaccactccctgttggaacatcagctactggataggttgatatgcaatgctcttatttttttggcgtaacaataattgaagagcaagctcattc

SEQ ID NO: 50564 - DNA, 315 bp, Zea mays
  Clone ID: LIB3067-013-Q1-K1-B1
caactcccaaggtcccttttttttctcgatctggaagcgttgcagtagcagccatggacgtgagcggagcatgcgggaaggcgaagaatggcgcggcggggcgcaaggccggcgggccgacgaagaagtcggtgtcgcggtccgccagggccgggctgcagttccccgtcagccgcgtcgggcggtacctcaaaaagggccggtacgcgcagcgtgtaagcacgggtgcccccgtctacctcgccggcgttctggagtaccttgcggtcgatgtgctcgagctcgccggcaactcggcaagggacaataagaaga

SEQ ID NO: 50565 - DNA, 243 bp, Zea mays
  Clone ID: LIB3067-013-Q1-K1-B10
gacactcgaacatactcgtgagaagataacatacctcttgtgataacgatatcaaaatcgtagagctttgctagctgaaggtcgatgaaccccaggtaggaatagaatgtaccgcggcagacatgcgatctggaaaacaacattggcttggtatcctccgactatgactcgatagacgaaatctatcagtactacgactcttcttacgctcaggcgctacatgagaagccttgatccaactac

SEQ ID NO: 50566 - DNA, 468 bp, Zea mays
  unsure at all n locations
  Clone ID: LIB3067-034-Q1-K1-B8
cccgggctcgactccactgcgtctcgattgtttggccatganngtcctcgtcagaatacccttcanngtgttggaccattctactnnngatacaacgtgagcgagcatttgctgattggggcgctatgcaaggggcatcnnaaatgatatatgttcatcatagtattttagtaacccatntngagtaattcaatttctgttgtcacgtnncatgtatgtgactgannagtgtaaatttcttccttagctgggctcagagtgaagnnntttgttgggaatgtaaaaattagttttaatcgacatactgtggatttgggtttcaattccaatccaaaccctggtagtgtgccttcaaatttagtgctgtactattaagtttaaagttattattaatgtgaatattaaatatcaattttctgataaattgttgcctctgttgatacacttatcaaatagttaaaatggata

SEQ ID NO: 50567 - DNA, 348 bp, Zea mays
  Clone ID: LIB3067-034-Q1-K1-B9
cccacgcgtccgagggcgtctgagactctgagacacaggaacagaaccctctctgcgcggccgccgccgttgcagtcgcggccacatcgtcgcctatccatccccaccgctcccactgccacgattcacaagaggtgtcgagatgtctcagaacaacccctcccagctcctcccctcagagctgatcgatcggtgcatcgggtccaagatctgggtgatcatgaagggggacaaggagctcgttggcaccctctgcggctttgatgtctacgtcaatatggtgctggaggacgtcaccgagtatgaatacactgctgaaaggcgccgcattacaaaacttgaccagat

SEQ ID NO: 50568 - DNA, 389 bp, Zea mays
  Clone ID: LIB3067-034-Q1-K1-C10
cagtaaagatatacctgaaatcccagacagtttctcagaggaagggaaaagtttcttgcggctttgcttgaaacgtaaccctgcatctcgtgcttctgcagtccagctgatggatcatccttttgttcaggatcaccctgcagtgagagctgcaaaatccagtgtattgagaaacacaccatcttctccagcagatggcagacacacaatgtccaacagggagttgccatctcggaaaattataactcctctgaaggatattggactgggcatgagagattttactggattttccactactgttccttcaccacacagtcctattcctggaagagcaaacatgtctacgccagtttcaccatgctcaagcccgcttcggcagtttaagc

SEQ ID NO: 50569 - DNA, 330 bp, Zea mays
  Clone ID: LIB3067-034-Q1-K1-C11
gtacaaggaccagggttttgagatccttgcattcccatgcaaccagttcggtgggcaggagcctggcactaatgaggagattgtccagtttgcttgtactcgcttcaaggctgagtatccaattttcgacaaggttgatgtcaatggtgacaatactgcacccatttacaagttcctgaagtccagcaaaggtagtctctttggcgataacataaaatggaacttctccaaattcttggttgacaaagaggggcatgttgtggagcggtatgcaccaacaacttccccactgagcatcgagaaagacatcaagaaactactaaggagttc

SEQ ID NO: 50570 - DNA, 392 bp, Zea mays
  Clone ID: LIB3067-034-Q1-K1-C12
gctggcaatgctgataagaaggtgcaagagctaaatatgaagctggagaagctccagaggacaagcagtgatcaaaagcgcaggattcagaagactgaacatgctcttaaagctgctgaggaggagctgatgaaggctcagttggaaacaacaacaaaagtaaaacagcttagagaggttcatggagcctggttgccaccatggttagcgacacatgcagcccgctctatggaggtgatgtcaaatcactggaatgaacatgggaaacctgcctttgacagcttcttgcagaaggcatctgaaaaaacagtgcagacaaagaaatgggctgagcctcatctggaaactgctaagacaaaatggatgcctgttgctaaaagaaaaatgggtta

SEQ ID NO: 50571 - DNA, 372 bp, Zea mays
  Clone ID: LIB3067-034-Q1-K1-C4
cccacgcgtccgatttattggattttggcggcaggtacattcaaagcacttgtgctacaacgggtgagggattgtatgaaggcctggactggctgtccagcaacattgcaaccaagtcctaaattgtcaagcgaggtttggatcatctaggagcttttggatgatgatgatggtgctggatatttagggttgggttggtatttccgtatgtaagatgtatgcccctgagctcggcagtttttgagctctgcttaagattctcacagttaaattgttttatgtaatttgggccttgagatgtttttgaaccaaacagctaaaagagttcagttgagttaactgggtgccattattacattatgagattctttg

SEQ ID NO: 50572 - DNA, 296 bp, Zea mays
  Clone ID: LIB3067-034-Q1-K1-C5
cggacgcgtgggcggacgcgtggggtgagcctgctgccgtcttcttccgccgccgtctgcgtccgtagagcagagcagatcagagagcggggaggaagaaaaaccgatcgatggcgtccaactacgtggacacaacgggcgaggagggacggttccacggccctcacagccacagcaccagcacgaccccgacgggcggcgcggcggcggcggcatcgccgcgcaacttccggcgcagcttctcctccgcgtcctccgcgggccacagccacggcggcggcggcggctgtgccaag

SEQ ID NO: 50573 - DNA, 439 bp, Zea mays
  unsure at all n locations
  Clone ID: LIB3067-034-Q1-K1-C6
cccacgcgtccggagatgtgctcctatcacaacaataatcggttcagtttacctgaagagcctgcacttcagcgatcgttgcagcttgctcttaagtgtaaggatgagcatgatgcaaggaagcgagcaagtggagatgctgatgaagatgatcaaagtgcagacactgataatgaagaagagaatgatgatgagcatcccatcacgcatgccaataaggggaccctactcacgcgtaaaagattgcggtacatgccggcggatatggaggatgtaggtttcggcaactcttccagctcacatgactgtagctggagatctgatccncatagcattgcagtggacatcaacaaagcttctccagatggaactaacttggctttcngttcaaaaagacttggctacacagtctgcngagattgagaaacagcgcatggaa

SEQ ID NO: 50574 - DNA, 372 bp, Zea mays
  Clone ID: LIB3067-034-Q1-K1-C7
gcttcctattattttatacataggcctttcctaattatctcagtcacctaaaaacaatgcatatctagttcgtgtcatgatacggattccggagttcctgaatgccggtgaagagttgtggggttgtgacatggaggtgttcacgaagcagtagagcctagagtagaggaggaactgaggaaggtacagggacaaagtagctatccaagaggttgctgcctgatggtgacgtgaacagtgaactgcagcgatcgaaaatgttggccgttcgaacaccacaagttttttttttttgcttgatcaaaaatgtttccttcttgattggatgcgaatacgtgattctgtgcgctacaagcgtcatcggaggcccat

SEQ ID NO: 50575 - DNA, 305 bp, Zea mays
  Clone ID: LIB3067-034-Q1-K1-C8
cccacgcgtccggcggacagtgctggatgcacctgaggatatatatgcatacctgctgtgcttgttgttcatgtcgtcactgtgacgagtccgctgctgatactgcacgtgcgtactctatgtatgtagctgtgtaataaagttcaggggatgtaaattgacactcctaccaagtatgctgatgtatgttctcatgcgtgtcggggtttcttatacatggtttgtgttagatttagtatgaagatgacctctattttatttgatacaaatcgaataaattgtaggtttatattaaaaaataataa

SEQ ID NO: 50576 - DNA, 353 bp, Zea mays
  Clone ID: LIB3067-034-Q1-K1-C9
cccacgcgtccgcccacgcgtccgactggatgtgtagtcctttttcctgttgcagtcaggttcttcatcacatggtggtttattcaatttgttgatgggtttttcagtcccctatatgcaaaaattggaatcgacatatttggtcttggttttttgacttctatggtattcatatttctggttggaatatttgtttcttcatgggttggttcaaccatcttctgggtgggcgagtggtttataaagaaaatgccatttgtaagacatatatattcagcatcaaagcaagtcagcactgcaatttcaccagatcaaaatacgactgctttcaaagaagttgcaataattcgtca

SEQ ID NO: 50577 - DNA, 312 bp, Zea mays
  Clone ID: LIB3067-034-Q1-K1-D1
aaaactaaaacgagcagcgcatgcatgcatctaccgtccggtttcgtctgaaaccatcattgatttcgatcgtccactccacgcacagcaagttctttacggaccttgccgcatatgatatgtacatggtgacaagataaggtacaggagaattgatgaaagaagcgttgccggccagtcgtcgttgcacgagaacaaacacataaattaaaacattattacaggagtagggtatttattgtattgttcaggccagaaaaatatgtggaaagtgggtctttaacttaattcggaagaagcatatagcactcc

SEQ ID NO: 50578 - DNA, 322 bp, Zea mays
  Clone ID: LIB3067-034-Q1-K1-D10
accacgcgcacgcccacgcgtacgatcgagtgccgacgacttggcaatcaccagcagcgacgacatggcggccaccagcagcaagcagccggcagccgccagaccggtgcagggcgcagccgccgcactgctcgtgatcgccgacgtcgcggtgtccgtgctcgacatgagcaccgagcaggtgagcgacatgaacaacgagcaggtcaagacgagccaccccgcggccgccacgacgacggacccctccgacgcgccggcgcaggcgtaccgcaactcgctgtccggggccgacaacaagtgccggatcggctacaacaac

SEQ ID NO: 50579 - DNA, 357 bp, Zea mays
  unsure at all n locations
  Clone ID: LIB3067-034-Q1-K1-D11
ngaagaggacctctcatgaatcaaatttggaaggaagaattgtcaacgtgtcatcagaggggcacagacttgcatatcgggaaggaatccgttttgacaagatcaacgatgaatcagagtatagtagcattggtgcatatgggcaatcaaagcttgcaaacatattgcatgctaatgaacttgccaggcgatttgaggaagataatgtcaacataactgcaaattctcttcatcctggttccattatcacgaaccttcttcgctaccacagtatcctagatgttctccatcggacgctgggtaaattggtgctgaaaaatgctgagcaaggtgcggcaactacatgctatttggcac

SEQ ID NO: 50580 - DNA, 372 bp, Zea mays
  Clone ID: LIB3067-034-Q1-K1-D12
cggacgcgtgggcggggggccacatcaaccccgccgtcacctggggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccg

SEQ ID NO: 50581 - DNA, 341 bp, Zea mays
  Clone ID: LIB3067-034-Q1-K1-B3
agcaggagatagcgcgggcggtgaggggaaggagacaagtgaactcagagaagaactagcgcggcgagcattgcaagccaagctgcaggggtccggagcggagaccggaggagggagacgtcgcttgcgatgtcaccggcagcatccgccgccgaaaccatcgtcgtcgcaatcgcaagcgtcccgagccagcagcagagcagccaccgcgccgcggcgccgtccgtcccgtcgtcctacgccgtctgggagaaggagcggtaaggcgtctgcagctttacgacgtcgtcgtcgtcgtcgtctgccacctacctactgctgctgctgctgcaaggggaagt

SEQ ID NO: 50582 - DNA, 427 bp, Zea mays
  Clone ID: LIB3067-033-Q1-K1-H5
gtggtggtggtggaagcggtgggggtgggagtggagggggtggatcgggtggtgggagtggaggcggaggatctggtggaggcggcagcagcggtggaggcggcggatctggtggtggtggaagcggtggcggcggcggatctggcggcgggccgacgagcggtcgttgccccgtggactcgctgaagctgggcgtgtgctccaacttgctgaacaggctgatcaacgcgaccctggggactccgtccaggacgccgtgctgcacgctgatccaggggctggcggacctgtaggcggcggtgtgcctatgcaccgtcctcagggccaacgtcctgagcatcaacctcaacctgcccatcaacctcagccttctcgttaactactgctgcaggcgcttacccctcggcttacagtgcttctgactatt

SEQ ID NO: 50583 - DNA, 424 bp, Zea mays
  Clone ID: LIB3067-033-Q1-K1-H6
cacagtcacaaaagaaacgatgtccactgtcgaactgacggctccgtcatgcggcgatcgataaaaatgccgcgaggccaccacgcgagacgaacgcaaacgaagtgcggaaaataggcctcttttttcttcttctcgtagagatatttcggaagagggagtgcgtgccttcctctcagctgattcgccgaggacacgagatcctctagagggttgtgctgtttggcgtgaggctttaggggcgatttgctttgctcgcatgggggatcatgtcgctgtggatgttggggagctcgttgcgtcccgagtcggtgaggcagcggggctattgtccggcggcaaggaagaaacgaaggcgctggctgggatggtggagtgccgcatttgccaagaggaggacctcgcaaagaacctcgagagcccc

SEQ ID NO: 50584 - DNA, 366 bp, Zea mays
  Clone ID: LIB3067-033-Q1-K1-H7
gtcggcttctcctcccactacggttcgggttcgggttcgtgaggttctacggggttcgggttcgtgggtgagcggatcgagatggcagcatcagatgttgagtaccgctgcttcgtccgcggcctcgcctgtgccactgacgaccactccctccacaacgccttcagcacctactgagaggtcctcgagtccacgattattctcgatcgggagactcataggtcccgcgacttcggcttcgtcaccttctccactgaggaggcgatacagaacgccatcgaaggcatgaacggcaaggagctggacggtcgcaacatcaccgtcaacgaggcccagtcccgcggcggacgcggaagctgcggctgc

SEQ ID NO: 50585 - DNA, 390 bp, Zea mays
  Clone ID: LIB3067-033-Q1-K1-H9
gtcaaccttgatcaaggctatggaggaagctgatgtgaagacgaagtgggagaacagctcatggtgcaagaagctgattgtccagaagaggagggctgcgctcagtgactttgacaggttcaaggtcatgctgtcaaggatcaagaggggtggtgctatcaggcacgagctcgccaagctgaagaaggcgttcacggcttaagtccattttggtggatgacatgtcagcttctggtttcatgttggatcagcaatctgttttgagtgttgtcaaagccagaatcagtaatatgttctctgcgtacccgttctaaacttcatcaagaatgactgtgctctggatatttcgtcgggacatgatatggaacacttaaaagttcgctgtcaaaa

SEQ ID NO: 50586 - DNA, 238 bp, Zea mays
  unsure at all n locations
  Clone ID: LIB3067-034-Q1-K1-A1
atgtcgcgcctaatgaacgagcccgtagatcttgtgttcttgtggctggttttgttggatcgcgatctcggttacgtttacatgagtcttgctgcctaacatacatctgtgttctttttctaggctgagagaaactnaactgatcgagtctgtctggcaggcatcgatctatccagtcgtcagttcgtcacatccgctttttcgtatatatcatcttcagatnttgttcatctgtcaa

SEQ ID NO: 50587 - DNA, 347 bp, Zea mays
  unsure at all n locations
  Clone ID: LIB3067-034-Q1-K1-A10
agaagaccgagggcaaagangnggannccagaactgncggggaaaacaacagagggaagagancngcngccagaagangggangncaacaanncagcaaagaaggcgaacgngggnaccacaacnggancaacagcctatgaggaaannnctggcttttcacaacacacactgcagtcatttacagtggagagattgcgtgcacttctacgacaaagtggtcgatcgaccaaaggcaaaaaggatgaactgattgctcgcttacgggagtcgcagggttgacatgaatctggtacttgtttagtcaatcaaaccccttcaggctagggttacacgaccaaatgagta

SEQ ID NO: 50588 - DNA, 169 bp, Zea mays
  Clone ID: LIB3067-034-Q1-K1-A11
gtctcgttcaacgtctgcgcgcatggtgtgctcctgtaaataaacgtctgagtctgacgaactgacaatagattattgaccgcagccaaatctattgtgtctctggccaaataaatatttaatcacaaagaattctataactcacaaagtctaaagctgttttgttacg

SEQ ID NO: 50589 - DNA, 350 bp, Zea mays
  Clone ID: LIB3067-034-Q1-K1-A2
cccacgcgtccggaaacttaagcgccgcattctaccaagtgatattacaataaatattggaaaaggagctccagtccctgagtgcccgatacctggagaaagttggaaagaagtcaaacatgacaatactgttacatggttggccttttggaacgatccaattaacccaaaggatttcaagtatgttttcctggcagcaagcagctcactgaaggggcaaagtgacaaagagaagtatgagaagtccagaaaattgaagggtcatatacaaagaattcgtgagaattatacaaaagatttcaaaaacaaagatgtgacgaggaggcaaatagctgtggcaacatacctta

SEQ ID NO: 50590 - DNA, 297 bp, Zea mays
  Clone ID: LIB3067-034-Q1-K1-A3
gggacacagtcacgcagcagatcagagagtctgcagtcgctgcgatctagctgcggtggctggtcagtacgtagtaccatggcaaaaagtggcactctgctggccctaacctcctcttttcgcttcgcgacgcatgcggctgcaggtgcggcggatcctgccctagtccaggcggggtggcggtggcggtggagatctggggtggtggtggtggaagcggggggtggagtggaggggggtcgggtggggagtggggcggggatctggtggagcggcagagcggtggggcggggatct

SEQ ID NO: 50591 - DNA, 214 bp, Zea mays
  Clone ID: LIB3067-034-Q1-K1-A4
gccgctcgaccgccgacacatcagcgcacacgtgggccaacccctccgcaggcgaggaggcgagcatcgcggataccgagcgggacgtgaaggcggaggatacggagaccgacgacgccgtgacggccggcgtcgataccgccgtcgaggccgacgttacgccggcggacgcggttacggccatcatgcaatcggatgccaaggtctcaaccga

SEQ ID NO: 50592 - DNA, 378 bp, Zea mays
  Clone ID: LIB3067-034-Q1-K1-A7
cggacgcgtgggcggacgcgtgggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgct

SEQ ID NO: 50593 - DNA, 417 bp, Zea mays
  Clone ID: LIB3067-034-Q1-K1-A8
cccacgcgtccgcccacgcgtccgcccacgcgtccgcccacgcgtccgctgtcctgtcggattctgtcgccctatacagtgacgcgatgaacatcttccgtaagaaggaagtggcctgatctcagatttcaaaagtagtcagtgctggatgaagaatggtctcgcaatgcaagactcgatggtacgaaggaaaacgatgcgcttggattccgtgaaggaacgatttctttgtcagcacctcagaatttggccacttgaaagaatctgatgcttgaagtttcctggttctgtgtacacaagtcggctcaatgtcagaattgagccgcttgaaatatatttagttatattctatgcggagagtaagtcttggaaacagccttttccacaataatgtacagttattatgccaatttctga

SEQ ID NO: 50594 - DNA, 403 bp, Zea mays
  unsure at all n locations
  Clone ID: LIB3067-034-Q1-K1-A9
gnaggagaggcggggagggggaagaaggcganagccggggagganggngcnngngctggcgctgggggatctgcacatcccgcaccgggcgcccgacctccccgccaaattcaagtccatgctcgtgcccggcaagatccaacacatcatctgcactggcaatctctgcatcaaggaagtccatgactacctgaaaagcctttgccctgatctccatattaccagaggtgaacatgatgaggatgctcgatacccaaagactaagacacttacaattggtcagtttaagcttgggctgtgccatggccatcaggttgttccatggggcgacctggactccctggcgatgctccagcggcagctggacgtggacatcctggtgaccgggcacacgcaccagttc

SEQ ID NO: 50595 - DNA, 377 bp, Zea mays
  Clone ID: LIB3067-034-Q1-K1-B1
cccacgcgtccggttttggggcatgtgtgctaccacatcatagctgccggattgaacggttgcatggctacggtgacaaatcttaagaatccagtgaacaagtggcgatgcggcgcgactcctatttcttttatgatgactgtgaagcgatggtcgcgtggcccttcagccacccaaattggaaagcccgctgttcacatggctagcgttgacttgaaaggaaaagcatacgatgtgttgagacagaattcttccagctttttgttggaagatgtctacagaaacccaggcccgctccagtttgaaggaccaggtgccgattcaaagcctatttgattgtgcgttgaggatcaagactatatgggcatgaataaaaa

SEQ ID NO: 50596 - DNA, 166 bp, Zea mays
  Clone ID: LIB3067-034-Q1-K1-B10
cccacgcgtccggacttcattgtctttcggatcggagagggtgtacgtacgtggattggttgatgctgcgagatgcatgtgtgtcttttgtttcacgttgcattgcataggcaagtcgagatgatgagttggcgttgtacactaagatgaaccatgtttgtgcaat

SEQ ID NO: 50597 - DNA, 365 bp, Zea mays
  Clone ID: LIB3067-034-Q1-K1-B12
cccacgcgtccgcccacgcgtccggtcgggggaagctccggcgcctgcctcgagatgggcatgcgcagggtccccacaatcaccgagggcatcaacttcgacctccccgacgtcgtcgccgcagcgccgcccatcgccggagtgaggcatgttggcggagatatgttcaagtccatcccctccggtgatgccattttcatgaagtgggttctgacgacgtggaccgacgacgagtgcacggccatcctgaggaactgccacgccgctctgccggacggcggcaagctcgtggcctgcgagccggtggtgccggaggagacggacagcagcaccaggacgagggcgctgctggagaacgacatctt

SEQ ID NO: 50598 - DNA, 354 bp, Zea mays
  unsure at all n locations
  Clone ID: LIB3067-034-Q1-K1-B2
cccacgcgtccggactagttctaaatcgctctctgcccccgatcaccggtcgcctccctgtggctcccctgcctgcctaatccctccggccaccccgaaaccgctcgctcgctcgctcgctccccgcgcccagagacaagcccggagaccatggcggaccagctcactgacgaccaaatcgccgagttcaaggaggccttcagcctcttcgataaggacggcgacggttgcatcacaaccaaggagcttggaactgtcatgcgttcactgggtcagaacccaacggaggctgaactccaggacatgatcaatgaggtggatgccgacggcaatggcacgatcgacttncccgag

SEQ ID NO: 50599 - DNA, 398 bp, Zea mays
  Clone ID: LIB3067-033-Q1-K1-F7
ctccactcgtccgcggacgcgtgggaaaaagggcggcacaacagaatacacacctcgaggggtaattctgctgcatgttgaggtgcctacatgacaagtctataatagcataggacgctgagattctcatggtctgatgcacatcctgtaactgaaggtcagatgcacagattctacagtgagcactgcattctggtgactctgtgctcattaagcgaacctgaatcatgcatataggccaaagattttacacctacagatagcactggagcattccaattgctggaagatcccataaaacctaaccaatgtccatgcttacaccataggctattttcagctgtgaatcttatgtcaagactaagtcatcctaggagcactttattgccccatgtgct

SEQ ID NO: 50600 - DNA, 417 bp, Zea mays
  unsure at all n locations
  Clone ID: LIB3067-033-Q1-K1-F8
cggacgcgtgggcggacgcgtggggaacccgcgcgacctctctcccgagtctactgctgtgcccggccagccccctcccctgttttccttcccatctcatcacaagcagaagaaaatcgagataacgagagctagggttttgattccagtactcacgccgcatcctgtctccttctgcccctccctctcggcaccgtcttcgtcccctcattctctctcgcgtcatccggcggaggctcgaggaaactgaggccgggagcgccccgaagaatattctccacccagtcgccgacacccctgcgcgcgcgagagttaccattgtacttgtgtagcttggcagttggntgactgtgtgacaaacttgagctatgtcatattacgaaagaaagggtggagacaggggtagtggccgtattc

SEQ ID NO: 50601 - DNA, 431 bp, Zea mays
  Clone ID: LIB3067-033-Q1-K1-F9
cagttagaactgatgtcagctcaagcttctgagcttcgcctgactgtggcatcactggaagagagagttcaggctgaaagaaatatttctatgcagcagaaagaaaacgcagaagctatgttgagtactaaagaagaactggaagcacagctgtgttcagcaaccactgaaatggggaaactgcgtgacatggtcaaagcactagagaatgaggtcaaaacggagaaggcactgcatgaagaactaacagcacatatacagataaaggttgaagcagctgttgatgcagttaaagaaccattggaagcacaactgtgttcaacaaatactgaagcagagaagctaagagatgttgtcaaagcacttgaggatcaagtagaaaaagagaaggcattgtgcgaagagcttgcagcaaaggtagagttgaaaac

SEQ ID NO: 50602 - DNA, 419 bp, Zea mays
  unsure at all n locations
  Clone ID: LIB3067-033-Q1-K1-G11
cggactcgtgggcggacgcgtgggcttgcacgttcaattggcctgatcgggcacaccttcgaccagaagaggcttaagcagccactctaccgccacccatgggaggatgtcctgtacaccaagtgagatagagccattctttgcaaagcataaagtattattgccgcttagggctttcagctgtctgtacacttcataaatcgagcagttgcaaaaaaagctcgaaattgtgattgttgatgaagttaggggcagggggagagacatcgaggggaggcactactagattgtgtgttttgtgtcgagtcgtttcacgatatacggcctcagaatagaagttccctttgaaatgaagtaacgctcgctgatttatgagttgataaacataattgagaagcanaatgatggatcttggaaaa

SEQ ID NO: 50603 - DNA, 426 bp, Zea mays
  Clone ID: LIB3067-033-Q1-K1-G12
cccactcgttcgggaaaggagaagaacattgctgtcattgttggcacagtcacagatgacaaaaggatccaggaggttccagcaatgaaggttactgccctgaggttcacggagacagcaagggccaggattgtcaatgctggtggcgagtgcctcacatttgaccagcttgctcttcgtgctccacttggcgagaacactgtcctcttgaggggccccaagaatgcccgtgaggcagtgaggcactttggcaaggctcctggagtgccgcacagccacaccaagccgtatgtgcgctccaagggaaggaagttcgagaaggctcgtggcaggaggaacagccgtggattcaaggtttaaaacaaattgtggccctccgtgttgccatcagcatagtgcaaccgttgtgtttgatcagtcgacagt

SEQ ID NO: 50604 - DNA, 411 bp, Zea mays
  Clone ID: LIB3067-033-Q1-K1-G2
cccactcgtccgcacatatcttttagtaacctttcaataggcgtcccccaagaactagtgaacatggcaaaactgttgagcctgttcttagccctctcctttgtagcagctatgtttgccataggctctcatgctgatggagactgtgagaatgacctccaaagcctgataagtgactgcaagacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaagaggccatttgagcatggcttccagtgcggaagcttcaaagttccagcaaactgatgatatcacaag

SEQ ID NO: 50605 - DNA, 437 bp, Zea mays
  unsure at all n locations
  Clone ID: LIB3067-033-Q1-K1-G3
cccacgcgtccgcccacgcgtccggacccacgcgtccgcccacgcgtccgcccacgcgttcgtgttgaccatgctgttgagcttgcgcactttgccctgttctttaaccagggacaatgctgctgcgctggatctcgcacgtttgtacatgagcgtgtttatgatgagtttgtggagaaggccaaggctcgtgcattgaagcgcgtcgttggtgatccgttcaggaaaggtgttgaacagggcccgcagattgacgacgagcaattcaaaaagatcttgcgctacattaggtatggtgttgacggtggagctacccttgtgacgggtggtgataggttgggtgacaagggtttctacatccagccaacgattttctcagatgtccaggacggcatgaagattgctcangaggagatatttgggcctgtgcagtcgat

SEQ ID NO: 50606 - DNA, 438 bp, Zea mays
  Clone ID: LIB3067-033-Q1-K1-G4
cccacgcgtccgagaccacagccagtcagccacatcactagctagctgtgcagaggcaatggcgtccaaggttgagctggtggtggaggtcaagtccccggctgacaagctgtgggcggcgctgcgcgactccacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggctgacgacgagaacaaggtggtgtcgtacagcgtggtggacggcgagctggcggacttctacaagaacttcaagatcacgctgaaggtgacttcggccaatgccgacggcgagggctgcgccgtcgtcagcttggccatggagttcgacaaggccaa

SEQ ID NO: 50607 - DNA, 444 bp, Zea mays
  Clone ID: LIB3067-033-Q1-K1-G6
gatgcctgtgcgtccccgtgcccctcgccagctgatgtcgtcctaggatctcaagccatgttctggacctcacaagtccagggagtgcctgcctctgatcctcattatcaggaacatgctcaagtatgcactgacgtaccgtgaggtcatttctatcctgatgcaacaccatgtacttgttgatggcaaggtcaggactgacaagacctaccctgctgggttcatggttcaagctctgcaaggtgaggtttgttcagtttggccagaaaggcatcccctacatgaacacctatttgttgtacaggaaaacatagaatggaattcaaatttggtggccgcaaaagtgtggagacttgaattcatataaagttaggcttaacattagtgcaaacagttgtattttagtttagatttagagtacacttatgtatgcgttgtttgaca

SEQ ID NO: 50608 - DNA, 383 bp, Zea mays
  Clone ID: LIB3067-033-Q1-K1-G9
aaaaaaaaaaaaaaaaaaaaaaaattaatttaaaaaaaaaaaaaaaaaaaaaaaaagaaggggaaaaattaaaaaaaataaaagaaaaaaaaaaaaaaaaatacaaaaaaataaaaaaaaatataatatagggccggcctttttaaatgtcccagctttacttccccttccttccgacttattacttcttttttgttgccccctaatttaatttcctggcccgtctttttccaacttgcgtcctggaaaaaccgtgggttccccaaattttttccccttgctgcacttccctttttgtccaacttactttatctttatcggccctttaccttttgcccttccaaacatttcccccaccttattgcctaatggtcccccccctt

SEQ ID NO: 50609 - DNA, 325 bp, Zea mays
  Clone ID: LIB3067-033-Q1-K1-H10
gcctttagctaagattgtccatatgttgttctcgagcagctatgtgttgcatgtcggctacttccaaacttatatctggtttggtttggattgtgatgaactaatggctctttgaatgtatattatgatgttgacgatattcggtgaaaaaagaatatcaagcaaaaagctcaacaaaaaagaaaaaagcaaacaaaggtaaagcgcactagggtggccgacctgactgccgcttgcttgctacggcatcactcttctatggtagcacgtaaacagagtcacctagacgaatatgtacaccgtattcactggccaaacttcatcg

SEQ ID NO: 50610 - DNA, 432 bp, Zea mays
  Clone ID: LIB3067-033-Q1-K1-H11
cccactcgttcgattgattcactgtctcttacatttagtattgacttgatgactagggcaggatctgcttgctatttgaaatggggggcatgtgaaagcttgctgcacttgcaagatggtgcacaatcctggatcgtcgaataacaactgccgcctggacagcagtagcaaacaccttcggatattgctccctttttgcaggcctgtttctcgcatttgcagaaacgaacaacgttccgagagtatgcaggaatcatcaaacttcctaggatcaccatcaagagcaggacagccttgcttgcttccattgtaattctcgccatataaggattttttttctcaggagccgtgtgcagtgttgttgtgcttcatgagggtcttgtgcttggccgtgtcggaggctgcaagaatccctactgtactttttttctt

SEQ ID NO: 50611 - DNA, 433 bp, Zea mays
  Clone ID: LIB3067-033-Q1-K1-H12
gtctccgccgccgaggccatcgcgcgcttcccccacccgtggatgcgcgaggcgctgcagcggttctccgacaccgtcgcggtcgcggcggagacgatgcacctcgcctccgccctctagctctaggcccggccggccgtcgatcgcttgcctcttcccgccgcggtctcgtcggaccgcgggcggcctcgcgcgttttttcggccgccgcgcacggacgcggcgcgtgcggggctgccggcgtctgctctgctcgctggattggacggaacacgccatcattgagtcagacaaatctggacgtcgacgagctgtggcaccaggacgcggcctgtacattgatcttgggggggcctcgttgtgaaacacaaacttggaaatgtcacggagcttaacgagatccactgtggtactctactagcatacaatacac

SEQ ID NO: 50612 - DNA, 443 bp, Zea mays
  unsure at all n locations
  Clone ID: LIB3067-033-Q1-K1-H3
cggactcgtgggggaaaacaacaatataactggcgatgtctcttctctgatgaactgctggagcctcaatatcttaaatgtgtcatacaataatttggctggtgctgtccctactgacaacaacttcacacggttttcacatgacagctttttaggtaatcctggactctgtggatattggcttggttcttcatgtcgttccactggccaccgagacaaaccgccaatctcaaaggctgccataattggtgttgctgtgggtggacttgttatcctcctgatgatcttagtagctgtatgcaggccacaccatccacctgcttttaaagatgccactgtaagcaagccagtgagcaatggtccacccaagctggtgatccttcatatgaacatggctcttcatgtncttgatgatataatgaggatgactgaaaacttgagtg

SEQ ID NO: 50613 - DNA, 274 bp, Zea mays
  Clone ID: LIB3067-033-Q1-K1-F6
gagaaaacagtgcccacatatgccttagtttttctttttcgcgtagaattttcttgatgagttcttcttttgctgttagagtgggtgcttgacaagttgacacttttttcgagagctgaaaatattagcttttgctgtacattctgtaaatttttccgttgactaggattcttctttgtacgtaacattcagctaactttttgtacatcaagcgaacccagaaaaaaaaaaaaaaaaaaaaaaaaaaaaaaaaaaaaaaaaaaaaaggcaaaaa

SEQ ID NO: 50614 - DNA, 224 bp, Zea mays
  Clone ID: LIB3067-011-Q1-K1-G7
attttcgtgctaatggtgatatagcactggcatttggggtggactttgagaagtatgggatcggtgcaatgcctatgcagctaagtgctgcagattagtcggctccataccacatgcaactgatgatgatactctctactacaccaatcatcaaagaaatggatatctgtgaaatcctattcctatattcagcattgtattaagagttcacctataacacaact

SEQ ID NO: 50615 - DNA, 56 bp, Zea mays
  Clone ID: LIB3067-011-Q1-K1-G9
tcgcttcatgtcaaattggggtgctttcttggaagttatccataagaagagagctg

SEQ ID NO: 50616 - DNA, 327 bp, Zea mays
  Clone ID: LIB3067-011-Q1-K1-H1
cccacgcgtccggtgtagttcggagcgggcagtaacacacagccccatcccaatcctcgacggtcttggtcccctcctcaagagaagaagctgaaccatggggaagagaaagtcagctgctaagccaccttctaagaatcgtatggacaagcttgacactgacttttcctgcccattctgcaaccactggagtcgtgtagagtgccgaattgacatgaaggaatctgattggcgaagcatcttgtagaatctgtcatgactacttcagcacaactgtttatgcgctcactgagcctattgatatatatagtgaatggatagatgagt

SEQ ID NO: 50617 - DNA, 192 bp, Zea mays
  Clone ID: LIB3067-011-Q1-K1-H12
ttcgggctttgcttagttccttcctctctctagatctcgcctatacaacgaccagcggagggtacgtggttggagatccaagaagcgtaagaaatggtagcccacattgcatccgagcatgcttgctatgtcaactgcagctattgcaacactatactggaggtgaatgcgccaagcatacgttgactacaa

SEQ ID NO: 50618 - DNA, 323 bp, Zea mays
  Clone ID: LIB3067-011-Q1-K1-H2
tcgcccacgcgtccggtgttgttcggagcgggcttcagcgcacagccccatcccgatcctcgtcggtcttggttccctcctcaagaaaagatgctgtaccatggggaagagaaagtcagctgcttagccaccttctaagaagcggatggacaatcttgacactgatttttcctgcccattctgcaaccacgggagtagtgttgagtgccgaattgacatgaagaatctgattggcgaagcatcttgtagaatctggtcttgaaaacttcaccacaactgtttatgcactcactgagcctatttgaatatatagtgaatggatt

SEQ ID NO: 50619 - DNA, 130 bp, Zea mays
  Clone ID: LIB3067-011-Q1-K1-H4
cggagcgggcagcaacacacagccccaacccaaaacaagacgagacggggacacgccacaagaaaagaagcggaaccaaggggaagagaaagacagcagcgaagccacccacaaagaagcggacggacaa

SEQ ID NO: 50620 - DNA, 359 bp, Zea mays
  Clone ID: LIB3067-011-Q1-K1-H5
cattgacgagaatcaccgcggaacttatgatttcatctaccttccaattgattctaagaatggatgtaacgtgggatatgcattcatcaatatgacagatccacagcagatagttccattttacaagacattcaacggcatgaaatgggagaagttcaatagtgagaaagtggcatcacttgcgtacgccagaatccagggaaggaacgctatgattgctcattctcagaattctagcctgatgaatgaagagaaatggtgccgccctatgcttattcacaaagatggccctaacgcatgagaccaggaaccattccctgtgggtaacaatgtatcgttttcggtctcggaggaacata

SEQ ID NO: 50621 - DNA, 218 bp, Zea mays
  Clone ID: LIB3067-011-Q1-K1-H6
catagatgagaatcaccgcggaacttatgatttcatctacctttcaaaggattctaggaatcggtgtaacgtgggatatgcattcatcaatatgacggatccacagcaaatagtttcattttacatgacattcaacggcatgaaatgggaaaagttcaatagtgataaagcggcattacttgctgtacgcctgaattcagtgtatgaacgcttagatt

SEQ ID NO: 50622 - DNA, 248 bp, Zea mays
  Clone ID: LIB3067-011-Q1-K1-G6
atttacgtgctttggtgatatagcactggcaattggggaggactttgataagtttgggatcggtgctatgcctatgctgcatagagctgctgatttgtcggcccataccactgcaactgatgatgagatgctctgactacaccaatcagctgagaaatggaattttggaagcctactctggtatcctgcaaggatttaagagttcatctaatacacaactgatgaagccattcgatccttatattatt

SEQ ID NO: 50623 - DNA, 202 bp, Zea mays
  Clone ID: LIB3067-010-Q1-K1-H5
accacgcgtccgctgggttggggaaacaaaatatagaaagcatattcttcaggcacttttatagatatagtatcttgcatagtttaagagtaaaaaggttcgacttcaaatgtaacgtgtttgtggggttctttcaaaccactggagatgatttactatcccctaagatgagatttaaatggtttcctttctgcagactgct

SEQ ID NO: 50624 - DNA, 374 bp, Zea mays
  Clone ID: LIB3067-010-Q1-K1-H6
aatatccagcgtttgtgtcaatctggtaaatgccgacttgaccgcacagcagacgggagtgcgcatcacggaggagaggatcctactggacggctcacctgaaacacctatcgattacattcaagttcagattgccaatgtcgagtccaaatttaccagtgcgatatctgagactggagagatcactgtggagggcagagtgaaggatggtgttcctcatctaacaaaggttggagcattccaagtcgatgtgagcttggaaggaagcctcatcctttgcaggcacgttgatcaaccatggatgattgggtcaatcggaagcgtcttgggtgacgagaatgtaaatgtcagtttcatgagtgtttggaagaatt

SEQ ID NO: 50625 - DNA, 421 bp, Zea mays
  Clone ID: LIB3067-010-Q1-K1-H7
accacgcgtccgcccacgcgttcgcccacgcgtccgatttctgtgaagggaatcaagggcgccttaacaggcgtacttctgcctgtgttggtgaccatggagaatggaaagcctaaccttaggaagaaggtgatgccagctgtcattgtgaggtagcgcaagccatggtgctgaaagggatgacgtctacatgtactttgaagaagcaagacaaatataaggatgctgaacctagtgcaatagatctttttaaggagatgcattgcagcaaaaagaaagggtttagcatatatgttcagaaagctattgttgatatggaagaaatggtggcaacatcagttcaagatggacaacaaccgaaatatcctacaaaagttgtttatagtgtgcaacttggctccagtgtgttcttatgcaatct

SEQ ID NO: 50626 - DNA, 387 bp, Zea mays
  Clone ID: LIB3067-010-Q1-K1-H8
cattgatgagaatcaccgaggaacttatgatttcatctaccttccaattgattttaagaataaatgtaacgtgggatatgcattcatcaatatgacggatccacagcagatagttccattttacaagacattcaacggcaagaaatgggagaagttcaatagtgagaaagtggcatcacttgcgtacgccagaatccagggaaggaacgctttgattgctcatttccagaattctagcctgatgaatgaagagaaatggtgccgccctatgcttttccacaaagatggcccgaacgcaagagaccaggaaccattccctgtgggtaacaatgttcgttctcggtacgggaggaacagaccacttagcagtggttcggagactaccaa

SEQ ID NO: 50627 - DNA, 131 bp, Zea mays
  Clone ID: LIB3067-011-Q1-K1-A1
gccacgcgtacgaatcattattcatataacgttcttgtagcacaaaggctgttggacatgaggaacaggcattgtactattacggtcaatggcgtttaaatccggatggttcacttagggaatgatgatgt

SEQ ID NO: 50628 - DNA, 144 bp, Zea mays
  Clone ID: LIB3067-011-Q1-K1-A2
aacggccaagcggaggaaacaaaagacaaaaaaggagcaagcagcacaaaagccgggggacaagaagaacaggcaggaaacaacaacggacaaaggcgaagaaagccggagggaacagaaagggaaggaagacgaccgcaaaaa

SEQ ID NO: 50629 - DNA, 333 bp, Zea mays
  Clone ID: LIB3067-011-Q1-K1-A5
cccacgcgtccggccacacgtgcgcccacgcgtccgcgcacacgtccgtacacgcgtgcggggtattctccctcttgccggttcccaataaagatcagctgctcatgatgtcctgcagagcgagaagaaggcaatggcgtgtcgacagctttcttttcacctctgagtccacgaactaggggcaccctgacaagctgtgcgactcagtgtcagacgccgtgcttgacgcatgccttgcgcaagacccttacagaatggtcgcctgctagacctgcaccaagaccaacatgatgatggttgtctgctagatcacgaccaacgcgaccgtggact

SEQ ID NO: 50630 - DNA, 177 bp, Zea mays
  Clone ID: LIB3067-011-Q1-K1-B1
tcgaatacacatccctacacgctctcttctgcgcagttgaacaacagttcagactgccctccctggggaaggtcatgcaatgctatgtgcccactatcgaccacttctagcggatagacgagcagtgcgcattcatagtgcggctgtatgctgtgttaccgaatggacgcatgttgt

SEQ ID NO: 50631 - DNA, 52 bp, Zea mays
  Clone ID: LIB3067-011-Q1-K1-B5
aacgcacgtacgtagagcgtttgactctcatgcatgccataacatgcagtct

SEQ ID NO: 50632 - DNA, 51 bp, Zea mays
  Clone ID: LIB3067-011-Q1-K1-B6
aacacacgtctgtagaccgcttgatattcttgctattcttaacatatattc

SEQ ID NO: 50633 - DNA, 94 bp, Zea mays
  Clone ID: LIB3067-011-Q1-K1-B7
accacacgtatgtagagagcttgatattcatgcttgtcttaataaacagtctcagacgatagtgcacgatatatcacgtacttatgtttatatt

SEQ ID NO: 50634 - DNA, 267 bp, Zea mays
  Clone ID: LIB3067-011-Q1-K1-C1
gacgatctttggcgagtgtataatccttaaatttaagctagatcggtgctgctacctggagagagctgtgatgagaaaggctatctctgcagagagcctgatatttgaagactcatttgacggctaacatgtggtactagtttagacatatgtctggactgctatctctgaaaggttcgtcacggtctgctaagctcataatttttgaatatctgatagtcgaaataaggaaggatcatttatgtgtagcaatagctaaatgttatt

SEQ ID NO: 50635 - DNA, 305 bp, Zea mays
  Clone ID: LIB3067-011-Q1-K1-D6
accacgcgttcgcccacgcgtccgattacgcttacgagactatggatattcaacatacgtctggaatatatatggaggagcttatgtcccgttttatggatgagtaacagttggtatggtgacaggaacaagtacctattattcatattttcattttgggcagttttgaaacactactatcaactattcaatagtacaatgcttctacttgctacaattcttacatatgttacaattatcaactgaatcttctacagttgctgtatgttaccgtttatgatcagtaatattgaagatcatttgtt

SEQ ID NO: 50636 - DNA, 195 bp, Zea mays
  Clone ID: LIB3067-011-Q1-K1-D7
tcgaccacgcgaaagattagacatgcagtttcgctttcttgactatggtcatccaacaagcgtcggcgtatatattatgaagagcttagaatccgatttatggtaggaccaacatcgggaatggagacatgtacaagttcctttaatacatatgactcatttagccaagcatgatacactactaccaactttaca

SEQ ID NO: 50637 - DNA, 318 bp, Zea mays
  Clone ID: LIB3067-011-Q1-K1-E1
cttgtacgcatctgaagacattaacaatgggcaagggacaactgggagaatcattttttcaagctttggctgagtgcccattattgactgctttaacagtcaacgatgcttctattgggagtggcattcaagaagtaactgttaatcatgatggacatgcgtgagcttcatattttgaagtgccatgcacttagaatatcttgcagatgatcccaacttcaaatactgtctttgaggctaacaggcatggctcatgtatctctgaactgtgctcaattgcttgagttggacttccaatcctgccataagctttttgac

SEQ ID NO: 50638 - DNA, 67 bp, Zea mays
  Clone ID: LIB3067-011-Q1-K1-E3
cttgtacgcatcgtaagaacatatcagatgggctatggacaactgctagaatcattttttcaagcta

SEQ ID NO: 50639 - DNA, 453 bp, Zea mays
  Clone ID: LIB3067-011-Q1-K1-F1
cccacgcgtccgcccacgcgtccggcagatccttccagcggctgtcgctgttcctgttccaccttccgttgatcataagcaagcagcttctgtgatgctcaagggcatgaccgcccatgttctgcttcgccgggtattcaaggtacaaacaaaccctaaaccctaaccactacttaattgattgatttttagccctcctcttacagtatccactcagtctgggatctcagcccttggctaactgaatgtgattctgacgaccccttcttattactttgcgcgagcgttctgacaattgtttatttgaacaatcaattggatatgtaaacagtaagcaaaaatgacattgtatatttatataagtaatatataggtctatttatatacatggaagccgatacatagtatgaaaattgtgattaggaattttgaaagttttttagattgattcag

SEQ ID NO: 50640 - DNA, 356 bp, Zea mays
  Clone ID: LIB3067-010-Q1-K1-H4
cggacgcgtgggctggaagcattcacggcgaagaaactctttcggccagtggaaaaacgatggaccatgttgatttgttgagagaacagttgaaaattttgtcaggggaggttgcgtttaatacaagtgctcttaagcgcctcacagaggaagctggaagaagcccaaagaacgagaagattcagatggaaatgaagaagaagaccgatgaaattaaagggaagcatcaacagatagcatctttggagagagagatagctcatgcaacattaggaactcaaggaaaggtcgatacgttagagcattcaccgtcttatcatgaactacttgagcagctcaatgagaaatctttagaa

SEQ ID NO: 50641 - DNA, 376 bp, Zea mays
  Clone ID: LIB3067-011-Q1-K1-F5
cccacgcgtccgcccacgcttacggcttacctgcaatcaaaatgacgaatgggttaccctgcttgaatcctttgccactgagcttgcctgctactactattccatgcaaaacaacgtgttcttaaccaaaattaaagttactaacatcgctgtgatgaatgggtgaatcgtaacctatttcttggaaatatcatctgcttgctcgaagaacagctgcgctggtccagctatctgggtaccgtactatctaccatcgattgaactgtatatgggtcaaagtaatctggggatatactctttgcatgctaggatataaggtgttactacttttaattcttaaatcactatatatatttaattctcttttatcaatttt

SEQ ID NO: 50642 - DNA, 351 bp, Zea mays
  Clone ID: LIB3067-011-Q1-K1-F6
cccacgcgtccgcccacgcttacggcttacctgcagccaaaatgacgaatgggtcaccctgctggaattcttagccactgcgcttgcttgctactacctattccatgcataacagcgtgatcggaaccaaaattaaagttcctgaacattgctgtgatgaatgggtgaatcgtcaccttttactatgaaattagcaactgtttgcacgaagaacagctgtgcttgtccaactatctgggtaccgtacttacctatctctattgaacagtattttggttaaagtaatgggggagatactctttccatgctatgaaaaaaggtggaactacctttaattctaagattaagaaa

SEQ ID NO: 50643 - DNA, 163 bp, Zea mays
  Clone ID: LIB3067-011-Q1-K1-F9
gccccgtactgcagtgcagtgcagcagtgtgctacccttctcagtcctcttactttatcacatacgcttgtcttcctcggggagatcttttcaacgaccgacagctcggaacgagtcttagaagccatggcgtcaaagaggctgctgcttgcggcgctgtgcg

SEQ ID NO: 50644 - DNA, 282 bp, Zea mays
  Clone ID: LIB3067-011-Q1-K1-G1
ctgacgcgtgcgctgacgcgtgggctctacattggcatctgatgctgactacgagttcctggggcaggccatgggtcatggtgcgtggtcgaacactcagacgctgacgctgctgctgatcggactacctaccgtactagtgctggtagctgattatcgccaatagcacgtatcgtgtatcggtagtgggcaagccgccggttactacatcgtcgacgggcacactggccatattggggcacctacaccacatttgtccctagacacacatatctttcaagg

SEQ ID NO: 50645 - DNA, 99 bp, Zea mays
  Clone ID: LIB3067-011-Q1-K1-G2
tcgcggacgcgtgcgctgacgcttgggctttacattggcactccaagctgattacgagaacctgcggcaggtcatatgccatggcggcctggtcctatc

SEQ ID NO: 50646 - DNA, 327 bp, Zea mays
  Clone ID: LIB3067-011-Q1-K1-G5
attttcgtgctttggtgatatagcactggcaattggggaggactttgagaagtatctgatcggtgcgatgcctatgctgcaaagtgctgctgatttgacggcccataccactgcaactgatgatgagatgctcgactacaccaatcagctaagaaatggaatcttggaagccttctctggtatcctgcaaggatttatgagttcaccttagacacaatctgctgatgcctttcgctccgtatataattcagatccttgatgctctgtacaatgtgaaggatatggatgatactgtgattaatactgcaatatgtgatttgtgagatc

SEQ ID NO: 50647 - DNA, 141 bp, Zea mays
  Clone ID: LIB3067-010-Q1-K1-F5
ggccgtcgaggactgcggcgcggcgtcgttccaccggtgcgactcggtgcgcgtgcagggcgggcatacagcgggcaagagccgctgccggttgtacgaggtggagagcgcgggcgcagtggacatccgaccttacaaggg

SEQ ID NO: 50648 - DNA, 370 bp, Zea mays
  Clone ID: LIB3067-010-Q1-K1-F7
cccacgcgtccgcccacgcgtccggcttccctgcagccaaaatgacgaatgggttaccctgcttgaatcctttgccactgcgcttgcgtgctactactattccatgcaaaacaacgtgttcggaaccaaaattaaagttccgaacatcgctgtgatgaatgggtgaatcgtcacctttttctttgaaatagcaactgtatgctcgaagaacagctgtgctggtccagctatctgggtaccgtactccctaccccgattgaactgtatttgggtcaaagtaatgggggagatactctttccatgctaggatataaggtgtaactacctttaattctaagatcaagaaatatatttaattctctttatcaat

SEQ ID NO: 50649 - DNA, 391 bp, Zea mays
  Clone ID: LIB3067-010-Q1-K1-F8
cccacgcgtccgcagtgattgagtttgcacgttctatcatgaagttgcacggtgcaaacagcacagagttcgatccaaccacaaaaaccccatgtgttattttcatgccagaggggtcaaaaacccatatgggggcaacaatgcgccttggatcaaggaggacctttttccaggtcactaactgcaaatctgctaaactgtatgggaatgctagctacgttgatgaacggcaccgccacagatactaggtgaatcctgatatggtcccagaatttgagaaggcagggctttctttcgttggcagggatgaaagtggtaaacgcatggagattatcgaactgccaactcatatgtatttcgtcggtgcacaatttcatcctgaattcaagtc

SEQ ID NO: 50650 - DNA, 339 bp, Zea mays
  Clone ID: LIB3067-010-Q1-K1-F9
caaggagaaatcaaggcgccatccatcacacgaccgagttgactactacagttcgcattcatggcgtgaaaaagatcggcatagacaccattgatcaaggtgaggaggatcccgggtttgcagggctttgctgcatggagaccaccacatggcagtgccgacagaatcatgaaaacttgtagattgtcatctcattggcggttgcatttgcttcattgtgttttgcaccttggattgtaacttgcagagcaacatgaatttgtagaaccttcatcttcactagttcccaaaattctcgagaaataatttatggtgttactaatataaaaaataatttta

SEQ ID NO: 50651 - DNA, 252 bp, Zea mays
  Clone ID: LIB3067-010-Q1-K1-G10
ggtgcaaggtgacaatatctttgcttataacgattcgaggcaatttggagctgtgccttatgggctgattacagggaagatcttttgccgggtttggccgtcagagagtcttggcgcaattgatgactcatcgaagcagtcttaacgctgatgaggagccgaggagcacatggacccatattgtttgatcgcgcccagagattctatctataacatactgcatgggggccctttattgagctcgagagcttt

SEQ ID NO: 50652 - DNA, 392 bp, Zea mays
  unsure at all n locations
  Clone ID: LIB3067-010-Q1-K1-G11
ctccaggtcaattgtgggtgcttccttggaagtaatccagaagaagagagctgagaagccagaggtccgcgatgctgctagagaagctgctcttcgtgagatcaaggagcgcatcaagaagaccaaggatgagaagaaagcgaagaatgcggatgtgagcaagtcccagaagacgcagacaaagggtgcggtccagaagggttccaagggccccaagttgggcggcggtggtgggaagcgctgaaagaacttagtgtcgtttctcgacattgcagtcgttccttagccaaagccactttcgtagaacctgtngtgaatttgcaagacttattcaagcgttgcttgtgcgtgctaaataccatggcaagagaacggatttatatttatgcctg

SEQ ID NO: 50653 - DNA, 343 bp, Zea mays
  Clone ID: LIB3067-010-Q1-K1-G2
gttgtatgttagaagagtgttcatctctgatgaatttgatgaccttcttccgaagtatctcagctttttgaggggtattgttgactcagacacactgccgctgaatgtgtcacgagaaatgctccaacaacatagcagtctgaagactatcaagaagaagctgatccgcaaagctcttgacatgattaggaaacttgctgaagaagaccctgatgagtacagcaacaaggataagacagatgaagagaaaaatgagatggaggagaagaagggccagtacgccaagttctggaatgagtttggcaaatcaatcaagctgggtatcattgaagacgcaactaac

SEQ ID NO: 50654 - DNA, 395 bp, Zea mays
  Clone ID: LIB3067-010-Q1-K1-G3
cggacgcgtgggcggacgcgtgggctcgacaatggcactccaggcagcctacgagtacctgcgggaggccgtcggccatggcgcgtggtcgtccacgcagacgctgacgctgctgctcatcgccgtacccaccgtactactgctgctagcgtccctcgccaagagcacgtcgtcgtccggtaggggcaagccgccggtccctccctagccgtcgggcaccctccccatcgtggggcacctacaccacatcgggccccagacccacatctcgctccaggagctggtggccaagtacgggcacaacgggttcctgttccttcgcgccagcgccgtgcccaccctgatcgtgtcgtttgccaacgccgtcgaagccgtgatgcgcacccacgaccaca

SEQ ID NO: 50655 - DNA, 262 bp, Zea mays
  Clone ID: LIB3067-010-Q1-K1-G4
cccacgcgttcgctcctcgcatttcttcccatcccccttcgcaacccaaaccccaactcgcgcggcatcgatggcgcccaaggccgagaagaagcccgcggcgaagaagccggcggaggacgagcccgcggccgagaaggcgcccgccgggaagaagccgaaggcggagaagcgggtccccgctggcaagtccggtgccaaggacggccgcgagggcaagaagggcaagaagaacggcaagaagagcgtggagacctacaag

SEQ ID NO: 50656 - DNA, 438 bp, Zea mays
  Clone ID: LIB3067-010-Q1-K1-G5
ctcgatcggccatcatctgactgtgcaagcacgagagggggatacagcggattcataaaccgtcagagtgttaggacaagatggtggccaatggtgatgcacctgctagagggagcgcggcggcagccgcaagcctgcgtaggcgtaggaccacaagcggtgctgctgctggtggaggcggtgccagctcaatgctccaattctacactgatgaggctgccggccgcaaaatgtcaccaaacactgttctgatcatgagtattgggttcgtagccgtcgttgctgtgctccatgtattcgggaagctgtaccgcaccttcaactaggttggcattgccatatccaagaaagctgagtccaccaagagaggattcctgtagaacaatttaaatggatagcaagtgactatcagactctgttgtagaagtttatttatac

SEQ ID NO: 50657 - DNA, 386 bp, Zea mays
  Clone ID: LIB3067-010-Q1-K1-G6
cttgagccttcagccacgcacactccctgcttgccttcgcgatcactactcttcctatcggggcacacgcaccgtccaagctgtgccactcaaattcagggccatcgcaaatccaccggctccccgatccggtcgtgtacccaaccggccgatcggatcctgccgtgtggattgaacgctgaattgtggatattcaagattttagaggaacatgggcatagcatggaagagttctatgctatagaatcatctaaaattgatgataaacaaatacatctatatggaattactgaaggacatggcggagcacgtgctgctgagtatttgaaggagcatttgtctgagaaccttatttatcattcatagttcatgactaacacaaaatt

SEQ ID NO: 50658 - DNA, 57 bp, Zea mays
  Clone ID: LIB3067-010-Q1-K1-G7
cttcatcgtacaaccactcactctcccaacttttatatctgattaatatgattcact

SEQ ID NO: 50659 - DNA, 405 bp, Zea mays
  unsure at all n locations
  Clone ID: LIB3067-010-Q1-K1-G8
attttcgtgctttggtgatatagcactggcaattggggaggactttgagaagtatttgatctatgcgatgcctatgctgcaaagtgctgctgatttgtcggcccataccactgcaactgatgatgagatgctcgactacaccaatcagctaagaaatggaatcttggaagcctactctggtatcctgcaaggatttaagagttcacctaagacacaactgctgatgccattcgctccgcatattattcagttccttgatgctctgtacaatgggaaggatatggatgatactgtgatgaagactgcaataggtgtcttgngagatctggctgacacattatgtgtccatgcttgccctttgatcaaataattcaacttaaggcaggcatttttaaaggaatgctt

SEQ ID NO: 50660 - DNA, 286 bp, Zea mays
  Clone ID: LIB3067-010-Q1-K1-G9
gatggttcttgtggatatttctgcttcacgtggcattagtggtggatatgaatcttactccatggttgatggggatgaaactctcatatggagtctgcagactgcaagtaatgagggtgagcatttgatggttgatgttcccaggaagcatggccagcgttgccagttttttttgcacgaaagagtaatgggagctcttgtacagacacatacttaatgataaaattgtaaaactcactgttcgtttcataatattcaatagccaccgaaagatgattggacgacc

SEQ ID NO: 50661 - DNA, 319 bp, Zea mays
  unsure at all n locations
  Clone ID: LIB3067-010-Q1-K1-H10
cttcagtcttcagccacgcacactccctccttccctccccgatcactactctccctctccaggtgcacacccaccgccccacctctcccactcaaatccagggccatcgcagatccaccgcctccccgatccggtcgcctacccagccgcccgatcggatcctgcagtgtggatggaacgctgaattgtggatattcaagttttagaggaaaaagggcaagcatggaagatttctatgatataaaatcatctataattgatgnataacaaatacatctctttggaatttttgatggtcatggcggntcacgtgctgctg

SEQ ID NO: 50662 - DNA, 232 bp, Zea mays
  unsure at all n locations
  Clone ID: LIB3067-010-Q1-K1-H11
ggcaccgncagcccgggcggtataaagacgaggcccatctcgaaatcgacggcgatgaagaagaccagttcccctctcctgatcgtcctgttcctcacagcagcagccatggcggccgagccggagaagcaggcggcccccgcggcacaggagacggccgtgcacatcgtgtacgtttgaccgcccgaggacgccgaccctgaggagttccacanttcgacccttacccccg

SEQ ID NO: 50663 - DNA, 286 bp, Zea mays
  unsure at all n locations
  Clone ID: LIB3067-010-Q1-K1-H2
cccacgcgtccgttccagtgtccatcagcacctcctgtgctgtgcattcctgagaaaccaaccccgccccctgcccccccacacgcacagtttagtgcccggagcccggaggcgtacgtgtacgtcgcatcccagcgcagcgatgccggtcaccgtcggcgcccggaccaccctcctcctcttcgccaccgcagtggtgctagcgtgcacttcagcgccgccggcatgccatgccgcgcacaacatcaccgccatcctcttcgggcaccgggacctngccgagttc

SEQ ID NO: 50664 - DNA, 401 bp, Zea mays
  Clone ID: LIB3067-010-Q1-K1-F4
cccacgcgtccgcccacgcgtccggcagatccttccagcggctgtcgctgttcctgttccaccttccgttgatcataagcaagcagcttctgtgatgctcaagggcatgaccgcccatgttctgcttcgccgggtattcaaggtacaaacaaaccctaaaccctaaccactacttaattgattgatttttagccctcctcttacagtatccactcagtctgggatctcagcccttggctaactgaatgtgattctgacgaccccttcttattactttgcgcgagcgttctgacaattgtttatttgaacaatcaattggatatgtaaacagtaagcaaaaatgacattgtatatttatataagtaatatataggtctaattatatacatggaaagcagatt

SEQ ID NO: 50665 - DNA, 406 bp, Zea mays
  Clone ID: LIB3067-010-Q1-K1-H3
cccacgcgtccggtgttgttcggagcgggcagcagcacacagccccatcccaatcctagtcgatcttcttcccctcctcaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatctgtcaggaaaacttcagcacaactggtaatgcacttactgagcctattgatatatatagtgaatggattgatgagtgtgaccgtgtcaacacttgtgaatgcgacgatgatgcgtgagccttgccccatgtgatgaaactgttacctacaatcgta

SEQ ID NO: 50666 - DNA, 177 bp, Zea mays
  Clone ID: LIB3067-042-Q1-K1-G8
atccattatatgaaatacgacaactgcaacgactccggaaggagcttgatggacaggtatacgaagatgaacgacactatgaagacgtatgggaagggcatattattatcgctgtgcgaatggtggaggcaaaacgctgatacctgggcaagctgcatggggaacagatcgagaacg

SEQ ID NO: 50667 - DNA, 169 bp, Zea mays
  Clone ID: LIB3067-042-Q1-K1-G9
cgatgctatactgaatgcttactggaattttgatcatcatatgtcactagtcgattaggggtgcactgagcagaggaaaccttggatttgcacttctactgatgccatgtcacctttcaaaaaaaaaaaaaaaaataaaattatataaaataaatagtagtacattata

SEQ ID NO: 50668 - DNA, 427 bp, Zea mays
  Clone ID: LIB3067-042-Q1-K1-H10
ctcaagcattcccttggccagtcacaccttgttcttctgacccgccataatccagactccctggacgagtctgtcctgtggacagagagcagggacgttggtgatgggttccgctgcattaggatggtcaacaacatctacctgaactttgatgctttacatggagacaaggaccatggtggtgtgcgcgacgggacggcccttgtgctgtgggagtggtgcgagggagacaaccagcgctggaagattgttccctggtgaacaaggaaatgtgtgaccgagcccgcaccaaggaggagctcctgccgtaataagtgaagtgattggtactgaagtttctggaaataagatgcttttcctagatgcctgtttgtgtgagtatttgcgtttccaatttcgttttcatgattattaaacgccttgattt

SEQ ID NO: 50669 - DNA, 445 bp, Zea mays
  Clone ID: LIB3067-042-Q1-K1-H11
cccacgcgtccgcccacgcgtccgagagctcttataaggcactagcacgcaaaaaccccacgagagagacgaatcttccgaatctctcggtgcgatggcgctctccgaccgctcccgcgagtcgctcctcccgagcttcctctacgcctcctcggcgcgctctttcgctgccacaggagccgccgcgcgcctccctgtctcctccccggcgcctgccgcggctggagcaggaggcggcgtgccgttctcgatccaggcgcccaaggagaagatcgagatgtactcgccggccttctatgccgcctgcactgccggaggaatcgccagctgcgggctcacccacatggccgtcacgcctctcgacctcgtcaagtgcaatatgcagattgacccagcgaaatacaagagtatctcatctggatttggtatcctgttaaaggagcaa

SEQ ID NO: 50670 - DNA, 405 bp, Zea mays
  Clone ID: LIB3067-042-Q1-K1-H12
tcgcgaggaaggagggagagagcacgggggattgttcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcggcacgtactgctggcgatccgcaacgacgaggagctcgggaagctactggccggcgttaccatcgcacacggcggtgttctggccaaca

SEQ ID NO: 50671 - DNA, 250 bp, Zea mays
  Clone ID: LIB3067-042-Q1-K1-H2
gttctagatcgcgagcgcccgcccttctttttcatttttttcgattatctgaaatacgaggactgttttacttttaataaacaacgcggggcacagattagcgcattcatttatatatatgcccttggtaatgggcattactataccgctatggcgttggatgacctaaaattacattagtgactgggtccttcaaaaatgagaaacaactcaataatggaaagcattctccattacgagaagaacccaa

SEQ ID NO: 50672 - DNA, 341 bp, Zea mays
  Clone ID: LIB3067-042-Q1-K1-H4
cggacgcgtgggtgttgttgttggcctgcttgccttctctgctcgatcgaccgccacgtcgtcggtgatcgccgggaccggggcgggtgtggtggttggctgctccgctcgtctctatgctggcggtggggttggtcgttggcccgtgtccgcaggtcgttgcaatcatgcaggcgatccatccaaaaagtacttgttgccttggcggggttctcaggctgctgaccagcgtggtcgcgtactgggcatgcatgtttttgacgcttgctatttgcctattcggggtggttgaggcatgaaactttatatatatagagagagagatttattaagattaattg

SEQ ID NO: 50673 - DNA, 324 bp, Zea mays
  Clone ID: LIB3067-042-Q1-K1-H5
cccacgcgtccgaccgtgacaggttatctttcaacaaattccagattgccaagatcacaactgaaggatcaaccatctacccaccatattccttgaagacctactggggcttctctcactttgaaaacccagcccagggcgctgtgggatcatggtagattaatgcgccgcgcacgccgcatatcatgccatgaacttagttgaggccaatctgtgctgctgaaatcaaacacttatgaacgtttgttctgaacatcactggaactctccatttgcttgtatgacatgcttatggttcagcgagtttaattccaacgtttggtc

SEQ ID NO: 50674 - DNA, 358 bp, Zea mays
  Clone ID: LIB3067-042-Q1-K1-H6
gaccccgcgtccgggctagatcgcgagcgtccgcgcctgttgccttttgctcgacgaccgccacgtggtagtgatcgccggaaccgagcgggcgtggcggatggctgctccgctcgtctctatgctggccgtggggatggtcgttggcccacgtccgcaggtcgttgcaatcatgcaagcgatccatccaaaaagtacttgatgccttgtcggggttctcaggctgctgaccagcgtggtcgcctagtgtgcatgcggttttttgaccttggctacttgcctattcagggtgtttgaggcatgaaactatatatatatagagagagagatttatgacgattaactgaccttgtacagt

SEQ ID NO: 50675 - DNA, 277 bp, Zea mays
  Clone ID: LIB3067-042-Q1-K1-H7
acccacgcgaacgcccgcgcgtccgaccggtcaggttttcttttaacaaaccccagaaagccaagagacaagtgaaggttcaacacaggaccggccatataattagaagacccaccggggcaacacacactatgaaaacccaacccaaggcgctgagggatcatggtagattaaagcgccgcgcacgccgaatattatgccatgaacatagatgaggccaatctgtgcagcttaaatcaaacacttatgaacgatagtttttaacattactggaaca

SEQ ID NO: 50676 - DNA, 400 bp, Zea mays
  Clone ID: LIB3067-042-Q1-K1-H8
cacgcgtcccgtgactcgtggtcggtgccccgttgcgtctctgtaaaaccagacggcgaaccactgctgcggtccactgcatcccgggtccgtcttctcgtgccatgctacggttgctttctcccgtcggcgcctgcgcagatttggccgccgtcgccgctgacccaggctgtcttgatggcgcccgatgcagaagccgctaaggggacaggcaccgttccacaaaggtgctctgccattgaacgaaaggatactggcatgcatgtccaggaggtctgctgctggacacccttggcatgatctggagataggccctggagctccaaccatattcaactgcgtcattgagatacccaggggcagcaaggtttaatatgaacttgacaaggaaactggactg

SEQ ID NO: 50677 - DNA, 233 bp, Zea mays
  Clone ID: LIB3067-042-Q1-K1-H9
ccacgcgtccggcgcggcgtctgcggctgtccggcaggccacttgcaaccgcctcaagagcatgacaggccggctcggctgaaacgtcagcagggccaacacacccaacaaccccagcaagtgccgcatcagcgccgactcgcccagcacccacacacggcgactgacccaagaacaactgatccatggaaccacacgaggaagacgctcgaccgctagacggcaccgtacga

SEQ ID NO: 50678 - DNA, 443 bp, Zea mays
  Clone ID: LIB3067-043-Q1-K1-A11
cccacgcgtccggcatttctccgaagatgtcgacttcgatagcagaggtggcgaagcagcgcgagctgagcggcacacttctgagcgaggacgacagcaagatgaagaagcagatatcggacctgaaatccaaggagctgagcggccacgacatctttgctcctccggaagacccacggccacgcaactcagagaacggctcgacctcgcagaccccgggcaaaaatgcacacgtaagcaacttcaagttcggcgaggccgacgaggacggcatggtgaagaccgcgaagaagatccccacaaagaaattcaccgacctcgcgggcaatatcttcaagggcgacgagaccccccctgggacggcggagaaacacctgagcacagcgaaactgatggagatgaccggcagcgacatcttcgcggacgggaaagccccctcgcgg

SEQ ID NO: 50679 - DNA, 451 bp, Zea mays
  Clone ID: LIB3067-043-Q1-K1-A12
ccggcccgacccacgcgtccgcccacgcgtccgcccactcgtccgctgtctcgtgggtgctcgcctgccccatccggcgggccgcgagccagcgagccgcctctccttcctcggcgtgttcctggcttgcctttgccgcgtagcagtggcatgagggcggggcggccgaagatcggcgaccaagcgaccagcgacgtggtagtgcggctacggacgccggagggccgcgacgagtggctctactgccactccgcggtcctcgccgccggcagcacctacttcgccgaccgcctctccgacgcctggccgacgtgccagatcctcggctcgcgctactgcgtcgaggtctactgccaggagctggacctgagctcctatgtcacagcgcttcggctcctatacgccatcgagccctgctcccatttcggcgttcgcggcgcgctgggcgtgc

SEQ ID NO: 50680 - DNA, 200 bp, Zea mays
  unsure at all n locations
  Clone ID: LIB3067-043-Q1-K1-A2
ggccggggtgaccttccaaggcattanttagctgacatatagaaagcaaggaagcggatgccgtgccagctgctgcacgcataaatcttgaatgtgctggttgagagttttttagttgctctgcaggattagacaatgttctaagactaccatgttttaagtctgctgatgctatattcatgaacgattttgcagctagc

SEQ ID NO: 50681 - DNA, 402 bp, Zea mays
  Clone ID: LIB3067-043-Q1-K1-A4
cccacgcgtccggaatagtggagaagatttagggtacctaatacaaggcggtattgcggctgacatcctaggtgcagtcctggattccataaaatcagacaaagggaattcattcttggatgagatcaagacaacttcaagtttaaagttggttgatttcagaccacaacatcttaagcgatcaaagttggacgccttcatgtaggcacataagttattgttacctggtaagtctgttctagtccaagtgttaatattgttcttgggtagttatttgttctgaagacatacacttgatttaaatactctgaactattctgatgacagattaccaatgggtgccgtcacccagcagtttagtttctttggaccctaatacccaaacgcctttttgatgtactg

SEQ ID NO: 50682 - DNA, 221 bp, Zea mays
  Clone ID: LIB3067-042-Q1-K1-G4
cggcccgacccacgcgtccgctcacgcgtttcgtggttgctctcgacgtttatccgattgaactggttgtgtggcttccagccctgtgcaggaagatggaggtcccttactgcattgataaaggaaaggctcgccttggatcgattgttcacaagaagaatgcatcagtcttgtgtctgaccactgtcaagaacgaggataagcttgagttcaacaagatc

SEQ ID NO: 50683 - DNA, 430 bp, Zea mays
  unsure at all n locations
  Clone ID: LIB3067-042-Q1-K1-E10
cccacgcgtccgggcctacatcgaagagcttangataaaagacggccccttcgacggactgatgggtttctcccagggttccattctgtcggcggcgcttccggggctccaagaacaagggctggccctgactagagtcccgaaggtcaagtacctcatcatcatcggtggcgccaagttccagtcaccgacggtggccagcaaggcgtacgccaacaagatcgcatgcccctcgcttcacttcatcggtgaaaacgacttcctgaaagtccatggtgaaaagctgatagaatcatgcgtggacccattcgtaatccgtcacccaaagggccacacagttccgaggctcgatgacgagaagttagtggtcatgcaccgttttcttgagaagattgaaggggaagtacttgagtattcgtccaaagatgtc

SEQ ID NO: 50684 - DNA, 429 bp, Zea mays
  Clone ID: LIB3067-042-Q1-K1-E11
tcggcgagggagaggcatggctgctccgaagttcgtgacgctggcgctggccgtgctcctggcggcgaccgcggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaactgcaacacgattaattaaatgaggcgtcctgtgcgcgtccgggcgaggaatgcatgcat

SEQ ID NO: 50685 - DNA, 171 bp, Zea mays
  Clone ID: LIB3067-042-Q1-K1-E4
cgaataaaccgaaatatctagtggaaggctcatcaagtatgcatccttgatactgcatgttcacagaaatgcttgtgcggcaggctgttccaaggctttaaactttatggtgctttacattcctaataaaccgaattgtgtatatgatgtttgggaaaatggtgatttttc

SEQ ID NO: 50686 - DNA, 339 bp, Zea mays
  Clone ID: LIB3067-042-Q1-K1-E5
acgcccacgcgtacggccacgcgtcttttgctttatcgcgatctagaactaggagaaggaaaaagagcagtcgtgtagcatagttataccataatggcattcgtagccatttcacgtggtgtcagtgtcgcagtttacaatgtactaggtctagtgcgttatactgacaaaattgacggttctgatggaagaacataacctgaggaaattggcttggaagaagtactcatgagcatgttctgcaatttggcgggcactcagactatctccaattatatccactatattccctctgtaagaaaaaaaatctttcgtattaattacggtgaaattgtgaca

SEQ ID NO: 50687 - DNA, 312 bp, Zea mays
  Clone ID: LIB3067-042-Q1-K1-E6
cggcccgacccacgcgtgcgcccacgcgttttcccattgcggctgtactttatcgcgatctagaactaggagagggaaagtgagaagttgtgtagcatagttataccataatttcattcgtagccatttcagttttgtaagtgtagcagtttacaatttactaggtctagtgcgttatactgacaaaattgacggttctgatggaagaacataacctgaggaaattggcttgttagaagtactcgtgagcatgttctgcaatttggcggccactcagactatcttcaattatatctgctatattccttcttt

SEQ ID NO: 50688 - DNA, 356 bp, Zea mays
  Clone ID: LIB3067-042-Q1-K1-E7
cgccaataggattcgcatctccatatgcactctgggctgaggtgctgatactcggcatccgctccttcgtcgggccagccattgttccaggccacatgatcacattctggctctggattatactccgtcaggtggaggctatcgagacacatagcggctttgatttcccattcaccccgacaaagtatattccattctatggaggagcagaataccatgactatcatcattatgtacgaggccagagccaaagcaattctgcttctgatttcacttactgtgattacttatatggcactgacaaaggttacagattccacaaaacatacctagcaaagcttaaggatctggggcat

SEQ ID NO: 50689 - DNA, 405 bp, Zea mays
  Clone ID: LIB3067-042-Q1-K1-E9
cgtcgactttccaaaatttaccaacgccgtgatcttcgagtcccggcgggcgtgctgcggcacgttcacgatcgagacgtcggtgctgtgccaccagggggcgccggggacgtgcaccaacgccacgggctacgtcttctgggacggcttccaccccacggacgccgccaacaaggtgctcgccgacgcgctcctcctgcagggcctacagctcatcgcgtgagccacagccacgcaacggcctcccgtcgcccttatacgtaccttgctgcttctgtcgttccctcctgctactgtgtctcgtgtgcttgtctgtctgactgtctgtctgtctgtctgtccatgatctctcgtagctttgtgatgcttggaaacacttgggagtgctgtaagatttctggtctg

SEQ ID NO: 50690 - DNA, 268 bp, Zea mays
  Clone ID: LIB3067-042-Q1-K1-F1
gggagaagtttggactctgcttttgtttctgaaccgagcagcctaagcatggcggaatgcactatcaagttgctgaatggtcacaactggaacacatcattttagaactggagccagtacccaattaaccaaagcgtacacgaacaaggggaacaaagagctctggtgcaagtagttgtcggcacattacatatgaagagtatattattgattgggagctgaagtgttcagtcaggatattgtcttggattcagcctgtacctatttg

SEQ ID NO: 50691 - DNA, 392 bp, Zea mays
  Clone ID: LIB3067-042-Q1-K1-F12
acccactcgtccggcaacttgatatgtcataattatgtctatttgtatgcctctctcgaaacatgccagacgatggtgcataaaatggcaccgagggaggaggctctagagttaaatatgctgtgatggatgttcccatcaccttaccttcgttgaaaccagcttttgacaagcctaaccccaaacaaggcattggtatgctgtcatggagcatcgacagccactatttcttcaccaggaatgacaacatgccaactgttctctggatatgggatatatgccgccttgagcttgccgctgtgctcgtgcataaagatccaatccgtgctgtatcatgggaccctacctgcacactccttgttttatgcacagagagcctttacttgttcatg

SEQ ID NO: 50692 - DNA, 348 bp, Zea mays
  unsure at all n locations
  Clone ID: LIB3067-042-Q1-K1-F2
ggtcccttttttttctcgatctggaagcgccgcagtagcagccatggacgtgagcggagcaggcgggaaggcgaagaagggcgcggcggggcgcaaggccggcgggccgacgaagaagtcggtgtcgcggtccgccagggccgggctgcagttccccgtcagccgcgtcgggcggtacctcaaaaagggccggtacgcgcagcgtgtaggcacgggtgcccccgtctacctcgccgncgtcctggagtacctcgcggccgaggtgctcgagctcgccggcaacgcggcaagggacaataagaagacgcgcatcatcccgcgccacgtgctcctcgccatccgcaacga

SEQ ID NO: 50693 - DNA, 356 bp, Zea mays
  Clone ID: LIB3067-042-Q1-K1-F4
cacgcgttcgcggacgcgtgttcatcgtcggtttcggtgtctgcgcgccgagaaggaacaaaggaagactgtagctgtgcagagatagtgagccctctgggcgggtggccgccatacaacccgcacagcttcagccagttggtttgtttttattctacgcaacaacttcgaatgtcacaccattcacgtatgtttcgacccacacgacagatccgtcacccaattcagtgataacgaccgatgccatcaacattctgtttaggctcttgttctataaatttccggagaatttgatgccaaagagagctgcgcctgacaacctatctcctgagaacaacaacaacatgaagcaaccc

SEQ ID NO: 50694 - DNA, 449 bp, Zea mays
  Clone ID: LIB3067-042-Q1-K1-F5
cccacgcgtccgcccacgcgtcctgcgaagtcgaccctccctccttcgctccttccccgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtctcgccactccaatgggcagggccgctggccggttaaatcagccgggttcatcctggatttgctgaagaatgctgagagtaacgctgatgtgaaaggctcggatgtggacaacctctatatttcacacatccaggtgaaccaagc

SEQ ID NO: 50695 - DNA, 410 bp, Zea mays
  Clone ID: LIB3067-042-Q1-K1-F6
cgtaccgctgacgcgtgggcatctccggatccggggtcggcgcgccgagaaggaacaaaagaagacggcggctgtgcggagatggggagccctctgggcgggtggccgtcatacaacccgcacaacttcagccagttggtccctgccgacccctccgcgcagccctcgaatgtcacaccagccacttatgttgcgacccacaggacagatccgccacccaatcaagtgataaccacggaggccaggaacatcctgctgaggcacttgtaccagaaatccgaggagaagctgaggccaaagagagctgcgccggacaacctagctccggagaacaacaacaacaagaagcagcccaggggacctgtgggcgacgttgggggccagtcgagcgcaagaagctgaagacgcac

SEQ ID NO: 50696 - DNA, 125 bp, Zea mays
  Clone ID: LIB3067-042-Q1-K1-F8
ggcggttacaagcaaggcagcagcacctgaccagcacgcgacagaggacacatataaccaagacccccggaggccacacgcaccctaggcagagacggaggaaaacaccaccagagaaaggagag

SEQ ID NO: 50697 - DNA, 167 bp, Zea mays
  Clone ID: LIB3067-042-Q1-K1-G1
tcgctccatatgagtatcaatatgggcagatgattgtggtagataagattttaattgagctgcgaagtattggcatttgtccagagacagtgccaaagctgaatgaacggtgacgatgatgacgatattttttaaaaaaaaaaaaagaatgtacaaaagaagataac

SEQ ID NO: 50698 - DNA, 300 bp, Zea mays
  Clone ID: LIB3067-042-Q1-K1-G11
cccacgcgtccgcggacgcgtgggttggtttattccagatgccattggaagcatcggtgtcgtgccatctggttttggacatctgacagtgcaggttgaagatgaggactacgacaatgaggattagtcagggtcatcttctcattgtatgcactaacaggactgttctggtgttgtaaaatgtaaatatagtttgaaatagttgccgcagtttacctgtgattgtctgtcgttttatgcggttatgtagtcctgtgtaactttcgttctccaataattgcttggtagttgcttttttac

SEQ ID NO: 50699 - DNA, 412 bp, Zea mays
  Clone ID: LIB3067-042-Q1-K1-G12
ccggccctctcgcccgtccgtctcctgcctctttccctggtcggaccacgagagccccggactgcgttcacctctgccttttgttcacccctgcacgcgttctctggcgctcttgtctcgtgcgtgcgacaacaactgggcgaccgccgccgccgccgccgccgccctacgccaggtgcgcaggtcttcgtcggatccttcgccagcgaggcgacgagcacctaccaggtgatgcccccggcttaattgaatgggctctcttctcaccaggactggcgtcctgccatggctccaggccaagatcgttgatcccgtgctgcatgtcatcagaaggggagcagaacccaagcaactggccttctttgctgcccttggtgtcacgattgggatctttccgatatgtgggaccact

SEQ ID NO: 50700 - DNA, 342 bp, Zea mays
  Clone ID: LIB3067-042-Q1-K1-G2
gaggtagctctcgaccacttttgggcaagatctgattttgtcccaaggttgatatttctggagcaatgggtggtgattagtttgtcaccagtacctcactacctcgtgacagtggtcacatatttccaagacccctggaggctacacgcaccctcgtcagagatggatgtaaatatctctagagaaaggagaggtctggttctgattgctgtttacaggttagaggtgcagcgtatttacaaagagatataagagttatcacttatcatcagactgcctggtttgctaaataaaggtgaatttagttactagattatgagaccctctgttttgactgccgca

SEQ ID NO: 50701 - DNA, 145 bp, Zea mays
  Clone ID: LIB3067-042-Q1-K1-G3
tttcgtccacgcgttcggccacgctttcggagggttttttgtgtgggcccatcctggctttcgccgagttatgttatctatctataggatcggggtaccgtttcgctttgtcaccgtgttagtggccgttctacccttggattaa

SEQ ID NO: 50702 - DNA, 353 bp, Zea mays
  unsure at all n locations
  Clone ID: LIB3067-042-Q1-K1-E1
acccactcgttcggcaagaacaaagggcgcttttataaatgtttcttactttgaacaatttggtgttaccttgatagaggctgccatgcacgggctgcctgttattgcaacaaaaaatggggctcctgttgaaattcatcaggttctggaaaatggtctccttgttgatccccatgatcagcatgcaatcgcagatgccctctataagatgctgtctgaaaagcaattttggtcaagatgtcgagagaatggattaaaaaatatacaccagttttcttggcctgaacattgcaagaattacttgtcaaggatattaactctaagtccaaaacatnctgctttcgcatgcaaag

SEQ ID NO: 50703 - DNA, 328 bp, Zea mays
  Clone ID: LIB3067-042-Q1-K1-B5
cccacgcgttcgatcaagttgattgaatgtgggaggacgctgtgtcaaagcttggccctgctgaaagcttcctcaaggcggtgctcgcgatcccattcgctttcaagagagtggaagcgatgctgtacatcaccaacttcgatttagaggttgactacctcaagacctcctacaaaactcttgaggcagcatgcgaagagctacagggcagcaggttgttccacaagatactagacgcggtcctgaagacgggcaaccgcatgaacaccggcacgaaccgtgggaacgcccacgcctttaagctggacgcgctcctaagctagtcgac

SEQ ID NO: 50704 - DNA, 372 bp, Zea mays
  Clone ID: LIB3067-042-Q1-K1-B6
gccaaagagaaggaggagaaagatcttgtgtctcagcagaacatgtatgcgcaactgcttcctcttgctctgcctgctccgccaatgcccggcatgggtggccctccacctccgatgggcggaatgggcatgcctccgatgggcgggatgggcatgccgccgatgggccctggtccgatgccagcattcgggatgccaccaatgggaagctactgagatgtttttttttggcagaaagcttagatgatgatttgatatgttcctgtgtaagcagaggcggaaacctcattggagttgtagatggttacattttggaattaatattctttatggtaccaggaaatttttggccagtgaaaatctggccagagt

SEQ ID NO: 50705 - DNA, 408 bp, Zea mays
  Clone ID: LIB3067-042-Q1-K1-B7
gagatctagagcgagggtatggagtgtaaaatgtccacgaggctgcggcgccggggtcgtcggtgctcggccgcgcggtggaggaggtgcgctcggccctcaacgagcacgccgacgtggttgccgacctcttcggtcgcgtctcctccgaagtgcgcaccggcttcgcgcccgccgtcgactccttcgttggcttcttccacgccgtcgactggaaggagccttggctgatcagcatactatctttccatgccattctgctactggttaccatcatcttgaggagggatatcaatttccagctcatcttgtcagctctaacatattctggtgtattccttggctgaagattaaatacgttcctggcgcaaaaactggaagagctttctttaccccaatactattttg

SEQ ID NO: 50706 - DNA, 79 bp, Zea mays
  Clone ID: LIB3067-042-Q1-K1-B8
cccacgcgtccgcccacgcgtccgttcgaaatctatgccacaacctgtacctaatccttcggttcgcttaccacttacc

SEQ ID NO: 50707 - DNA, 428 bp, Zea mays
  Clone ID: LIB3067-042-Q1-K1-B9
cccacgcgtccgcgtgcctttccccacctactctcgcggcttatgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaatggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgatctgtgttccgcgatgttgcagttggttgcttgatcgaaagatg

SEQ ID NO: 50708 - DNA, 370 bp, Zea mays
  Clone ID: LIB3067-042-Q1-K1-C1
tcgggcgaggttggtcaaaatggaggtggagctcatcttcagcacggcggatgagatgaaatgggcccctaagaccgcagttacatgccaaagatgcaaccatggagaagcatacttcaagcagatgcagattcgatcagctgatgaaccgatgacaacaatatacaggtgttgcaaagaagaatgccagcatgaatggagagaggactgaccatagcattcgcactttgcttacacttcgctccctgtgcttcttcagttttgagtgttgggatgccctgttgcacatgtaatgcttctaaatagcgtatacttaagtacaaatttttggaaatgtatgttctatactatggcatccgcttttggctgc

SEQ ID NO: 50709 - DNA, 179 bp, Zea mays
  Clone ID: LIB3067-042-Q1-K1-C11
ccacgcgtccgaagtcaagaaggaaatttattgccccctttttttcacctccaaggggggacttaagggggcatcataagtacctcagaagaaacctgccaaggtcgtcccaatgaaggaaccggttgaagagagaaaggatgctgctatgtatttggtgttattgatgtaaccaatga

SEQ ID NO: 50710 - DNA, 223 bp, Zea mays
  Clone ID: LIB3067-042-Q1-K1-C12
acgcgtccgatcgacgtgcagacataccttaacaagcttaatatggtaccacgcatctattgaaaactgcgaaacttttaatccccaaccggggacttacatataattgaatattcagtaaagcattgcagtatggtgtatacagcgcaaattgtctgaatgaccccaccacaatgtaccccacctttattacaaataacatctaatcacacactaacataac

SEQ ID NO: 50711 - DNA, 153 bp, Zea mays
  Clone ID: LIB3067-042-Q1-K1-C2
caaagacatgcgagtaccagacatgtgcaattctagtagtatggtgcgtgttatcactaggcacgcgtactcgtatagttgtgttcagttctgggtctatagagatatgtagccctgcattgtcgaaataaatactgtgtccactcgttcgtg

SEQ ID NO: 50712 - DNA, 447 bp, Zea mays
  Clone ID: LIB3067-042-Q1-K1-C7
gcatggaacaccctctggttttttggatttcctcgccctgtgcttttgaattcatatcaagctagcatgcagaagttccaaggcaacaccccggtgtatttggcccctccaatcatggcaactgggaacctgccattggtggtaccaagccctgcaccacttgtgcagccgttccaggccattcatcccatcatggttcctgctgcaagcagcgtggtcccaggaaaatacatgtgaacttgtcataccaatgacaatctccttctgttggaagagtcctggctttccagttacccctttggtttggggtatacgtctgaaaggactccgcgattttgcctggtctgttgattcacttgtcagttgctggtctgtgtccgtattttaagttgaagggctttgcaaccttgtcaatcttcatgctctgtgtgggttttcgaaatattc

SEQ ID NO: 50713 - DNA, 167 bp, Zea mays
  Clone ID: LIB3067-042-Q1-K1-C9
ccacgcgtccgcccacgcgtccgcccactcttccgaaaattataaaaccacccaaaaaaaaaaaaaaaaagagacaactttaaaaaaaaaacgaggcaaaaaaaaaacaaacaaacaaaaacaaaaaaagaaaaaaaaaacaagccaaaacaagaagacaagaccag

SEQ ID NO: 50714 - DNA, 319 bp, Zea mays
  Clone ID: LIB3067-042-Q1-K1-D10
gtttgacgcccgcatgaccaacgccaaagagcatggcaagctagtggtcatttacttcatggccccctggtgcagagggtgccagatgatggccccggtgtacgcggactgcgccagcaagtacccttccgcggtcttcctcgaggtcgacgtcgacgaactgctggaagtcgcgaagatctacggcgtccatgtgatgccgaccttctgctacatcaggaacggcgagacgctcgagagctttgctaccgtcgacgaggacgagctccgggacgccgtcaggaagtacgccgtcgttggcactacgacggctcctgcc

SEQ ID NO: 50715 - DNA, 210 bp, Zea mays
  Clone ID: LIB3067-042-Q1-K1-D11
agcgatcccactcccgatcattcagctgattgctcactcttgcagctcggtcattctttagctgctctagctctagccctagctagtagctagccactcggtcgtgtagtcatcagccttctgatcgtcacccatggccactgcctaggtccagaccccgaccgtcgtggctaccgaggaagcgcctgtggtggagaccccggcttcgtc

SEQ ID NO: 50716 - DNA, 444 bp, Zea mays
  Clone ID: LIB3067-042-Q1-K1-D12
cgacgcgacccgctcgctctcgctctcgtgtccccagtccgatcgggtcggtgcctaccgacccccgctggccgccgcacccaggcgaggcgaggcaaggcgcgtcccgaacaacggaaccaactgcaccgaccgagtcaatcaatccggcgagtgaccgagtggggtaggttgtgtgcggcatgacgaccacgcgcgaccgtggcgccggcggcggatcggcgtcgagggtcggtgacggggacgtcgacctgggcgagggctgggactggggcgccatcccgcggctcctctcctccgcctgcctcttcctctgctccggagcagaggctgttttggttgctgcgataagactgtaaagcaactgggtgaactgtccagaaacttgatcacccaggaccaaattaccattggagagccattttggagcacaaccaccatcga

SEQ ID NO: 50717 - DNA, 325 bp, Zea mays
  Clone ID: LIB3067-042-Q1-K1-D5
gtacaatgtatacgttcacagcttcttgctgtatggttcctttgcatcgcgagcggagattctgaagtccaagaacggaccattcagctcctgcatgctgcgcggatttagtggtaaatatacctacaacggacagcagttcgatgcgactgctagaccagaaggagcattgtatgacaaatgcaggggagagattgccaaggcgatgaatctcaaggcaccgtgcaaggcaaagaactgcaccttcggtggtgtgtggaatgggggaggtggagctggccaaaacgacatctaagtcgcgtcaggtttctactacctttgctta

SEQ ID NO: 50718 - DNA, 123 bp, Zea mays
  Clone ID: LIB3067-042-Q1-K1-D6
tcggttctagatcgcgagctgccgctttttgtttattttttttaacaaaccattgatgcattggaagttgtggcaaaataccacgaggtggttcaatacattactaacaaacaatgtttcgcc

SEQ ID NO: 50719 - DNA, 456 bp, Zea mays
  Clone ID: LIB3067-042-Q1-K1-D7
cggacgcgtgggcggactcgtgttatggatctcgaaagatcagctcaaggttgaagttacgtcagtttttggatctgctgcaccttcactcaaagtgaatcttgtgcaagtgttgggatctgactctaaagtcatcactagtgagaacatggatcttcaatacgaccttgacaacaatgtccattacttggacattgctttcattgaaaattgatgttgggaaacactctattgtatttgagattttactttttgtacctttagctgagattgtttttgctactggttctagttacatataaagtgtttttgtctcatttttttataaaagtttatatggcttatattttttattttttttatgtttctctttttctttttatattatttttattttttttatttttttttttattttatttttttatttttttttttttatttttattttctttt

SEQ ID NO: 50720 - DNA, 405 bp, Zea mays
  Clone ID: LIB3067-042-Q1-K1-B12
cgcgtccgagctcatggatccagtggatcgcgccgtgtgtatcgacagaaacgaatgatcaaaaacgcgggagtctgctgcccggtcacgggagaggaagcaggcttatatcgccgagctagaatcgctggtaacgcacctcgaggaggagaatgccgagttgttgagagaacaggaagagcggcaccagaagcggcttaaagagctcttggaacgggtgacgccagtcattctgaggaaaaaaccatcaggagatcttagaagaacgaactcaatgcagtggtagattggagccaagctcagtcgccgtctctttacagttattaacatagaatttgcccctgtatgtcatttttctatttatatatgcgccaactaagttgtagtatcttagctgaaatagca

SEQ ID NO: 50721 - DNA, 223 bp, Zea mays
  Clone ID: LIB3067-002-Q1-K1-H2
acgcatgcgtgctctgcgtcgatattgactagtaggactgctgagcccgctagaagcgggagcatggacacccaagtgaagcttgctgttgtggtaaaggtgatgggcaggacctgctccaggggtcatgtgacccaggtcagagtgaaattcttggatgaccagaaccgtctcatcatgaggaacgttaagggccctgttcgtcagggtgacatactgaccc

SEQ ID NO: 50722 - DNA, 436 bp, Zea mays
  Clone ID: LIB3067-002-Q1-K1-H4
gctaccctcccgcgggccctcctctctctcccacccttcctcctcccaccacatcctgcgtgtgtcagcccgtcgttggctccgccttctattgccgtagggaacacgcggcgtcgcccttgcgctcctcgccacatgctgttacaggctgtcgtacccgtgtccacggttgagggccttgtgccggtcatgttgaagaagaagcccatcgactagatctagctcgtcgtcgggcgcctctctgccgaagagagggagcgcctactacgaggtgccagctcgtgctgatgtcactactgcttccactcctcccagagtcccagtacacccccggcttgtggcatcgctgctcgccgcggccctgcacctgagccctgcctacatcccgagtcacacacctatcctttgaagaattaatggcgactggaagcaggtt

SEQ ID NO: 50723 - DNA, 58 bp, Zea mays
  Clone ID: LIB3067-002-Q1-K1-H6
cggacgcgtgggctaccgggttattgagaataattatggctgtttacgttgttgctgg

SEQ ID NO: 50724 - DNA, 258 bp, Zea mays
  Clone ID: LIB3067-002-Q1-K1-H7
ctaggattgccagcgcggcaaatgcgattgtctagtggaatcagttgatcgaaatttacttcaaataacatttgtttgtgttgcgaattgggaagagagtttttagttagacgagcttttgatggccctaaagatgttttcccggatgatgtttgtgctgctggaccgtttcctgttagcttcgatggcatcctccccatatcgataaactgttgcttagcctgacaatcggaagagtttaaatgttaaagatttgat

SEQ ID NO: 50725 - DNA, 402 bp, Zea mays
  Clone ID: LIB3067-002-Q1-K1-H8
cccacgcgtccgggccgccctttttttttttttttggtgaaaaacactgatattgtgagcattaatcacgcaacatctgtttcctcgcaggtatgggtgaccagacactagaacagctcccatagacagctgaatctttgatttacatcaaacagtgtttacttatatatggtcatatggagtcggggcacgaatacatattttcttcctgtatgttctatcttctgcgttccagcaagatgtgttgtttaactacaatacagagggacggtggccggcttgtagaggaaaggcttgacggtgtgcggattcccagacggatttgttgtaagtgaacttcaccccagagtgagcatcaccccgccgtgtgcaatgtagatggaagctgctcataggccttgg

SEQ ID NO: 50726 - DNA, 436 bp, Zea mays
  Clone ID: LIB3067-002-Q1-K1-H9
cccacgcgtccgcccacgcgtccgctagccatcccaggttgctccggccgcatgcccgccgaccgccgaccgccgaccgccgacgatgcctcccaaggccaagaaggacgctgcgccgtctgagcgccccatccttggacgcttctcctcccacctcaagatcgggatcgttgggttgccaaatgttggcaaatcaacttttttcaacatagtaacaaagttggctatcccagctgagaattttcctttctgtaccatcgaaccaaatgaagcacgggtgaatgttccagatgaacggtttgattggctctgcaaactttacaagccaaagagtgaggtgcctgcatatcttgaagtaactgacatagctgggcttattagaggtgctcatgctggggatggtctgggcaatgcattcctctcacatatacgtgct

SEQ ID NO: 50727 - DNA, 442 bp, Zea mays
  Clone ID: LIB3067-003-Q1-K1-A10
ctgaggtgtgcgaaagaaagctggatgagtaccttctcactcgcagctacatcactggctaccaagcttccaaggctgacttggctgtgctacactgcgttcatcgtctgctcccatcgcccaaggatatcaactcagcaaggtggttgaatcacattgatgcgctctataggctgcacggaattactgcaaagggccaaggtgtgtaggttgaatcacatgcagctccttcagacccatctccatatcttgctgaacctcacgccctaattgctcacgaggacgacgacgatgacgttgacctttgtgatgaggagaccgaatatgagaagaacgctgctgaagagcgtgctagaactgccaaggctcttggcaagaagaaagaatctgggaagtcatcagtcttacttgatgcgaagccatgggaccatgagactgacat

SEQ ID NO: 50728 - DNA, 308 bp, Zea mays
  unsure at all n locations
  Clone ID: LIB3067-003-Q1-K1-A11
attcatcgtacctatcttggtggggtgatcaacttcactgatggatctgttgaggtgctggctgcaacacaaatgcctggggaggctgctggttggttccagggcacagcagacgccgttagaaaatttatctgggtacttgaggattattacaagcataaagctatagaacacattttgattttgtcaggagatcaactctatcgtatggattacatggagcttgtgcagaaacatgtcgatgacaatgcagacataactntatcatgcgctcctgttggagagagtcgagcatctgactatggatt

SEQ ID NO: 50729 - DNA, 97 bp, Zea mays
  Clone ID: LIB3067-003-Q1-K1-A6
cccacgcgtccgaccacgcgtatgctcactcgttcgctgaaggttcagaaacaaagttggattcttttatgaggttgcttacggagttgttgggaga

SEQ ID NO: 50730 - DNA, 222 bp, Zea mays
  Clone ID: LIB3067-003-Q1-K1-B11
ggcggagcagcggccgtcggtggaggacgtgctgtggaacctgcagttcgcggcgcaggtgcaggacgactggcgcggggactcgcggagcagcgccagcgaggagtcgccgctgtcgccgtcgcagatcccgccgcggagggacagggagaccagcgcctggtaataagccaagcccgctctaggtgactgttgttgggcgatccgatcaggcggcgaggc

SEQ ID NO: 50731 - DNA, 392 bp, Zea mays
  Clone ID: LIB3067-003-Q1-K1-B12
gtgctggtgcggcgagtgcaccagctggtcgggcgtgtggacctgcgacgacctcctcaccaagtgcgccgtcacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaagcaggcagccacaccaataagctagctcttgttgttgttttgtatgtttgattgggtgtcccttcccagtcgagatggaataaaataaatcatcaggcgccaataagcaaaaaaaaaacaaataaaataaa

SEQ ID NO: 50732 - DNA, 59 bp, Zea mays
  Clone ID: LIB3067-003-Q1-K1-B5
caaacgggcgacttggtaccaagacaggatgagccatccaccctgcattgccagagacg

SEQ ID NO: 50733 - DNA, 167 bp, Zea mays
  Clone ID: LIB3067-003-Q1-K1-B9
ctcccgccgcgctggcgcaggctcccggccccgcggcgacgcctagcgggccgccgaacgtgacggcgatcctggagaaaggcgggcagttcaccatgttcatgcggctgatgaaagagacgcagcaagacacgcagctgaacagccagctgaacagctcgtacgcc

SEQ ID NO: 50734 - DNA, 437 bp, Zea mays
  Clone ID: LIB3067-003-Q1-K1-C10
cggacgcgtgggcggacgcgtgggttttgagatcaaacacaagatggtataagaaaccaataatacaatacagcacagacacagcaccctcaggccggcctcagaagaggaggaaaaagattaacaaaaaagattgaggggtagcataaaaaaaagaagtaaaatacaaccactactcttgttcatcatcatcatctcctacagtatcatcgtgtgcatggacccaggaagcagagctgcagcgttcttccctcctccgttccaggcacgaacgaacgcccggatcccggagccagagggctcggtcacattatatactcgtcgtactcacatcgcgtcaggtgccttattcgattccctaccgttcatcagctacgtacggtgtgcggatcagtcgaacaagctggcgatgtcgtctatgtcgacgaggatgagga

SEQ ID NO: 50735 - DNA, 443 bp, Zea mays
  Clone ID: LIB3067-003-Q1-K1-C11
cccacgcgtccgatgcaacaacaagcaatgacaagaaggtgtcagagttagatttgtacatgagcgaggacctagtgaaggtcaatgacaatgaagcaacgtttgatatcctatcatggtggaaagggcaagtcacaaattttcctattctttctacccttgctcgtgatgtgttgtctatgcaagtgtctactgttgcttcagagtctgcatttagttcgggtggacgcattgttgatgcattccgttcaagactcaaaccagaaattattgaggcattggtttgttgtaaagattggaagattgcttcggagaaagatttggagattgaaattaaaaccttaagtgaagctatgaatgacgttgacttggaggatgctgctgcaattagaacttgagaagttaaagttcaagttaccatggatgatgttgaacttgttact

SEQ ID NO: 50736 - DNA, 444 bp, Zea mays
  Clone ID: LIB3067-003-Q1-K1-C12
caaacagcaagcgaagcatcgccagattggtatatcgatcgattgatcggtggcggaggaaggggaggacggggggcagatggcggcgtgccggggcttcttcgagtgcctgctcaggctgctcaacttcatcctcaccgtcgccggcctcgctatggttggttacgggatctacctgctcgtcgagtggatgaagatatccgaggacggcatcggcggggcttcgacggcggaggtgctcgtctctggccggccgttgttgggggctgtcattctcggtgacagcttcctcgacaatctacccaaagcatggtttatttatttgtttattggtgttggcaccatcgtcatcttggtgtctctgtttggctgcattggagcatggacaagaaacacctgctgtttgtgtttcgtatcctgttatgtgcctcttcggcgtcatta

SEQ ID NO: 50737 - DNA, 226 bp, Zea mays
  Clone ID: LIB3067-003-Q1-K1-C5
agcatctccgctccggctgcgctcagccttgctttcctgctacctgctctagcgcgagcgagagaggtacggcggccgatctggcggaacatgcggagggctcggccgttgcacgttagtcggcgccatatatgtggagggtcctgatcgagctcaagcggatggagaacaagttcaattgccatgtcaccagcgccaagcgccgcaacggcctgctcaagaaggc

SEQ ID NO: 50738 - DNA, 439 bp, Zea mays
  Clone ID: LIB3067-002-Q1-K1-H11
cccacgcgtccgcccacgcgtccgagagcaccttgtgatgctttgcagatctgaggctgatgcaatggggaggatcactgctggaattcttcgtctccttaaacttgacaaatctcttgggcaaggaactatagaacaactacgtaacctatgaagtgtaggcatggacaatatcttttcacccaggaggctcaacaggcagaacagctttggtagcataggcactcctcggactccaactatgcaagccattgcagacgtcatgagttcgaaaaccacactggaagcaactatttcctcattacaaggcgagatttccgaatccaaggccaaatgtatggcactgatttctcaagcaagcagcactgatgatcaaaaccgtgccgaggacatcaggcagcttagcgaatagctcgagagcatgcaattcgtggtgaca

SEQ ID NO: 50739 - DNA, 227 bp, Zea mays
  Clone ID: LIB3067-003-Q1-K1-C6
cagtaggcgcatatatttggcagcaggagctgcctctcacttgcttcgacgtatttctctatctatcgatactgttcaagggaccgaataaggtagagagagaaacttgtttgtgataggaaggagatacatgttcatgttcatttaggtgtcagttcatctgatgtctcagaagcaaaattgtgtttggagctcagtgacaccattttgtaatgcatgttcctttt

SEQ ID NO: 50740 - DNA, 273 bp, Zea mays
  Clone ID: LIB3067-003-Q1-K1-C7
cccacgcgtccggcagtaataattttagaagatcgattcttaatattgatgacctattgtaatgtcttggtgcatgttaatggatggtatttctcaccgtgaccactctgcttagccggtaagaactgagccactgataaggactgaaactgctcacgtgctttgttgttagcagagtgctcatgattcaaggaagataattttccattttttctgtttggtcaacgaaacacacagaatgtgtactattgtacactgcatgctgttatttgc

SEQ ID NO: 50741 - DNA, 415 bp, Zea mays
  Clone ID: LIB3067-002-Q1-K1-F3
cggacgcgtgggcactcatgcaatcaacaaggatctgaaagctgaccccaaggatgaggttctttcaacactgcgggcgatcatccggtgcttcacctgccctgacagatacttcgagaaagtcattcgactggctcttggaggcatgggcactgatgaggatgacctcaccagggtcgtaactactcgcgccgaggtcgacctgaagctgataaaggaggcttatcagaagagaaacagtgtgccgctggagcgtgctgtggccaaagatacaactagagattatgaggatattatgcttgccctccttggggcggagtgaggaggcgtgcctcaactcgatctcatctgctcctacttgtttgatggggccaaaaaactgcatcgacgtggtatccacatggccgtggttttg

SEQ ID NO: 50742 - DNA, 216 bp, Zea mays
  Clone ID: LIB3067-002-Q1-K1-F4
ccgacgcatgcgcactcacgcacttaacgagcttctcaaagctgaccccaaggatgaggatctttaaacactgtgggcgatcatacgatgcttcacgtgccctgacagatacttacagaaagtcatgcgactggctcttggaggcatggacaccgatcaggatgacctcaccagggtcgtatctactcgcgcctagggaggcctgcagctgttaaa

SEQ ID NO: 50743 - DNA, 235 bp, Zea mays
  Clone ID: LIB3067-002-Q1-K1-F5
gtaccggtcctgccttctcgacccaagcgttccctgacgcatcagctctcatgcaatcactaggatctgaaagctgaccccacagatgagggtgtttcaacactgtgggcgatcatccggtacttcaccttgcctgacagatacttccagaaagtcattcgactggctcttgaatgcatgggcactgatgaggatgacctcaccagtgtcgtaactactcgcgccgaggtccacc

SEQ ID NO: 50744 - DNA, 275 bp, Zea mays
  Clone ID: LIB3067-002-Q1-K1-F9
tcccgatcaacccacctccgcccacctccaaacccatcttctacttccaacactctttaaacactggggcgcacaactacggtctagtacacaatcaacaaactaatctcaaaacatactcaccaaaacttactatattcaacataaaaacacttactcaaaacactccttacatcctctacaacattatatttccacatctctaatacacaaagtcatctaatctctttcaacgatcaatccaaatgtcacaatgctatgctgaatcaatatat

SEQ ID NO: 50745 - DNA, 195 bp, Zea mays
  Clone ID: LIB3067-002-Q1-K1-G1
gcgcccacacattcgcactcacgcattctcaatatgtctcagggattttacatccgttgaaggggtttcttgaaggggaccgtatacactatctatcagaagatgataaagctaagttgtgtcatgggtctacagataagataactgcaatttactatgacttggtctctgaagatgtcactgtgacaaggaaaa

SEQ ID NO: 50746 - DNA, 407 bp, Zea mays
  Clone ID: LIB3067-002-Q1-K1-G10
aagccacccgttacgtaacacttgctgaatatgttatatgttatgtatggtgttctataacactataaggggaggcgtatttattgaggaatgatgtctatatatgcaactagactatacccatttaattctgggaatgactgctaattgtgtcaactaatactgaatggaactttgatatgcagagttaaaaggacactgtttcactatcgtcgcacaaactatatatatgtagcctaaatctaacttgaggactagaatcagaactgatggccctgtctgcataacaaggatgtccaatgagacactactggtttcacgcatggaatacttctcggaagtcatgaccgtttacaagccaaggcttcttacatcactgaagctataggcaatatattgatctgatg

SEQ ID NO: 50747 - DNA, 420 bp, Zea mays
  Clone ID: LIB3067-002-Q1-K1-G11
gtatttgtattgcaggaactatcctctcctgatggctacatggaaggtagctcctgctctggctgctggttgtgcagctgtgctaaagccatctgaattggcttctgtgacttgcttagagcttgctgatatctgtaaagaagtcggtcttcctcccggtgtcttaaacattgtgacaggattaggtcctgatgctggtgctcctttgtcagcacacccagatgttgacaaggtcgcttttactgggagttttgaaactggtaagaagattatggcggctgcagctcctatggttaagcctgttacactggaacttggtggaaaaagtcctatagtagtatttgatgatgttgacattgacaaagctgttgagtggactctgtttgggtgcttttggaccaatggtcagatttgcagcgc

SEQ ID NO: 50748 - DNA, 427 bp, Zea mays
  Clone ID: LIB3067-002-Q1-K1-G12
gtgggcgaaaccatcctgtttggcgacagtgaccccacctccagcaagcccaagttcggctcgtactggatcaaggacggcaaggtcttgggcgccttcctggagggcgggtcaccggacgagaacaaggccattgccaaggtggcgaaaacccagccgccggtcgctaacctcgaggagctcaagaaggatggcctccagttcgccagcaagatctgagacgctcccgttccatgtaaaattccgtgtcatcgtgaaggttcttctggagctctggtcatgattgagaaatgttctgctacagatgttatactacatacgtgactacactacatgatatattcggttttctgattgtgatatctgtacgtggctacactcacatgtgagatttgaataagtcctgcagcctcagggctcagctagc

SEQ ID NO: 50749 - DNA, 419 bp, Zea mays
  unsure at all n locations
  Clone ID: LIB3067-002-Q1-K1-G2
tccacgcgtncgtccctctatgcttcaaagcaggggaggatgcagacaccctgggcctaaccggccatgagcgctacacggtccaccttccaaccaatgtgagtgagatcaagcctggccaagatgttaccgtgacaactgataatggaaagtcgttcacttgcacactcagattcgacactgaggtggagcttgcttactacgatcatggtggcattctaccatatgtcgctagaaagatagcggagcaatagattgtaccgttgagatggttgcgatacttgcggtgaatcgtaattggtgtaaacggtttggttagtagtacaacccatttttgcggactacttataataacctctgagtatctcagagtgagctgtctgaaatttgatgaactgctacaattctggtgcgccatg

SEQ ID NO: 50750 - DNA, 417 bp, Zea mays
  Clone ID: LIB3067-002-Q1-K1-G4
tcgcaaggaccttcggcgcccgttcaggatccacatcttcccgagcgagttcttggttgggctgttcctcttcggaccacctacaaagctcttggtgtagcttgccactctcaccaatcaagttttcatgtctgatctcgacattcaaatcccaactgccttcgatcccttcgctgaggccaatgctggggactctggtgcagcagcagggtcaaaggactacgttcacgtgcgcatccagcagcgtaatggtcgcaagagcctgaccaccgtccatggattgaagaaggagttcagctacagcaagatcctcaaagatctcaagaaagagttctgctgcaatggtacagtggtccaggacccagaacttggacaggtcattcagctccagggtgatcagaggaagaacgtctcgaa

SEQ ID NO: 50751 - DNA, 423 bp, Zea mays
  Clone ID: LIB3067-002-Q1-K1-G5
aaaacagggctttcctgtgacatatgcgtcaataatcttttagcagttgttaacacagaacttttgcgagattatggacaaatagataaaaggttacagcagttggcattcattgtgaagcattgggctaaaactcgacgtgtaaatgaaacttatcaaggaacactttctagttatgcctatgtgattatgtgcattcacctcctacagctgcgaagaatactcccatgtctacaggaaatggaggccacttattatgtcaaggtggaagaaattaactgcgcttactttgaccaagtggacaagctaaataattatggtgctcacaacagagatacagtatcaaggctgctctggtcctttttccattactgggcatatgagcacgattacacatgagatgtcatatcaattcgtactggg

SEQ ID NO: 50752 - DNA, 242 bp, Zea mays
  Clone ID: LIB3067-002-Q1-K1-G6
gttataatccgttaggtgagcaaaaaaaaaaaaaaaaaaaaaacaaaaaaataaaaagggacataaacactgcgcggtatcaacttgaaaccaatgttaaatatgatcaagcctgtccaatatgttaccttctcatctgataatcaaacgttgttctcttgcacactaattttaaacactccagttgaacttccttacttctatcattttaactttttaccatatatacctattttgatacc

SEQ ID NO: 50753 - DNA, 325 bp, Zea mays
  Clone ID: LIB3067-002-Q1-K1-G8
actccctgcgccagcgacactggtacatccagagcacttgtgccacaactggcgagggtctgtacgagggcctggactggctgtccagcaacattgcgagcaaggcttgaatatcaaatgcgaactgactaggagctccggatgtatcatggaaacttaggacagaatcgcctcttcaacctgttaggtgtcttctaccggcacaatatattttttgtttggaatatgtaatgatgttacggttcaacgtttattctaccctactatactgttggatgttctttgggcctgggtcattttgcacaaggattggaggtccaatatc

SEQ ID NO: 50754 - DNA, 409 bp, Zea mays
  Clone ID: LIB3067-002-Q1-K1-G9
cccacgcgtccggttgatttcagcaatgataattccattatctggacatctggtacttgtctttgatgtgcaatctgacttccattagcatctagataagatccaatgtttcccgttaatggctaccaattgatttaacttatacggttggtgactttggtatgcagattaagaagttcagggatgcacttgcaaagcacaaagcagataaatgtagccttggcccaacttggggactagaatcagaactgttggccctggctgcaaacaaggatgtccaaggagacactactggtttcaagcatggaagacttcgcggaggtcaggaccgctgacaagccaaggcttctgacatcactgaagctataggcaatatagggatctgatgacatgcgagagatgaaatgtg

SEQ ID NO: 50755 - DNA, 414 bp, Zea mays
  Clone ID: LIB3067-002-Q1-K1-H1
cccacgcgtccgcgcttcgcgtcacccagagctcgtcggcctccgtccccgctagaagcgagagcatggacacccaagtgaagcttgctgttgtggtaaaggtgatgggcaggaccggctccaggggtcaggtgacccaggtcagagtgaagttcttggatgaccagaaccgtctcatcatgaggaacgtcaagggccctgttcgtgagggtgacatcctgaccctgctcgagtctgagagggaggccaggaggctgcgctgaagcccttgttgtcttggatgtaattctgttaattttgttcaatgtttgtcgaacttgccgtgtgacccatactatatctgctttgggatttagtaagcctggattgcagttttttttatgttcctggtggaaattgcaattgtttgtcggc

SEQ ID NO: 50756 - DNA, 388 bp, Zea mays
  Clone ID: LIB3067-002-Q1-K1-F2
cccacgcgtccgcccacgcgtccgggatgagctggataaggaacgtggtatgcagtgtgaaatgtttttatgggcagggaagaaatttccctcatttccaggacgggaacaatgtccgcaggtcgaggaatgctggcttcgaccttttcttttctttttctttcttttttgtttcgacatgtagatgcaaacttcgagaggcaagcatgtgtggtctttgtgagattacggcgatattctatatcgtcaaccataaccgaagtcctattgataatttaaggatttttgggaggcctcaggcttaaaaaccaatgtcagtgaatgtagtatgacttctatccaatgtaatgatcaatgtgttggtgaggcacaatctttattcccttgc

SEQ ID NO: 50757 - DNA, 423 bp, Zea mays
  Clone ID: LIB3067-002-Q1-K1-D6
cccacgcgtccgaccagacaagcaaggtatcccccgatggctcatcgcgttctcctgctcctctctctcgcggctgccgccgcggtagccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctatccgttttcaaggccaacctgcaccgcgcgcgccggcaccagctgctggacccgtcggcggagcacggcatcactaagttctacgacctcacgccggcagagttccgacggacctacctcggcctgcgcatgtcccggcgcgctctcctgagaagacttcgggagtctgcgcacgaggcg

SEQ ID NO: 50758 - DNA, 420 bp, Zea mays
  Clone ID: LIB3067-002-Q1-K1-D7
cggacgcgtgggcggacgcgtggggaaggctcaagagcttggcctgcaagtccttgcggggatcagaggatatgcagatgcggctcaagctccggaactttttacaaccaccccagcacttgcgataccaaaggctatatcaaatgctggattagagtcatcccatgttgatttttttgagattaatgaagcattttctgctgtcgcacttgcaaatcaaaagcttcttgggattccttcagaaaagattaatgtccatggaggagctgtgtctctagggcatactcttgggtgcagcggtgctcgcattttggtcacccttcttggtgtccttagggaaaagggcggcaagatcggtgttgctggtgtctgcaacggcggacgtggagcatcagctcttgttctcgaactcgcataaga

SEQ ID NO: 50759 - DNA, 238 bp, Zea mays
  Clone ID: LIB3067-002-Q1-K1-D8
ccgacgcgtgggaaaacacgtactgattgctcaagagcttggcctgcaagtcctggggggtatcatatgatgggcaaatacaatttaagctccgaaactttctactaccaccccatcacttgcgataccaaatgctatatcaaatgctggactagactcatccaatgttcatattgttgagattaatctagccttttctgctgccgtactagcaaatcaaaagttacttgtgattgct

SEQ ID NO: 50760 - DNA, 382 bp, Zea mays
  Clone ID: LIB3067-002-Q1-K1-D9
aatctctcatctgagatacagacagattaatcaacgcccgcacctcctatgggcacgaccggcgacgctccggctccggcgggggatccgcaggaccgccaccgtacccaacccccggcggcgaagcagcggacgacgctggtgttcacgtacgggacgctgaagcgcggcttctccaaccaccgcctcctggaggagctcttcgcgagcggggacgcgtcgctggtgggccccgcggtgacgtcggcgcggctgccgctggtgtgcgggccgtaccgggtgccgttcctgctgaacctccccggcgccggcgccggggcgcaccgcgtgcgcggggaggcgtacgcggtgacgggccgcgggcttgcgcggctggacgagc

SEQ ID NO: 50761 - DNA, 366 bp, Zea mays
  Clone ID: LIB3067-002-Q1-K1-E1
cggacgcgtgggcggacgcgtgggatattttcatagggaacttctgagtggcgacaaggagggtcttcttcagctcccaagtgacaaagccctgctgagcgaccctgtcttccgccctcttgtggagaaatatgctgcagatgagaaggcattctttgatgactacaaagaggcccacctcaagctctccgaactggggtatgctgatgcttaaatgtccatatcctggagcgggacacaaactgctgcctgtatggactcgtgccaatcaaggtgaaccatcagattgtctagaggcttctttggaataaatttatctggtcttgggactttggctatgggtgaatcggaacccattttccgttt

SEQ ID NO: 50762 - DNA, 443 bp, Zea mays
  Clone ID: LIB3067-002-Q1-K1-E10
ctcgccggcgacgagatccaccgcaccgccttccttcccgtcttcccttggcattccgctgtgtcttgagaatgagtagggtaggagctccaggagcagttcttccccttctcacagaatcgccctccctgaggcaaccatcttaacaacaaaagaggctcgtacaatcacagctgcaactgctaaaccacttgtgcatgcaaagtatcaaaaaggaggccagacacaggttgatgaaacatctaaaaaggcaataaggatgtcaaatctgcagctttgccaacatgagtagtctatattcgcttccccgcaccctccacttccttgtcgtcgtgctgattccagatcaaggggtagtgatccggaaggtggctatggtttttgtaagtacgaggcttaagatcttgttcaaggaaggtggctatggtacttttgatcctctg

SEQ ID NO: 50763 - DNA, 119 bp, Zea mays
  Clone ID: LIB3067-002-Q1-K1-E11
gccactatatctgacgggcgcaacttgttatatatctagggatgggatgtcgtttggcatgtactccattttgaaagtgtccaagtgagactttatacatatatgcagttgagagatgg

SEQ ID NO: 50764 - DNA, 397 bp, Zea mays
  Clone ID: LIB3067-002-Q1-K1-E12
aataagacgacttgtttcattgattcttcaagagatcgagcttcttttgcaccacaaggtcgaggatgtcttgcagctgcggatcaagctgcggctgcggctcaagctgcaagtgcggcaagaagtaccctgacctggaggagacgagcaccgccgcgcagcccaccgtcgtcctcggggtggccccggagaagaaggccgcgcccgagttcgtcgaggccgcggcggagtccggcgaggccgcccacggctgcagctgcggtagcggctgcaagtgcgacccctgcaactgctgatcacatcgatcgacgaccatggatatgattattatctatctagcttgtggtggtggttgaacaataataagcgaggccgagctggctgccatacataggta

SEQ ID NO: 50765 - DNA, 240 bp, Zea mays
  Clone ID: LIB3067-002-Q1-K1-E2
tcgcctatactccccgtccactgaaagcagcagcagcagcgccggcgcatcaccgtcatcggcatcggcctcgcagtgacggtcagtcgctgttaagccttggtgtggttcttgatgttgctttgtggatcgatggaggttgcctctggtcattcggatcccatgtttaaccttgatgacgaacattgtaaaaagcattttgttttatggactggaatagtctgcatacatcaccatagc

SEQ ID NO: 50766 - DNA, 69 bp, Zea mays
  Clone ID: LIB3067-002-Q1-K1-E3
aaaaaacaaacaaaaaaacaaaaaaattttaaaaaaaaaaaaaaaaaaaaaaaaaaaaaaggagggaat

SEQ ID NO: 50767 - DNA, 288 bp, Zea mays
  Clone ID: LIB3067-002-Q1-K1-E4
gcgcgaaagcacccgttctgtcccctcgcataaccctagctccagccaccatgaagggcagggcgtgacacctccaagaaggacgagggcaggctccgggcgggcggcgccgccggaaagcgcaagaaggccgccgcgagcggcaagcccaagcgcccgccctccgccttcttcgtcttcatgtctgaattcaggcaggagtatcaggcgctgcacgctggcaacaagagcgttgcgaccgtgagcagggcagcaggggaaaagtggcgtgctatgtcatatcaagag

SEQ ID NO: 50768 - DNA, 335 bp, Zea mays
  Clone ID: LIB3067-002-Q1-K1-E5
cacaaaaacaaacacaaaaaaatttattcataaaaaaacaaaaaaaatgacaacaaggggggtcttatacagctgccaagtgacaaagccctgctgagcgaccctgtcttccgccctcttgtggagaaatatgctgcagatgagaaggcattctttgatgactacaaagaggcccacctcaagctctccgaactggggtatgctgatgcttaaatgtccatatcctagagcgggacacaaactgctgcctgtattgactcgtgcgattcaaggtgaaccatcagatggtctagagattgctttgtaataaatttaaactatcttggtactttgtc

SEQ ID NO: 50769 - DNA, 407 bp, Zea mays
  Clone ID: LIB3067-002-Q1-K1-E6
caaggaccttcggcgcccgttcaggatccacatcttcccgagcgagttcttggttggcctcttcctcttcggaccacctccaaggctcttggtgtagcttgccactctcaccaatcaagttttcatgtctgatctcgacattcagatcccaactgccttcgatcccttcgctgaggccaatgctggggactctggtgcagcagcatggtcaaaggactacgttcacgtgcgcatccagcagcgtaatggtcgcaagagcctgaccaccgtccagggattgaagaaggagttcatctacagcaagatcctcatagatctcaagaaagagttctgctgcaatggtacagtggtccaggacccataacttggacaggtcattcagctccagggtgatcagaggaagaacg

SEQ ID NO: 50770 - DNA, 236 bp, Zea mays
  Clone ID: LIB3067-002-Q1-K1-E8
ctagatcattggacacatatcgaaacagctctagctagcgcgctcgtcgtctaacctggcttccggcatggcttccaagcagatcggagtcttgacctgcttcattgccatcaccgctctcgccttccgtccctgcgcatccgccgtgcccatggacggtggctggtcgaacggcggcgccacctggtacggcccagccaagggcgctgaatccgacaacggtgcgttgcggttcc

SEQ ID NO: 50771 - DNA, 421 bp, Zea mays
  Clone ID: LIB3067-002-Q1-K1-F1
ctgaaagggcatatgtctataagttggccccacaggcagaatgttatatacctttccgaattgacacctcggctgaaggcggggaggaaaatagctgcttgaaagggggtgtttacttagccgatggtgatgaaactgttccagttcttagtgcgggctacatgtgtgcaaaaggatggcgtggcaaaactcgtttcaaccctgccggcagcaagacttacgtgagagaatacagccactcaccaccctctactctcctggaaggcaagggcacccagagcggtgcacatgttgatataatggggaactttgctctaattgaagacgtcatcagaatagctgctggagcaaccggtgaggaaattggtggcgatcaggtttattcagatatattcaaatggtcagagaaaatcaaattgga

SEQ ID NO: 50772 - DNA, 386 bp, Zea mays
  Clone ID: LIB3067-002-Q1-K1-F10
acgcgctgttccgctgcagcgacgccgccggcgaccagcagcgggacagcagctactacgagcgcgagaacgcgctcacggtcatcgggagcaacccgctgcggcgccacctggccctgggctacgacgactcccactcccacgacgacggcgcgtcgtcagctggctctgaccgcgtggacggcatagagctcgccgcggcggcgccggcgccggcggtcgttaagaagcaggtgaggttcgcggtggctccgcccaggagccccggtgtggacgagaccgtgttggaggagctgcacgagctgtgcgaggcgcgcgaggccggcacggcgttcatcctgggccactcgcacgtgaagaccaagcccgggtcgtcgatactcaag

SEQ ID NO: 50773 - DNA, 270 bp, Zea mays
  Clone ID: LIB3067-002-Q1-K1-D5
tcgcccacgcgttcggccacgcgtcttaccacgcgtacgaccacgcgtccgatgaagagggttcttctgctctggcctactatctacgagagacaccccgttcggatccactacttgctgatcttcttggtcggacgttgcaattccaccatgctgattctggctcgtcaacatatcgtgctgacctttgatcctattggtcgtgcctcagacctgatggttctttttcttcagaatacgaatgagcgtcttctggctttgtgatgaaac

SEQ ID NO: 50774 - DNA, 441 bp, Zea mays
  Clone ID: LIB3067-002-Q1-K1-F11
cccacgcgtccgcccacgcgtccgatgcaataaatcaaataaaataagattaagattgacaaaagatgtaaaaaccaagagctaaaatgaatactatttccagttctaggcggcattataaattctatttttttcttataatgatgtgaatcttgatggtttaatattatggttttaggacaattattatggtttcatactatttccagttctttagtcatggattttttttcagaagttgatgaactctaccttcgcaggatctagttccttgtatcttactgtcttttgagtttgagcatatactgatgtggagaggaagtgattggaaatcatctcttcctccattagaaaatagttatgaagtgacaaaggtgcaagaaagttttagtggcaaagaatctaatgaaaaggttacacattcaggaaatggtttgatcc

SEQ ID NO: 50775 - DNA, 441 bp, Zea mays
  Clone ID: LIB3067-002-Q1-K1-F12
cccacgcgtccgaaactgcgcaaccagtatccagatgctgcaaaacactaacaggcacgtggttggtgactctgtgggaaacttgtcactcaaagagctgaagcagctggagagccgccttgagaaaggcatctctaagatcagggccaggaagagtgagctgctggctgccgagatcaattacatggccaaaagggagactgagcttcagaatgaccacatgaacctcaggaccaagattgaggagggagagcaacagctgcagcaggtgactgtggcccagtctgtcgcagcagcagctgccaccgacgtggagctgaatccgttcttggagatggataccaaatgcttcttccctggcggccccttcgcgacactggacatgaagtgcttcttccccggcagcttgcagatgctggaggcacagcagcgccagatgct

SEQ ID NO: 50776 - DNA, 188 bp, Zea mays
  Clone ID: LIB3067-036-Q1-K1-C8
cacaagtgtagctgcggctaccaatggatctacactagctacaagacctacttccgtgcggtgaatatgatgcttgtgcttcgaactgggctgcactctgaggaccacactcttgtttgcattgtcattgagtatacctgcaaggagttactggacatctgcatagtgtacgtctgttacaagatgag

SEQ ID NO: 50777 - DNA, 438 bp, Zea mays
  unsure at all n locations
  Clone ID: LIB3067-036-Q1-K1-C9
aaaagatcttgcgctacattaggtatggtgttgacggtggagctacccttgtgacgggtggtgataggtggggtgacaagggtttctacatccagccaacgattttctcagatgtccaggacggcatgaagattgctcaggaggagatatttgggcctgtgcagtcgatcctcaagttcaaagacctcaatgaggttatcaagagggcaaacgcgagccagtatggattggccgccggcgtgttcaccaacagcctggacacggccaacaccctgacgcgcgcgctcaaggccgggaccgtctgggtgacctgcttcgacgtcttcgatgctgcgattccgtttggcgggtacaagatgagcggcatggggagggagaaaggcgttgacagcctgaagaactacctgcangtgaaagcggtcgtcaccccaatcaaga

SEQ ID NO: 50778 - DNA, 228 bp, Zea mays
  Clone ID: LIB3067-036-Q1-K1-D1
gtgaggaaaccctagcgaccgaccatggcgttgctcccgcgcaccgcgcggctggccctgggttccaccccgcgggcgtactccgctgccgctgctgcgggcgccttcccgacgtccccagcgccatacgggggcgctcccccaccggcgatgtctaagactgccgagttcgtggtctttaaagtggactacctgatgaactgggcgctgtagggctcgatctggccc

SEQ ID NO: 50779 - DNA, 452 bp, Zea mays
  Clone ID: LIB3067-036-Q1-K1-D10
gtcaccgatttcctcccattcaattcgtaaatttcgtccatgcatgggcatggaatggatgggtgtgaatgccacgaacgattccgccccgccggccaggtgagagatgagcctcacggcggccttccgtgccaccaaaatcccgcgcgctcttcctccaaagtgcggtgagcctgccgcctcctcctcggcctcggcgtccggggatccgccgccgggggccgcgaagagtactaaggcgccgccgccgtggtgcgtgtaccttatagcctcatcccggatccgccgcacgtacgtcggcgtcaccaccgatttccctcgccggctgcggcaacataatggtgagttaaaaggtggtgcaaaagcttcctctgccggcaggccttggaatctcgcatgccttgttgaaagatttgccaacagaagtgaagcctgtgagtttgaatcgaaat

SEQ ID NO: 50780 - DNA, 433 bp, Zea mays
  unsure at all n locations
  Clone ID: LIB3067-036-Q1-K1-D11
cggacgcgtgggcgaaacatgccagacaatggtgcagaaaatggcaccgagggaggaggctcgagagttaaatatgctgtgatggatgttcccatcaccttaccttcgttgaaaccagcttttgacaagcctaaccccaaacaaggcattggtatgctgtcatggagcagcgacagccactatttcttcaccaggaatgacaacatgccaactgttctctggatatgggatatatgccgccttgagcttgccgctgtgctcgtgcagaaagatccaatccgtgctgcagcatgggaccctacctgcacacgccttgttttatgcacagagagccctcacttgtacatgtggacgccatccggtgcctgctgtgtcaacatccnctttctgaacttccgaatcgttgatttgaagtggagctcgaatgggagct

SEQ ID NO: 50781 - DNA, 234 bp, Zea mays
  Clone ID: LIB3067-036-Q1-K1-D2
ggagtgttacaaggaggaaatatttggtccagtgcttctcttaatgaaggcggatagcctagatgaggccatccaaattataaacagaaacaagtatggcaatggtgcttccatatttacaacatttggcgtctctgtcaggaaatttcaaacagacattgaatcttgtcaggtgggcattaacttgcctattttagtccccctgccggtcttttccttcacgggcagcaaagc

SEQ ID NO: 50782 - DNA, 418 bp, Zea mays
  Clone ID: LIB3067-036-Q1-K1-D3
cccacgcgttcgctctgctcctactatgcgaaaccaaccactcaaactctagctacgtttggagatctgaagttgttgttcatagaaaggatcaacagggaattcttagaccaacatgaggaggaagaaatgcctcatgttattagtgttacaccagacatacaggaggccattggacgggaatgaggggctatctgcaaactatcttcttgagcaagctggtgaggaagattaagccagagtagttttcgtatgggtacaaacatagctttgcgtcaatcgatgccaggcaaatgcagaatgcttggtagccggtcagcgctatgtgtagaacacatactccggagatgaacatggatcacgagaactggaataattgctgtcagccatggacccatgacatcggctgtttcgcgca

SEQ ID NO: 50783 - DNA, 416 bp, Zea mays
  unsure at all n locations
  Clone ID: LIB3067-036-Q1-K1-D5
cccacgcgtccgcggacgcgtgggcttcgagaacgtcggcggcgccatgctcgacgccggggtgctcaacatgcgcgtgcacggacggatcgccgtctgcgggctcatctcgcagtacaacctgtcggacggtgagaaggacgccgtgcgcaaccttgtggtcgtcatcttcaagcgcctgcgtctgcangtgttcatcgagcccgaccacaagcacctctacccgcagtacgaggcgtgggtgctgccgtacatcagggacggcacgctcgcctgcgtcgaggacttcgtcctggggctcgagagcgctcccaaggcgctgataggactcttgcacggtcgcaacgtctgaaagcagctcgtccgcgttgccgacgacgagtgatgcgcgccttacttcgattggaccagacgat

SEQ ID NO: 50784 - DNA, 453 bp, Zea mays
  Clone ID: LIB3067-036-Q1-K1-D6
aatctgcgctgcgcggaagaagggaaggggaaaagcagttaagcttgagcgcgcgcgacagggtcaagtcgagggccggggaatcgccggagaatggaggtgggcagggctccgcgacgacgggtgtccccagcggcggcggctgcggctgtgccttcgctgcttctgttcgccgttctattcgcgggccgggcggcggcgttcggccacctgcaaggcgccggcgcgacggcgctgtacaagcacgcgtcgttcttcgaccgcgatggcgacggtgtcgtctccttctcggatacgtacggcgcgtttcgggcactcgggtatggattcggcctgtccagcgtcagcgctgccctcatcaatggcgcccttggtagcaagtgcataccttaaaacgcaacgtcatcgaatttggacatttacatataggacatccagaaaggaaaacacgga

SEQ ID NO: 50785 - DNA, 177 bp, Zea mays
  Clone ID: LIB3067-036-Q1-K1-D7
tcgcccacgcgtccgcccacgcgtccagagaggctatcaccacgtacgtatacacacgggcacgtaactagctagctagctagcagtcgtagaatgacgatgaggggtctctctgttgcggtcgctctggtcgtggtggtggccgcggcctgtcttgccgcgccgcgatacgcggac

SEQ ID NO: 50786 - DNA, 384 bp, Zea mays
  unsure at all n locations
  Clone ID: LIB3067-036-Q1-K1-D8
cccacgcgtccgcccacatgttagtacaggtctcctacgccatcggcgtgccctagcccggatcattgttcgtggacacgtacggaaccggcgcgatccccgacatggagatcctgaagatcgtgaaagataacttctactataagcgctgcatgatcaatatgaacctcgaccttaagaaaggcgggaactgtcgctaccttatgacggcgggctacgggcactttaagagggatgacctttacttgacctgtgaggtggtgaatcccctaaaggtagaaaatccgtgttctagatgaggtgctttctatgttttggaagaagctnttggtatggtctgtctgcgctctatcatgcttcattatggctcctacgtgttgtgat

SEQ ID NO: 50787 - DNA, 113 bp, Zea mays
  Clone ID: LIB3067-036-Q1-K1-D9
aaaaatttcaaaaattaaacaaaaaataaaaaaataaaagaaaaatgaaaaacataataacacatataaaaaaaacactaccaattcaaacacacaaaccttcatactttaaa

SEQ ID NO: 50788 - DNA, 450 bp, Zea mays
  Clone ID: LIB3067-036-Q1-K1-E1
gggagatgtcgtcggcgttcagcggcgatgagaccgcccctttcttcggcttccttggcgcctccgctgcgctcgtcttctcatgcatgggggcggcgtacgggacagccaagagtggcgttggcgtggcgtccatgggtgtcatgcgcccagagctctgtaagaagtccatcgtgcccgtggtcatggctggtgtgctcggtatctacggcctcatcatcgccgtcatcatcagcactgggatcaaccccaaggccaagccatactacctttttgacggctatgcccacctgtcgtctggccttgcctgtggtcttgcttggcttgctgcaggcatggccattggcatcgttggtgatgctggtgtcagggcgaacgctcatcatcctgagttgtttgtgggcatgatcctcatccttatttttgctgaagcgcttggcccttacggtc

SEQ ID NO: 50789 - DNA, 440 bp, Zea mays
  Clone ID: LIB3067-036-Q1-K1-E10
atcgtatcaaaggaaaactgaatttttatttagcctcaggattgctagaacaagttccggacctggaaggtcagtcagaaattccgaaggacagtcagggttcagctgacaggagtggaccgccaccagttttacgagcacagcccaaatctaaaccggaactcccagaaaacgctggtacatcaggagaaggaacttctgattccattcgtactaaagggcccaacgcccatccaaccgaagtttctgaaaaggtattggctaaatcaaagcagcgtgccagagccagaaggagattggattttctgtcaaccccagtggagctcaaattgtgcactgctgcggcaagttgtcaaaggcctccccagaaaatggatcaaccgggtccagtggccgaaaacatctcttcgtcagatgcatgtcaagacatttcacagaat

SEQ ID NO: 50790 - DNA, 452 bp, Zea mays
  unsure at all n locations
  Clone ID: LIB3067-036-Q1-K1-E11
caaaaacttcccccgacaaccgaacaggagcggcggcggcggcactaccctctccagcaatcggcatgggcacgcgggaggtgtacgaggagaagctccgcagcggtgcgcacctccaccgcgatcccaccatcaacccaggcctcggctcgccccggtgcccgcgatgcctctccctcctcaaccccaccgcgggaaagagggactgggccatcacctccgtcctgcacgacgccactgccgtggctggttccggtgccggcgctttgctcagtgctgtgcacgggtttaacacagggatcccttttgtccagaagcatgtcaaggggccgaagtggctgcagttgctcgttggggtgccaccactgctgatattctcaggtgccagtgctgtatttggtgcatatgcacttncaaggtttgttcagctcacagtgacgtcttactacgcg

SEQ ID NO: 50791 - DNA, 321 bp, Zea mays
  Clone ID: LIB3067-036-Q1-K1-C6
cccacgcgtacgcccacgcgttcgatcacgcgtccgaagaaattggatggcactgggagcgtgagagacgaaacgtccgtgcgctatgtgccgctcactagcaaggacgcccagttgcacgcaagctgagtgagctatcatgtcaaaaaaaaaagttatcctgatttgacaaggtgaggcattcaatcgaatcgctacccttgtaaatgtattaatcctactgtctcattgaatgcactggcttggaaataatgtaaatgatggaacatcatggaacgtttgtttcccttcagctgccccggtgttcttacttactatgca

SEQ ID NO: 50792 - DNA, 453 bp, Zea mays
  Clone ID: LIB3067-036-Q1-K1-E12
cccacgcgtccgcccacgcgtccgattaccagcaacttcaaggaatctaaaagcaatgatgttgggagagctaatgcctcatctgatggatggcaggattttgccagttttgatcaagctcagagaattactaaagttcatgtggaaggacatgttgtaaaagatccttcaggggctgaaactttggacttatgggcctcaagtcatgttaatgaaaagaaccttgaacagataagtgaacataatgatctattcgatgactggcaggatttccaaaactccaatccacagcaaacaaccttacaagtttcttcagatgcttcattatttgatataaccttggcatcaaggcctgatgcttttggagagcaagaatttgggagtgttttgcaggtagcttcatccgaaaactcaaaggattaaaaggagggttctaatgaatcaaaagcattt

SEQ ID NO: 50793 - DNA, 134 bp, Zea mays
  Clone ID: LIB3067-036-Q1-K1-E2
cccacgcgtccgctgtaatattatgcacctgaactttgtttattgtaaggacagtgaactttttaatgagttgggttgtactcttttttcctgtctaaaaaaaaaaaaaaaaaaaaaaaaaatattataattat

SEQ ID NO: 50794 - DNA, 426 bp, Zea mays
  Clone ID: LIB3067-036-Q1-K1-A7
ggcagagcagaggttgctttggatgttgtgctaagccaactccaataatagcagtagacgagccttccaagcggttgaggatccaagggccgaccagtaaggaaggctagcctctcggatgacttttggagcacgagtgcgcatgagatggagaacagcgggatccaatcgcagaggagcatgtcttcgatcagcacgttggctcagtccagcgatcagcatgcgtcaggaagttgcagcaacccgaatgagtttatgaatcaaggtcttatgctctggaaccagaccagacaacagtgggttggaagcaaaaaacgccactctagatctcaacagcctcgagaaccaaagttgagctggaacacaacgtatgaaagtctgctaggaagcaataagctattctcccaaccgataccttttggcaaa

SEQ ID NO: 50795 - DNA, 427 bp, Zea mays
  Clone ID: LIB3067-036-Q1-K1-A8
cggacgcgtggggtaccgcagtctactactgactgagaagcttgaggttcctgagagagcgcctctggcccactccgttgtcaagaagcgcctgtcgttccccgtcgtcgagaagccaatcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattgtgagacagttctaactgtgtttacagacaatgcgtgatgctaaatgtatgtgtgggtggttggctttcaatgtactgatatgatagtatttgattt

SEQ ID NO: 50796 - DNA, 458 bp, Zea mays
  unsure at all n locations
  Clone ID: LIB3067-036-Q1-K1-A9
cccacgcgtccgcccacgcgtccgcccacgcgtccgcccacgcgtccgagaattcctggagttgagtcagaggggcaataatctgtctgtcgatttgactgtgggggacatatatggggaagaaggttacccgaagattggccttccagcatccactactgcggctagctttggaaaagtgaactcaagcaaactttctgagtataaagtagaggatcttgctgcagccttactgaattctttcacatacaacattggacagatagcctactttgtggctaatctttcaggcctgaagagaattttcttccgaggtgcttatgtctgtggtcatgagaagactatggacaagatttctcgttccctaaaatattggtccaaaggtgaagttcagacgacatttctatgccatgaagggttcttgggaacactangtgcattntggagttatgagaaca

SEQ ID NO: 50797 - DNA, 119 bp, Zea mays
  Clone ID: LIB3067-036-Q1-K1-B1
cccacgcgtccgatcagagtgcgctatatgttctaactcgaaaaagcttccctatactctgcgcatgatccaagcccgaaagactgtttcaactacaatcttatgatcagacactccat

SEQ ID NO: 50798 - DNA, 192 bp, Zea mays
  Clone ID: LIB3067-036-Q1-K1-B10
aaaaaaaaaaatacacataaacaaacacaaaatttaaaaactaaaaaaaaaataataaaaaaaaaaaaaaaggtactaatattaataaataataaacataaactacaacataataaaaaataaaaatcatatcaactacaaaccattcattctttaacatcactataactatttgcactccttctcttatat

SEQ ID NO: 50799 - DNA, 454 bp, Zea mays
  unsure at all n locations
  Clone ID: LIB3067-036-Q1-K1-B11
cccacgcgtccgcggacgcgtgggtctcagcatcacttgaccggaggccgaacgggaggccggcatcgaatggcaggagtaactccaggaacccacagtccaggacacagaaggcgcagcaggctgcatccgagaggtcatcctcatcaagtcacagcagcacgagcagcaaccacgactggcgcgaagggtcctcggtccttgatctcaagggcgagaactacttctcctgcgccgtcgggaggaagcggtctaacgcccgctacttgctgagctcgtcggaggaggttgtctccttcctcaaagagttggcgacagcgacagctggcttccaggccacctgtgctgactacatgcatgttcttggataggcagtaaatagactgaagttgaagcctncgtgctttaccagagagaagaagaatattcattcctcgtatgcgcgacagagcta

SEQ ID NO: 50800 - DNA, 454 bp, Zea mays
  Clone ID: LIB3067-036-Q1-K1-B4
cgaagttaagccaccatgtggacgatggctttagcgacggtgctgctgttcgtggcaagcgccgcgctgctcggcgtcggcggcgccagcgcgcagcatggcgtgtggagcatcatcactcgtcccatgttccagagcatgctgagccaccgcggcgacagttgtgtcaggggcgccttctacacctacgacgcgttcatcgaggccgtcagcaagttccccggcttcggcaccaccggagacgatgctactcgcatgctgatgctcgccgactttttcagccagacgtaccacgaaaccaccgttggatgtgcgactgctcctgtgggaccgttggcctggggatactgccgggttaaggaacataacccgacggacccaccctactttggactaggacccatacagctaactcatgagtacaactacatgctcgccgggcaagcgctgaacc

SEQ ID NO: 50801 - DNA, 140 bp, Zea mays
  Clone ID: LIB3067-036-Q1-K1-B6
cccacgcgtccgactagatctagatctcgaggtccgtccttttttttttatatttatttttggtattttttttttttttttatttttttttttttttttttattttttgttttttttttttttttttttttttttttttt

SEQ ID NO: 50802 - DNA, 461 bp, Zea mays
  Clone ID: LIB3067-036-Q1-K1-B7
acatcgagtacagtcggctaggtaatctggtggtacgacgacatggcggccaccagcagcgggtcgtcgtcgtcctcgagctcggcgcagcgggcagctgccgcactgctcgtggccgccgccgtggcggtgtccgtcctggtggtgggcgcggcggcggagtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgtccgactgctagcagtgtgctagccaagccaagccaagcaggaaggcccccggcattgctagctggacgtgtctgtgtgtgca

SEQ ID NO: 50803 - DNA, 314 bp, Zea mays
  Clone ID: LIB3067-036-Q1-K1-B9
gctggagttggtgcccaacactcacagtgctatgcagcttggtatgcacatgttcccggatggaaagttgtagctccatattctgcagaagatgctcgaggtttgctgaaagcagcaatcagggatccagatcctgttgtgttccttgaaaatgaacttctttatggtgaatcatttcctgtatctgctgaggtacttgattctagcttctgccttccgattggaaaggctaagatagagcgacaagggaaagatgtcactatcactgcattctccaaaatggtgggatatgcccttcaggccgctgatatact

SEQ ID NO: 50804 - DNA, 445 bp, Zea mays
  Clone ID: LIB3067-036-Q1-K1-C10
gccattgctacaggagggcggattgttccgagattccaagagttgagtcctgaaaagcttgggaaggctggattagtcagagagaaatcattcggaacaacaaaggaccggatgcttacattgagaagtgtgccaattctagagctgtaaccattttcatccgtgggggaaacaaaatgatgattgaggagaccaagcgcagtcttcatgatgctctttgcgtagcaaggaatctgatccggaataactcgattgtgtacggtggcggctcagccgagatatcttgctcaattgctgttgaaactgctgcagatcggcacccgggagttgagcagtatgctatcaggtcattcgctgatgcattagatgctgttccactagcgttggccgaaaacagtggtttgtcaccaattgataccttaactgcggtaaaagctcaacaagt

SEQ ID NO: 50805 - DNA, 395 bp, Zea mays
  unsure at all n locations
  Clone ID: LIB3067-036-Q1-K1-C11
cttcctttttcccccttactcaaaataatatgccaaaccaggaacttcataatgatttctgggtaactgaaacgcatgggcacacatccatgagtcccccaccgctacatgcctcacgcctcgtcactgagtcgttctcagtcacgacatgctgatgtcgatccacccgtcaagaacaaggtgcagcagagatctttctcctcgtcgctgcttcctcgccatccggagatggtcgtcgccgcctaatatcacagcggtgggaaggcacaacgctcccccatctcctccggttctgcctgctcgccagcacgacgcgacgatgcccccctgacccccgcgcgcacagcctncgctggagaagcgacaacgctctcgtctccggtctccatgagtca

SEQ ID NO: 50806 - DNA, 451 bp, Zea mays
  Clone ID: LIB3067-036-Q1-K1-C12
gcagttctgaggctgtggagggctcactagatgcagttccagagaaagtagtcattctcaggagttctgagactgtggatagctcatatgctgtgtcctgtattttggatgacacagttcatgatgcttctgatatctcacaggctgacggtgtacaacatgaggagcactctagtatctctgatgggagtacagaaaagctaatttctgaggaaagttcattagtatgctatggtgttcccagcaacaaaaaagacttggttaatatagctgttcaagaaagtaaagcctttatcttaaaaaatcctgccttccaaatcttggaagagagtggtccaggtttggatgtatctacagacagtgtttccctttcacatgcagactcagctcctgatttagcttgtcagcatgtttctcctaatgttgaagatacaacaagttatgagcctgg

SEQ ID NO: 50807 - DNA, 464 bp, Zea mays
  Clone ID: LIB3067-036-Q1-K1-A6
accagagctcctgactgttcctctctccctcctcacgggcgggctccgtctgttccgtccatccaccgccccggtcgtctcccggccagatccctctcctgcaaggtttctttgcgagtggccggagaagatgatgggcggtttcctctccagggtcctacggctggcttttgtctatgcctatcctgcctatgaatgctacaagaccgttgaactgaacaaaccacagattgagcagcttatatgttggtgtcagtattggattttagttgccctgttgacagttttggagagatttggagattttacaatatcatggctaccgttttactcagaagcaaaggtgttgttctttgtatatttgtggtaccctaagacaaagggaactacgtatgtttatggaactttctttaagccatatatttctcagcatgagaatgaaatcgaccgaaatcttcttgagc

SEQ ID NO: 50808 - DNA, 388 bp, Zea mays
  Clone ID: LIB3067-036-Q1-K1-C3
agcaaacagaaagggtgtcttgagtggatattttctctggctaattgtgggatatgcagtgggccttgtcattacgtatcttgcgctgttcttgatggacgggcatggtcaacctgcgttgttttaccttgtgccatgtacattgtgggttattgttattctatggtggttaataggtgagctttatgaattatggaacttctgaaaaagtccagcagaaaattttgtcaatgaaccatgacaacaaaatccattgaagatgtattcttcagcgtaagtgtataacttgaggatgtttattaggaggcaccgtgtattgcaagattgtatgtttaccattatttcatagaaggatgctattgtgttttaaaaaaaaaatgattataca

SEQ ID NO: 50809 - DNA, 453 bp, Zea mays
  Clone ID: LIB3067-036-Q1-K1-C5
cccacgcgtccgctaacgcactctactccctcccacctgcctctccgtgcgacgggcgcgggtctttgtctcgcggcgtcggcgactcggtctcgggcgcggcactcggctgctccctactccaggagccggagccggagccggaggcctagtagatgaagacgttcgatccgtggccggtcttctttcgccgggagtggaagcgcaattggcccttcctcacggggttcgccatgaccggctgtatcatcactaatatgacggccaacttcaccgaggaggacctcaagaactccaagttcgtccaggagcacaagaagcgctgaccaaccagtaatctatgacatggacgccggatggcactggcagagggatggtgtacggtgttggccgaattgcctgtctggacagccagttatgttatgctggttgaatgaaaaattagcttctttt

SEQ ID NO: 50810 - DNA, 456 bp, Zea mays
  Clone ID: LIB3067-035-Q1-K1-G8
gttcttaatgtatgctgtaaattgatcaaacagatggtatattatatctgccacaaagatcgctcacaccggactcttctgcgagatcgcgggcatcaggcatcactttgacatcaaaggccaagatagttgcatattctttctttctctcaagcatgacactagccttcataacatccttcttatgcactggccctatactgaaatcacagaagggaatattcacagcagggctcttcaagaactcagtgagagcttccaaagacccaagggtagatgcctgtacatagacaccttcaccactcctgtcaatccggctcctaacccgtgtcatctctttcataacagcttcattcagtttgtctaaatcatcatcaggtcctaacacgtaaagggctgtccctgcaattgcatgttcgagaccctgagcagatattttgactccttgtgcgttct

SEQ ID NO: 50811 - DNA, 365 bp, Zea mays
  Clone ID: LIB3067-035-Q1-K1-G9
cggacgcgtgggcggactcgtgggcggacgcgtgggggtgggaagaacatcgaggttgcagggatgacaaagaaggacggtctccgggaactcgaggagtctgagattgatgagtatgttgccgagatcgaggcagagaaggctgcagctgaggctgcaaagaagggtgcctcgaagaacgcctaatttcccgtcttgtgctatggctcccttcaaccctgtgtgtgtgtcccgtttttatgttccatagcaccatcttaactgttctagaaggatgctagatctttaagtgaaactacgcttatatgcctgtgggttaaatgatgtacaatgtgctcgtctacatgccttcttcggaggttttc

SEQ ID NO: 50812 - DNA, 413 bp, Zea mays
  Clone ID: LIB3067-035-Q1-K1-H10
cccactcgtccgcccacgcgttcgcccacgcttacgtttacgcgttcgtccactcgtccgagcctctgaagattgtcatcaagacctgtggcactaccaagctcctgctcaccattccaagaatccttgagcttgctgaagagctgtctatgccacttgctgctgtgaagtactcccgagggacgttcatctttcctgatgcacagccagccccccacaggagcttctctgaggaagttgctgcacttaaccgctactttggcggcctgaaatctggtggtaatgcttatgtgattggagatccagcatgacctgtacagaagtggcacgtcttctactccacttagtacccatagcaaccaatggttaaccttgagatgtgcatgactggtctggacaagaagaaagcttct

SEQ ID NO: 50813 - DNA, 437 bp, Zea mays
  unsure at all n locations
  Clone ID: LIB3067-035-Q1-K1-H11
cccacgcgtccggtcgtttccttacaagtggatcaataagaagtggaaagaagggttccatgtgacatccatggccaccgctgggaatcgctggggcgtagtcatgtcaaggaattcagggttctctactcaggttgtagagttggatttcctgtaccccagcgagggcatccaccggcgctgggagagcggctacaggataacttccacggcagccaccaacgaccaagccgctttcatcctgagcatgccgaaacggaagccgatggacgagacacaggaaacgctgcggacctncgccttccccagctcacacgtcaaggagaaatgggccaagaacctctacatcgcttcgatttgcttcgggcggaccgtgtgctgatcgcgcgcgcctgggaaatggaaatcgaaacgagggccaccgatccggtacggtg

SEQ ID NO: 50814 - DNA, 359 bp, Zea mays
  Clone ID: LIB3067-035-Q1-K1-H2
gctgcatctgtcctttaacctccgcgtaaacatcctttggtatgactattcaggatatgggcaatcgttatgaaagccgagtgatcacaatacttatgctgacatagaggcagcttacatgtgcctcatagagaaatttggtgccaaggaagaagaaataattctttatggacaatctgttggaagtgggcctactgtagatttgtccagtcgtttatctcagctgcgagctgttgtcctgcatagtactatattgtcagggctgatagctttgtatcctttgaatggcacatattggtttgacaatttcaagaatattgatcaattactctaagttacatgtcctgtgcttcattatt

SEQ ID NO: 50815 - DNA, 455 bp, Zea mays
  Clone ID: LIB3067-035-Q1-K1-H3
gcatgaagctgaatataatccaacagtgcataagcataggtctttcatttgagcttgctggtcaacttgtacagagagtgatcatatttcttcttctttttttacgttgattacacccaattagtatatatagttgcatacccacttggatgatttagttagtgaggaacacaagtgaagatgagctttgcactgttcaatgcttgtgcttggaagaaggatgctcttgcgcccgcagttcattgttatctggaaagtggcttgctactgagcattctcttactacatgatgtaaattgtgaatcttcatcaaagctggcttatggctgaagagtcagtatcatagtttcctttgatgggagaagacagcaaagccagctaatctctttaaccaagaaatcggctagtagttttttcccttttgaaccttgtcatgatgccttgtcttctggata

SEQ ID NO: 50816 - DNA, 452 bp, Zea mays
  Clone ID: LIB3067-035-Q1-K1-H5
gcaaggagtacttcagcaagtccctcttcctggtcggagagatcggggggaacgactacaactacgccttcttcaagggcaagaccctggacgacgccaagacctacgtccccacggtcgccgccgcggtcaccgatgccaccgagaggctgatcaaggccggcgccacgcacctggtggtgccggggaacctgcccatgggctgctcgtcggcgtacctgaccctgcacccgggccgcaacggcagcgactacgacgccgccggctgcctcaggacgtacaacgacttcgcgcagcaccacaacgcggtgctccagcggaagctgcgggcgctccgggcgaagtacccgcaggcgaggatcatgtacgccgactactacggcgccgccatgtcctttgccaagaaccccaagcagttcgggttcacgcatgggccgctgcggacgtgctgc

SEQ ID NO: 50817 - DNA, 452 bp, Zea mays
  unsure at all n locations
  Clone ID: LIB3067-035-Q1-K1-H6
aacacaagctagccatggttagcagaaagattagtattgtcggagccatcacatctccaattgtggttgtggtggcactgacactattgatcacacttttggcaccgacagtagatgcacaaccatactcaacaatgccacctagcatgataggagatttattgccacggacgagagtacctccgtctgggcctagccatcctccacccatggcggcgatgccaccatcatggagaatgccatccgctggacctatgaagcctncttccatggcggcgatgtcacctgatgttgttggggatttgctaccacgaggacctagccatccgncaccaagggtagcgacgtcacctgatgttgttggggatttgctaccacgaggacctagccatccgtcaccaagggtggcgatgtcacctgatgttgttggggatttgctaccacgaggacct

SEQ ID NO: 50818 - DNA, 448 bp, Zea mays
  Clone ID: LIB3067-035-Q1-K1-H7
cctagccccagctagatcattggacacatatcgaaacagctctagctagcgcgctcgtcgtctaacctggcttccggcatggcttccaagcagatcggagtcttgacctgcttcattgccatcaccgctctcgccttccgtccctgcgcatccgccgtgcccatggacggtggctggtcgaacggcggcgccacctggtacggcccagccaagggcgctggatccgacggtggtgcgtgtgggtaccagggtgccgtcgaccagcctccgttctcgtcaatgatcaccgtcggcagccaatccatcttccaggacggcaagggctgcggcacctgctaccaggtgaagtgcaccggacacgcgtcgtgctccggcagcccggtgacagtggtcatcaccgacctgtgccccggcgctgcgtgccaggtggagcccgtgcactttgacc

SEQ ID NO: 50819 - DNA, 458 bp, Zea mays
  Clone ID: LIB3067-035-Q1-K1-H8
tcggacgcgttggaaaaaaaaaaaataaaaattaaaaaaaaaaaaaactaaaaaaaaaaaaagaaaaaaaaatataaataaataatactataatattaaaactaaaatttaactctaatacatattcaatattattttccttcttttattcattatatttaatttatattttttctactttttatatattcttcttttttttatctcttttttcttatttttatttttttttttttttttctatttttcctttattttactactttttattttttaatattattatttcttttttataatatatttcttttaatatattttttatttttttcttatattattttctttttatttttttttatctattttatatattaatatctttatattttttttcttttttctatttttttctttattttttatattcttttatctctctttttttattttttttt

SEQ ID NO: 50820 - DNA, 439 bp, Zea mays
  Clone ID: LIB3067-035-Q1-K1-H9
cccacgcgtccgcccacgcgtccgcccacgcgtccgcccacgcgtccgcccacgcgtccgatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctgtacagaagtggcacgtcttctacgccactgagtacccagagcaaccaatggttaaccttgagatgtgcatgactggtctggacaagaagaaagcttctgtctttttcaagacttatgctgatgg

SEQ ID NO: 50821 - DNA, 357 bp, Zea mays
  Clone ID: LIB3067-036-Q1-K1-A12
cccacgcgtccgcgccgccgtcgtcgccgccttcaacagccagctccagggcacgcaggccagcgccatgacgctcttcggcgccgtgccgcccgtgccctccgacatcctcgccaaggccttccgcatcagcagcggcgaggtggaccacatcaaggccaacttcgcgcccaagtagagatccaacgtctgcattcccttgattttctcaataataaatccccgcggtgtgcagttcgatttgttcgtcttcggttggtttgcttcgagacattgctgaccacgcttgtcactgctaatttgtgcggagcggaggagttgcttgtgctccgataaataagataaataatcaattct

SEQ ID NO: 50822 - DNA, 372 bp, Zea mays
  Clone ID: LIB3067-036-Q1-K1-A3
gcatccccagaaccttgctgagggcagcctgaacggcttccaggtcacaccgtctcagccgggtcatccgagctggcagcatcagcacacgtactgagccctcctgtactccttggttatggtggctcttgagctgtcacaagccaagtttcgcgtgcttgggctctcactcgatgcagagtaagctgctccgattcagtagagcctttaccttgagcgctgagagggtcccaggcttacaacatttagagctttgcgttttaacatgttgcgtgatgtgccagactgatgcattgtggtttgttttcaatagtgagttaagatggcggaagctcaatcctgattaactgacacatgataacctaacaagca

SEQ ID NO: 50823 - DNA, 121 bp, Zea mays
  Clone ID: LIB3067-036-Q1-K1-A4
caacctgtatggttgccgtcacttgatccctgatggtctgatgagggccactgacgttatgatcggcggaaaggttgccgtggtctgcggatacggtgatgtctgcaagggttgggctgct

SEQ ID NO: 50824 - DNA, 122 bp, Zea mays
  Clone ID: LIB3067-036-Q1-K1-A5
cccacgcgtccgaaaccgaccattcattcctttttccatggcgaggagggcgactgtgatggtgctcgcggcggcgctcgcggtccttctgctagcgtcttcatcgtcgaagacggcccccg

SEQ ID NO: 50825 - DNA, 452 bp, Zea mays
  Clone ID: LIB3067-035-Q1-K1-G7
cccacgcgtccgggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcctgttcgcttccagctatcgacctctgacgggcagcaggcattgtctcagtgctacctggaggagcccgggagctgggtcctgtaccatgctggcgattttgtggcctcaaagcctgaccagctgatgaagctgaagttctccatggcacagatcgactgcacgcacacaaaaggcggactgtgcatcgacttcgttctta

SEQ ID NO: 50826 - DNA, 349 bp, Zea mays
  Clone ID: LIB3067-017-Q1-K1-F12
cggacgcgtgggcggacgcgtggggtcgcactagccaatcgtgcagcagctttgaatgctgccgtggtctctatcaaagaaaccatcaccgctgccatcataccgaatgcatggtctgcactgaatgttggtgcaccccattgtaaagggtatggaatgcttatcctaagagagtggaaagttacatgaaaaatgtaaaaacattgatgttaaaattagtcaatgatacatagggaagtctccaaaccattgtgatgaagatatgagattggcacggtctgtccgacagttgatctgggtgacaagtgctgtgtgcttgtatgcaccacttgctgggaggatgtgggca

SEQ ID NO: 50827 - DNA, 109 bp, Zea mays
  Clone ID: LIB3067-017-Q1-K1-F2
cattgggacaaatcatttctggcaaagtgggggttgggaaattaacccacgacagttttgtgcttagtttgtttcttcaatgaaagatgacagttgcgttttacctgtc

SEQ ID NO: 50828 - DNA, 221 bp, Zea mays
  Clone ID: LIB3067-017-Q1-K1-F3
tcggagtcagagaggtgcagatcaatgcggcggtggtggtgcgccgccggcggtctttcccgctgcgttctctcgttctccacctccggcatagcattccatgcccgcccgctgtcggttaccctgatgccccaataatccttcattaccctgccttttttcctgttctgttcgaggcgccactctcttcagggattctgtcacctggttatcgctttttt

SEQ ID NO: 50829 - DNA, 457 bp, Zea mays
  Clone ID: LIB3067-017-Q1-K1-F4
atccgctttcggcgccgtcgccactcgccaccatctccaccgcctcctctcgacgcgcatgccctcccatacccatggccactgaccgtctcctccaccttctccgagcgccgacaggctctccggctgccgccaccacccgcgcggctggttggggtcgtccacggacacagcgcgtcgacgtctggcaggttgctgcggggattcgccgcgcgttcgtgtcctgctcgagcactagctctggcgggcaggggggattaacatataaggatgccggcgtggacatagacgccggcgccgagctcgtgcgccgcatcgccaggatggcacccgggattggcggcttcggcggtctcttcccctacaatgacgattatcttgttgctagcaccgatggggtggggacaaagctgaagcttgctttcgaaactggtattcatgatacaatcggcattga

SEQ ID NO: 50830 - DNA, 397 bp, Zea mays
  Clone ID: LIB3067-017-Q1-K1-F7
tcgcccacgcgtacgcttcatgatactggttctttacccagagctgatactgtccagagtcttcctctacctgttactgataggggagtgctactaccggtggcgtctgaggcattcttgacacatggacacccgcctattccacgcggagactgttcaccccgacgagcttgaccaggagcttgacacctttcccactttacggccatgatacgtcttgcggatgcggttcgacaggctgctcatcgttgccttgaggatccagaccgtggtcagtgaccttgctactcagggcgagcggttgcagtcagtgctgagctggacggacccaatgtccaccggcctgttcgttgacctatgctttgttggcgccattttgctgtacgttacacccttt

SEQ ID NO: 50831 - DNA, 451 bp, Zea mays
  Clone ID: LIB3067-017-Q1-K1-F9
gttgctcttgtgccatactacattgatttggttggccgttataagctcagctctcatgctcgctctaaaactgatggagctagaacaaaggctgctcaggaggctttcagggaactacagagtgcccggcaggaggccctgcaaaggaaaaaggctgaaaagaagaaactcatcgaggaggcagatgccaaactaagcgctgagtcactccggaagaaagaagaaaaggaaagggctcggcaaatgaagaagtctggacccaaagtgaagatgctccgctcttaacaacgtcatgattcaagaatctatcatatcttggcttttgctattcacctgttgattagcatatagttcagtgtctgctagactcatttatattctaatcctgtgagaatgagcaaaaaggatccaggagaaaagaatccttactggcgtttcgcttttattggat

SEQ ID NO: 50832 - DNA, 450 bp, Zea mays
  Clone ID: LIB3067-017-Q1-K1-G1
ccacgcgtccgtccacactaacgaacgaactcttgctccgatcacgagctagctgaggtcgacgatggcggctgtgctgaacagcaggaagacgccgcaggtggtggccgtgctggtggtggtggcgctgctggcttcgtccgcgtcggcggcgatcacctgcgggcaggtggggtcgtcgctggcgccgtgcatcccttacgcgacggggagggccagcgcgctcccctcgtcgtgctgcagcggcgtcaagagcctcaacagcgcggcgcggaccagcgcggaccgtcaggcggcgtgccgctgcctcaagagcctcgccaacagcgtcaagagcgtcaacatgggcaccgtcgtcaccatccccggcaagtgcggcgtcttcgtcggattccccatcagcatgttcaccgactgcaacaagatcagctaagttacgacgaccaagct

SEQ ID NO: 50833 - DNA, 449 bp, Zea mays
  Clone ID: LIB3067-017-Q1-K1-G11
cccacgcgtccgctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtacctcgcaaggaagctggctggtgatccgaaccttcactttgttgaagctgttgctcttaagcctccggaagttaccatcgacatggctatgcagcagcagcatgaagctgagcttgctgcatcagctgcacaacctcttcctgatgacgatgatgatctgattgagtagaaaggatcatgagtcttgaacttgagcaggagttgtgccttgcgtgttttaagtggtc

SEQ ID NO: 50834 - DNA, 441 bp, Zea mays
  Clone ID: LIB3067-017-Q1-K1-G12
gcggaggcgagtgggcgccctcctccgatctccacgaacttcttcctcggcctcctcgggctgccagagccgccgccaccatcttctccccagcgaggaacctcttgctctcaaccgtcttgccaggctcttcacgtcccaggctggaagtgatggtggcgatacccagaagccctttattgcttttgtcttaggtggtcctgggagtggcaaaggaacacagtgcactaagattgcttcggattttggatttgcccatctgagcgctggtgatattctccgacatgaaatagcatctggcagtgagaaaggggagttgatcctagaaatcataaaggaagggaggattgttccgtctgagataactgtggaactcatcagaaaagcgatggaaatgaacaatgctaaaagggttcttattgatggcttcccaaggtgtga

SEQ ID NO: 50835 - DNA, 231 bp, Zea mays
  Clone ID: LIB3067-017-Q1-K1-G2
cccacgcgtccgcccacgcgtccgcaatcgcggagaggcaatcaccacgtacgtatacacacgggcacgtaactagctagctagctagcagtcgtagaatgacgatgaggggtctctctgttgcggtcgctctggtcgtggtggtggccgcggcctgccttgccgcgccgcggggcgcggactggccggccgagtgctgtgcgacgtcctgagagaccgctgctgtgaggc

SEQ ID NO: 50836 - DNA, 448 bp, Zea mays
  unsure at all n locations
  Clone ID: LIB3067-017-Q1-K1-G3
cggacgcgtgggcaacagcaggcgaggaaagcaagacacgcccacccacccgctccggcagccagcggctatgcagcagcagatgcccatgccgccggcgcccgctgccgccgcggcggcggcgcccccggcggccggcatcactaccgagcagatccagaagtatttggacgaaaataagcaacttattttggccatcctggaaaatcagaacttatggaagttggctgaatgtgctcagtatcaagctcaacttcaaaagaacctcttgtacctggctgcgattgctgatgcccaaccccagccttcgcaaaaccctgcaggtcgccctcagatgatgcagcctggtatagtgcctggtgcggtgcattacatgtcacaagtaccaatgttccctncaagaaccccattaaccccacagcagatgcatgagcagcagcaacaacaa

SEQ ID NO: 50837 - DNA, 256 bp, Zea mays
  Clone ID: LIB3067-017-Q1-K1-G4
ctggacctcaatgaaaaggacttgattttgttcgcatctgtgcaggatcacaggatctgagtggttaggaaatatcaccatcttttttttgtgtgtgtgtggatggagttcatagctggagttgtcctgcgagattgaagcgaggtgttcctaggagccagaaggggcaccgcattggtttctgatgtacgcacactaacggtttctgaaatttgagctagtaatctgaatgaaatccaaaccgaataaccgatac

SEQ ID NO: 50838 - DNA, 500 bp, Zea mays
  Clone ID: LIB3067-017-Q1-K1-G5
gcactgcacgtatccggtctcggtaattctccgtggtcgactccacgtcgtctcgtgtcccggggtaacaagctatgtctcagtcatggtgaccatgttcggtgtgtggcacctgcacgagaatctacgtggtcagtgtaatcttagagcacgtcatgcatctcatgtccctgaacatagatcatgctccagtgagaacatcagtggtccatggcatcgttgcgtgagcatcatcagtgcggcggcgggcaccatctggagctgggctcttcgtcgtcctcaaggttccggctgccgatgatgatgtcgtacgcgccgcataacgagcacttgctgcaggaacagacactgaacaacgctcgttcggctcctgagaagaggcagcgggttccgtcggcgtataacagattcatcaaggaagagattcgcaggatcaaggcgaacaaccccgacattagccacaggggaagccttagcacagcagccaaaaactgggcaca

SEQ ID NO: 50839 - DNA, 454 bp, Zea mays
  Clone ID: LIB3067-017-Q1-K1-G7
ggaacacattcaaagagattggcagagttaatgaagcaattcaggattatgttcaggcagcaacaatcaggccaaacatgccagaagcccatgccaacttggcctcagcatacaaggacagtgggcatgtagaaacggctataattagctacaagcaggctctccggctgcgtcctgattttcctgaggcaacctgtaatctcctgcatactctacagtgtgtctgtgactgggaaaacagagatggcatgtttcgagatgttgaagaaattattagaaggcaaataaagatgtcagtacttccaagtgttcaacctttccatgccattgcttatcctattgatccattgcttgctttggaaataagccgtaaatatgcggcccactgttccttgattgcctctcgttttgggctgccgccttttgtgcatccacctcctgttcctgtaaaagc

SEQ ID NO: 50840 - DNA, 318 bp, Zea mays
  Clone ID: LIB3067-017-Q1-K1-G8
gttctgctgaggggtcctaagaacgctagggaagctgtcaggcacttcgggcctgcaccaggagtgcctcacagccacaccaagccttatgttcgctcgaagggtaggaagtttgagaaggcgagaggaaggaggaacagcaggggcttcaaggtctaagtggccactgccttgccaatctagtgccgttttgctcgtgtcagctcaatattaccgttttggtgtcatagttgtaatgttttagttgtcggaatctcgtgtcattatcggatatcgaaccaatcaaatttcgctcaaaaaataaaaatgtttagaata

SEQ ID NO: 50841 - DNA, 381 bp, Zea mays
  Clone ID: LIB3067-017-Q1-K1-G9
cggacgcgtgggcggacgcgtgggcggatctggaatgggggcagcagctgtgttcgagcggggagacgcggtggatggactctccaacgtgagggacatgcaggcacataattttctgtctaaggatgcgaagtataggcgcagaaaaaccatccatcctagagcagcataagcctgctgcatttgtaatatattcgaaatccgtattttttttcttcacaagcactactctatatacgatgaataaaagggcgacaatacagtgtcatcttgtagccacctaagatgcgaaagagaaaagaatgccggctgttcaatgttctgggcttgttctgttattgcttgtcgtctttcatactgaacaagcatggccttttgtgt

SEQ ID NO: 50842 - DNA, 401 bp, Zea mays
  Clone ID: LIB3067-017-Q1-K1-H1
cgaagagggccttcttaaaaatcttccaaaggatcttagaagagagataaagagacatctttgtttgtcacttctcatgaaggttccaatgtttgaaaacatggatgaacagctgttggatgccatgtgtgatcgtctaaagcctatgctctacacagaaggaagctgcatcattcgcgaaggtgatccagtgaatgaaatgctcttcatcatgagaggaacactagagagtaccacaacaaatggtgggcaaactggtttcttcaactctaatgttctaaaaggtggagacttctgtggtgaagagctcctcacgtgggcccttgaccccacttcagcttcaaatcttcctggctcaactaggacagttaagacgttgtctgaagtcgaaacttttgctc

SEQ ID NO: 50843 - DNA, 360 bp, Zea mays
  Clone ID: LIB3067-017-Q1-K1-F11
gactagttctagatccgcgaatcgacgcgcctatctcagcttgctgcactgcactgcactggcctgccatcatatcgtacgtgagcccggccgagagcgagggagaggcatggctgctccgaagctcgcgacgctggcgctggccgtgctcctggcggcgaccgcggtggctcccccggccgcggtgcgcgcggcgatgtcgtgctccaccgtgtacagcacgctgatgccgtgcctgccgttcgtccagatgggcggggccatgccgccccagccgtgctgcggctgcatgcgcagcctgcttcagcaggccaacaacaccttcgaccgccgcaccatctgcagctgcctcaagaacgt

SEQ ID NO: 50844 - DNA, 415 bp, Zea mays
  Clone ID: LIB3067-017-Q1-K1-D6
ctcatctgggcgctcgtgacctctcctctcctcgtgctgggcggcatagccgggaagaacagcgacactgagttccaagccccctgccgcacgaccaagtacccgagggagatcccccagctcccgtggtaccgcagcaccgtccctcagatggccatggcggggttcctcccgttcagcgcgatctacatcgagctgtactacatcttcgcgagcatctgggggcacaagatttacaccatctacagcatcctcttcatcgtgttcatcatcctcatcatcgtcacggccttcgtcacggtggcgctcacctacttccagctcgccgtcgaagaccaccaatggtggtggagatctgtcctgtgcggaagctcgacaggcatattcatattcttctactgcatctactactacc

SEQ ID NO: 50845 - DNA, 456 bp, Zea mays
  Clone ID: LIB3067-017-Q1-K1-D7
gagatccggagcagccgcagtcccaccgaccccgtcgtcggtcgccctccatgtcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaaacaggttgctgctggggttaccagccaaaccaattactaccacagggctgatggtcagaacactggcaacttccttacggaccgttcttcaaccaaggtccacgctgctcctggcggtggctcttccctgggctacctgttcggtggcaactgatgcccgtgctggtgcgctcaccaaagttattcttccctgtctgctgcgtgctatgtctgaatc

SEQ ID NO: 50846 - DNA, 454 bp, Zea mays
  Clone ID: LIB3067-017-Q1-K1-D8
cggacgcgtgggttttttttttttaacacaaaccaatccggcaggtttcaacacaatagttggttcggtgataagactttctcgagtagatagggtaaaacagggaatgcggaactgtaaatgacgacactgtttgacactgtttgcagagtggagtttgaaaaaggaaataaaatacaggatgagataaagaatctgctagagataacctaagtcatccactgcaggtatgctcccaacaatagcaagtactcaattcatattaaaatccaccctgtggaattccatggatggtggcattgtcctttctatcaaccaaagcagatcactcgtggaacggagtgagatcgatcttgaatggcttctttcccttggtaactcgagcaattgcaattaattcctccaacagctcttccagattgcgcaatggccattgagttgggccatcgcatgg

SEQ ID NO: 50847 - DNA, 451 bp, Zea mays
  Clone ID: LIB3067-017-Q1-K1-E1
tcgcggacgcgtgggcggacgcgtgggcggacgcgtggggtgccatttaaaactgtaaaggtgtgcactaaaggtccatcgggagaagaatatgcatggtaccagtgcacagtgaatggtggacgtgatagccgagctataggagcatatgaactagcaaaagctgtggaagaattgggcgcaggagaaatacttcttaactgcattgattgtgatggccaaggttgtggatttgacatagatttggttaaaatggtttctgatgctgtgacaatccctgtcattgcgagcagtggtgctggagctgttcaacatttttctgaaatttttgagaaaacaaatgcttctgctgcccttgctgctggcattttccaccggaaagagggttctatactagcagtgaaagagcatctggtcaatgctggtgtggaagtcaaggtgtagcagggag

SEQ ID NO: 50848 - DNA, 432 bp, Zea mays
  Clone ID: LIB3067-017-Q1-K1-E10
cggacgcgtgggtaaaaaccaacatgcttcttgtaaaaaaaataagtatgattttgttgctgtaatcctttaataaagcgttatgtttaggaagcaaagtagggtattgaatagactgcaactaggaatagagaaaccttgctattgggagccatatggcatgacaccaaagtataatagacgattgtgttatatgaattgctagaatggtagagtgggctagtttttagttgtgaggattaagctgtcttatgttcctgttaggccacaggttttcatttgactggtacatcttttgtttgaaattagacagcacattagaactgtactgtgaaatgactgtgccatgatgcccccctattcagtctaaaaataaatagttgcccccctatccaggttaaaattatagtatatttgggagtctctggcact

SEQ ID NO: 50849 - DNA, 389 bp, Zea mays
  Clone ID: LIB3067-017-Q1-K1-E12
gatgcaaccagggtttggtaacgattggcttagccatgaaatttaaatgtcaaagcattctgggcgttgatattgattcaggtttaattgagactgctaagtggaatctgcgaaggataatgcggcaggataaggtggctacaaacaacgtcaaagctcagaaatcatcggattctcctcagagctctccagaagaattggcatctgagttatcgaatgggaacaagcaccaagatctttttaaaattgtctcttttcgacgtgaaaattttgtagcgagtatggatggatgttcagaacaagatgacaccatactatgtttgagtgtgacaaaaaggatccacctgaactggggcgacgatgggctagttacgttatatgtgaagatc

SEQ ID NO: 50850 - DNA, 464 bp, Zea mays
  Clone ID: LIB3067-017-Q1-K1-E2
gagaaaagaagggggcggccaaggggtacgggcaagtactccatctacagggagatcgatgatgaagatcttgaagaatctgatgaagattctgaggagaggaatactgcatccctacctgaagaaggggaagtaggggaattcgaagatgaagaagacaatgatgactcagtacctgataacaaggatgaatcagaggaaaaagagccctggtgatccaaaagagcagatgcaaggggagctgaacaatggtaaaaatttagatgctgatcaattaaaagaggctgatgttggttgcagtgatatgaaaaatgagaaagacgatgttgatatcaaacagcaaggcaatgatggagagggtacggggtaagttgaggaacctgttcatgagatgggtggggattgtgaaggaaaaagtacgggtgacttctctattgaccatgcaacaactggggattaaaagc

SEQ ID NO: 50851 - DNA, 412 bp, Zea mays
  Clone ID: LIB3067-017-Q1-K1-E4
gtcaacactgactgctatgataaatgatgaggctgcaatatctgaagtgattgagactgtcaagcagcaagttaaggatgctaaatttcctgatttagaggttattcgcatgttgtgggatgtgctcatggaggctgttcagtggtctgggaagaaccagcagcaaaattccaatgcagcacttaggcaggtgaaagcttggactgagcttttgaatgctttttgcacgagtggcagactcgaactggaacttatacacaaagttcagacacagtgctatgaggatgctaagctgatgaagctgtttccggaaatcataagaacactgtatgaccaagatgtcctagctgaagatactatagtcctttggttccgtaaaggttcaaacccgaaaggcatgcaatcttttgtg

SEQ ID NO: 50852 - DNA, 441 bp, Zea mays
  Clone ID: LIB3067-017-Q1-K1-E5
cccacgcgtccgcccacgcgtccgagcgaccgaccatggcgttgctcccgcgcaccgcgcggctggccctcctttccaccccgcgggcgtactccgctgccgctgctgcgggcgccttcccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccagtccgattgcatgatcgtcgccggcacgctcaccaacaagatggctccggccctccgcaaggtttatgaccaaatgcctgagcctatgtgggttattt

SEQ ID NO: 50853 - DNA, 409 bp, Zea mays
  Clone ID: LIB3067-017-Q1-K1-E7
caaacccaaccctgcaaggagtgcaagaaccttccggcatcatggccttcaagttcatcctgggagttgccctgctgtctgtcctaatcggcgtgtttcttgggaagcggtactagcgctcaggtcgtgctgaaagggctcagccagcggcaagtttgaaaggattggtggccttgttggtaatggttcgacgacttcctgggagaagggctcatcggcgtgtttctttttgccgtaattttcagttttcgggtaagggtaggcggccaaggaatttgattttcgatcattcctgccctatcatgcaaatggccaactgcttgcgactggttttgcctacagcaagtttccgtatacatttcttgttcgtaaagatcacaagttcatcgaccaaacatgaagcatttgc

SEQ ID NO: 50854 - DNA, 454 bp, Zea mays
  Clone ID: LIB3067-017-Q1-K1-E8
cgcagatccgtcgtccggtgagtggaagccgcacgaacccatggcctccggcgagcttgccggcacctacgccgctctcatcctcagcgacgatggcatcgccatcaccgccgagaagatcgccacgatcgtgaaggcggccaacatcaaggtcgagtcctactggccggccctcttcgccaagctcctggagaagcgcaacgtcgaggacctcatcctctccgttggatctggtggcggagctgctccagttgctgctgccgcacctgctggtggtgctgcggctgctgctgccccggctgtcgaggagaagaaggaagaggccaaggaggagtctgatgacgacatgggcttcagcctgttcgactgaggagaccctctcacccagccattagcaaatttcacttgtgctgtcaaagactatcttgtcttatgttatgtctctagggctttg

SEQ ID NO: 50855 - DNA, 437 bp, Zea mays
  Clone ID: LIB3067-017-Q1-K1-E9
cccacgcgtccgcccacgcgttcgcccacgcgtccgcccacgcgtccgcccacgcgtccgggcacgcgtccgggatgagcttcgtgatgagaagcaaaagctgaaattggagaaggagagtttagaacaccagatgaagctgatgacatcgactccaacctacatgcctcatccgaccttgatgctggcgcctttccctcaggcacccctagcgtcgttccatgcccaggggcaagctgcatggcagaagctgatgatgccctttgtcagctatccggggtacccaatgtggcagttccatgccgccttcagaggtcgacacctcgaagaacagtgaagcgtgccctcctgttgcataattgcttcgactagcggctggtcctgctcacaccatgcgaattagtcgcaactgaagcccccctagctgttgatccatt

SEQ ID NO: 50856 - DNA, 398 bp, Zea mays
  Clone ID: LIB3067-017-Q1-K1-F1
gttggcctccatcagaataccaccactggatctactgatattactgatatgtgggagccattggaggaaggcctacttccgcttgagacaacaagacatgtctctatgataactataactctttcaaagaaggagctggacacatcatctatcggatatcaatctcctttgcctgctgatgaagtgaagcctttggttaaatatgataatgatgaagatgcacactcacctggtggccgtgtaaggggtcgtggtggtcgaggccgtgggcggggcatgggcagaggtggacgtggaaatgggttcaatgactatgctgatgccggttgggaagactatcacgcccctgcatatatgggcaatggatatgcccgtggaagaggtcgtagttttagggg

SEQ ID NO: 50857 - DNA, 463 bp, Zea mays
  Clone ID: LIB3067-017-Q1-K1-D5
tctcccactcgtcctctgactcgttggaaaaaatttaaaaaaataaaatataaacaggaataatgggctataaaataaataaaaatcatttaaaaatacactttctatttttaattttcatttttcttttctcttcctttatattcctttccttctctttctttatcttctattttctttttatttaccttcattttattaaatgttttttttttaaaacttttcttatttgataattctttttcttttttcatatttatttttttccatctctctcactttttttaattctgttttattttttaattttccttcactttctatctcttaattaatatttgcattttttttttattttttcattttcccctttactttttcttaattccctttctcttttatcttttactttccttttttccctttttcttttctatttctctttttttcctttcttttcttt

SEQ ID NO: 50858 - DNA, 87 bp, Zea mays
  Clone ID: LIB3067-017-Q1-K1-B8
tcccactcgttcgaaaaaaaaattttaaaaaaaacataatatctataaataaaagggaatatgggaaaatttaataaaataaaaata

SEQ ID NO: 50859 - DNA, 118 bp, Zea mays
  Clone ID: LIB3067-017-Q1-K1-B9
agtcatcaatcgcttaccttgtggatgtggttcttgcattggatgcatcgtgttggaacgggaaataaaataaaaaaaaatgataatcaaaaaaaataaaataaaaaaaaataaagac

SEQ ID NO: 50860 - DNA, 458 bp, Zea mays
  Clone ID: LIB3067-017-Q1-K1-C10
cccacgcgtccgcccacgcgtccgggtcgctgaaggacgcggccaccggcaaggcgtccacgccgttcgatcacggagctgggcacatacacccgctgcgtgccctcaaccctggcctggtctacgacatcggccaggacgactacctggagttcctctgcgtggagaacctgacgccgttgcagctcaggtccttcaccaagaactcgagcaagacatgcaagcacaccttcagctcgccgggtgacttgaattatccggccatctccgcggtcttcgcggagcagccatctgctgcgctgacggtgcgtcgcaccgtgacgaacgtcggcccaccgtcttcgacttaccatgtcaaggttacagagttcaaaggcgcagacattgtcgtcgaaccaagcaccctgcacttcacaagctcgaaccagaagctgacctacaaggtgacgatgacaacc

SEQ ID NO: 50861 - DNA, 422 bp, Zea mays
  Clone ID: LIB3067-017-Q1-K1-C11
cccacgcgtccgctcggttccgccggcgcgcgaggggattcgagctgggtcttgggtagcctctcaccgtctcacgatgccgccagcacccaagtccggcgacgccctcttcgccagcgtggatcgcgtcaatgcggagctgttcacgctcacgtacggcgccatcgtgcggcagttgctcacggatctggaggaggtcgaggaggtcaacaagcagctcgatcagatgggttacaacattggaacacgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgatggtacaagttggagccttgtcctggaagacaaccctc

SEQ ID NO: 50862 - DNA, 434 bp, Zea mays
  Clone ID: LIB3067-017-Q1-K1-C12
cgcaacgcacgttctctccactggtcctacaacactctccctaccacaccgaaccaacaagaggagcaagaggtagctatagcagcctagcacacaccaccacccaccaccgccaccgcgccacagagctgccgagagtgtgctgtgctttgctcatcgaccgaccgatcgatctcggcatggcggactgggggccggtgctgatcgggctggtgctcttcatcctgctctccccgggcctgctcttccagatccccggcaagggccggatcatcgagttcggcaacttccagaccagcggcctctccatcctcgtccacgccgtcatctacttcgccctcctcgccatcttcctcctcgccgtcggcgtccacatttacctcggctagctagtcgccggcgggcggccggctgagcgaggctagctgctggcg

SEQ ID NO: 50863 - DNA, 452 bp, Zea mays
  Clone ID: LIB3067-017-Q1-K1-C2
cccactcgtccgcccacgcgtccgaggagattctcgtgacaagcaatctcctgttgtaaatgggagcattttcaatggtgttgatgctgatgtgtttgcccgatttgaagttttgcagtcccgtattgataatataaactccttgagtgagattgactgtggggagcagaaagaagcaagcaagagaccatatgcagtcgaagatactgttatggcgagactgaaagttttgaagtctcgtcctgacaatataacctctttgagtcaaggaagcactaaacaccagctagatggaagcacaaacagtgcagataatgttgatgacactgttatttctaggctgggaattttggagtcccatcctaataatgaagccctattgggacaggaaagcagcatgcgacaactggatccgagaacaaatagagaagatgggattgatgctgctgtta

SEQ ID NO: 50864 - DNA, 452 bp, Zea mays
  Clone ID: LIB3067-017-Q1-K1-C4
ggcccggcggcaagcacggcggcgcgatcggaaggcacggcggcgacgcacaccaccatgggaagaagttcgacggctactacctctggccgtgaagcgccgagcagccagcatcgtcatgcatgcacatataccgcctgccctgatggtgacgatggtgagccgccaaggtgaagagtgtacacgttcccgttcatccatccatcgtctccttagtactgctgcccggtgattagtcgatgaagagtgaaggtgaaggctacccacacacacacatttggtcgacgtacccgccaaaatttgaattttttttcttcccccttctccccccttcctcttccttctcattcttttttcttttagttttgtccagaaatcgaaaggtgtgttgatttgattaagttttttaaataccgtgccccgtggtaattaaatatgtacgtacttatata

SEQ ID NO: 50865 - DNA, 452 bp, Zea mays
  Clone ID: LIB3067-017-Q1-K1-C5
gttgagctgatggcttatgccttccttgtggtcagtccacctgacatgagtcaatgctttgaggagatggctgctgctgcatctaataaaacttcatccaaacctggattgaattatcctgacctggaagaacaggcccttcagtttatcttggactgctgtgaatctaatatagaaaaatatacaaagtacttagagggtggcgctggctctccagaagttccaatgaatgcaaagcaagccaacagaacattactgctaaaacagctagcaagagatctgtgcatcagtgaacggagaatcctgtatcgcacacaatatatattgcgtagaagattgatggacatgataggcggcgaacttagagctctgtcacttttcaacgggctgagaaaactctttaaataaatggatcggctatcttatcttggcagatcttactggacagattt

SEQ ID NO: 50866 - DNA, 453 bp, Zea mays
  Clone ID: LIB3067-017-Q1-K1-C6
cctagccccagctagatcattggacacatatcgaaacagctctagctagcgcgctcgtcgtctaacctggcttccggcatggcttccaagcagatcggagtcttgacctgcttcattgccatcaccgctctcgccttccgtccctgcgcatccgccgtgcccatggacggtggctggtcgaacggcggcgccacctggtacggcccagccaagggcgctggatccgacggtggtgcgtgtgggtaccagggtgccgtcgaccagcctccgttctcgtcaatgatcaccgtcggcagccaatccatcttccaggacggcaagggctgcggcacctgctaccaggtgaagtgcaccggacacgcgtcgtgctccggcagcccggtgacagtggtcatcaccgacctgtgccctgaggctgcgtgccatgtggagcccgtgcactttgacctgagc

SEQ ID NO: 50867 - DNA, 137 bp, Zea mays
  Clone ID: LIB3067-017-Q1-K1-C7
tcgcagagcagtgctttcatatcagcccatattttttttctaatattgttgagtggtattgatggcaattgggaattgtatgatttacttgccttatgaataaagcttgaaagaaacaaaataaagattagtatttt

SEQ ID NO: 50868 - DNA, 461 bp, Zea mays
  Clone ID: LIB3067-017-Q1-K1-C9
ccccgatctcggcgacatcgaagaggcccacaggttcgggctctcggtgattgccatcatgatggccgcgtgcctgctggagcccggggacaaccaccgctacaacatgttcccgtcagacactcacgtcaggatgcacgatgtcgtgcgcgacgcggcgctccggctcgcgcccgccaagtggctggtccgcgcaggcgctgggctcagggagcccccgcgcgaggaggcgctgtggcggggcgcgcagcgcgtgtccctgatgcacaacaccatcgaggacgtgccggcgaaggtgggtggcgccctagcggacgcgcagccggcgtcgctgatgctccagtgcaacaaggccctgccgaagaggatgcttcaggcgatccagcatttcaccaaggctacatacctggaccttgaggacaccggcattcatgacgcctttcccatggagatctgctgtt

SEQ ID NO: 50869 - DNA, 444 bp, Zea mays
  Clone ID: LIB3067-017-Q1-K1-D1
tcgcaaaaacctcgtcagtttgggaacagcggaaaaccggccccccgcccgcctgctaggtgctagcaacagcagtcgccgccgatgggggtggactactacaaggtgctgggcgtcggccgcggcgccaccgacgacgagctcaagaaggcctaccgtcgcctagccatgaagtaccatcccgataagaaccctacgccgcaggccgacaccctcttcaagcaggtctccgaggcctacgacgtgctcagcgacccgcagaagcgagccatctacgaccagtacggcgaggaaggcctcaaggccggcgcgccttcgcccgccgtcttcacgcacggcgccggcgccggcgtccacaggttccgctttaacacgaggagcgccgaggagatcttctccgagatattccgcggcgggtttgctggggcaggcccccgttacccc

SEQ ID NO: 50870 - DNA, 423 bp, Zea mays
  Clone ID: LIB3067-017-Q1-K1-D10
cccacgcgtccgcccacgcgttcgcccacgcgtccgcccacgcgtccgcccacgcgtccggccacgcgtccgcccacgcgtccgcaccggtgatctcttctgcgaaggccttccacgagcagctgtctgtggcggagatcaccagcagcgcgttcgagccggcttccatgatggtcaagtgcgacccacggcacggcaagtacatggcttgctgcctgatgtaccgcggcgacgtggtgcccaaggacgtgaacgccgcggtggccaccatcaagacgaagcgcaccatccagttcgtggactggtgcccgacggggttcaagtgcggcatcaactaccaggcgccaacagtggtgccgggtgccgacctcgccaaggtgcagcgtgccgtgtgcatgatctccaactgcaccagcgtcgtcg

SEQ ID NO: 50871 - DNA, 428 bp, Zea mays
  Clone ID: LIB3067-017-Q1-K1-D11
cccacgcgtccgcgaatcttccaaattctttcccgagacctaaaattctctcgacggattcgcctgatctgacacgcgatctctcggctcgccccaatggccgacaaggagaagttggagtctgaagaggagtacgagagcgacctcgacgacgcacccctctccgcgttgcggcgccgggacgctgcgagcgatgacgaggacgaggatgaggacggagggatgcccttgaggcggaggaaggctggatccgacgcagattccgacgggcagggcgccgccgaggtgtacgacgaggatggcgcgtacgaagaaagcgaggagtacgatgaatacgagtgcgagaaggaactcatggagaagtccacaatcgaagagacaatgtctgaacttatggatggtaagattcctatgctgcaagttgaaga

SEQ ID NO: 50872 - DNA, 193 bp, Zea mays
  unsure at all n locations
  Clone ID: LIB3067-017-Q1-K1-D12
cggacgcgtgggaaaaaaaaaaaantaatttaaaaaaaaaaaaaaataaaaaaaacaaaagggaaaaaaaaaaaaaaaaaaaaaaaaaggacaaaaaatacttaaaaaaaaaaaaaaaggggcgcctgttttctaggtcccaagcttcctaacgcgtccttgcaacttattatttttgctatggtgtccccaa

SEQ ID NO: 50873 - DNA, 330 bp, Zea mays
  Clone ID: LIB3067-017-Q1-K1-D2
cttccctcacaaatatcatgcggttatggatatgttccgtccttgcctttttctttaacttgtttagttggttgtaggaattttgttgttgttgtgtaaattacccctcatccgtggttttccacagaccagaatgcattttccccgataatacattgaagaaagttctcatgcaagcctctttgtgggggaaaatgaagtcttagggatgttctgaaagtagtgactacccatcatgtcttttgtaacattacttaatgtaagcatatctgatataggtatgcaaaggctccaatagcttccgtctgctgtatgggaaagaaaggagac

SEQ ID NO: 50874 - DNA, 446 bp, Zea mays
  Clone ID: LIB3067-017-Q1-K1-B7
ctttaagattattttgggagttcctgcacagggtaacaagctataacaaataaaatgtgaagaagacagttttctccaaatgttaggtctttgacatttttctataacacttcagcttaaatatgtacttttttcttttaatttgcgctgaacttgatgctaccttggtgacaagagcagatgtacgtttagtgcgatcaccaaggtcgtccgtatcccacggctgggctgttattttcttgtaatactgctttcagatgtaatgactattcatttctttttcctggtacggaataccggtagttggatggaaatcggcaacagcattagccatttcggaatagtgagcgcccaaattgtcttcgttttgctgctttttgccctcacgaatatatacactagagatattttggtctcgtcttggcaactaacccgacggaaagtta

SEQ ID NO: 50875 - DNA, 232 bp, Zea mays
  Clone ID: LIB3067-017-Q1-K1-D3
cggacgcgtgggttactccacccgtttgtgttggattgacatggaccatcatatgaaaactgtttttttggaaaaaaaaaaaaaaaaaaaaaaaaaaaaaaaaaaaaaaaaaaaaaaaaaaaaaaaaaaaaaaaaaaaaaaaaagggatgtagtaataaaagtacaaaagattatttaaacatttcatgaaaaattaaaatattactaatatgttaattaaattaaataaat

SEQ ID NO: 50876 - DNA, 113 bp, Zea mays
  Clone ID: LIB3067-017-Q1-K1-D4
aaaaaaaaaaatgtgaaaaacaataaaaacatttaaaaacatacatataaaaaaaaaaaaaaggggaaacaggcggtataaaaaaatataaaaaccaaattaaaggcatactc

SEQ ID NO: 50877 - DNA, 358 bp, Zea mays
  Clone ID: LIB3067-030-Q1-K1-G12
gcactatcatgaccatctctaaggacagagttaagccgtctccgttgcccgacagctgggagctgaaggagatctttgccacgggtatcgtgcttggaagctacctcgctctgatgactgtcattttcttctgggctatgcacaagaccgacttcttctcggacaaattcggtgtgaggtcgatcagggacagcgagcatgagatgatgtccgcgctgtacctccaagtgagtatcgtgagccaggctctgatcttcgtcacccggtcccggagctggtccttcgtggagcgccctggcctgctcctggtcaccgggtatctgcttcgccagcttgtcgcgaccttcctcgctgtcta

SEQ ID NO: 50878 - DNA, 175 bp, Zea mays
  Clone ID: LIB3067-030-Q1-K1-G2
aaaaaacatacaaaaacacaaaaaaaacaaacaaacaaaaacacataaaaaaaacacaaaacgaacacgcgtacgaccacgcgtgcacgatgatcctgtatctgttataaatatcattattattaaaaaaataaaaaaacatgaaaataaaattacataaaaaaaattggacaaa

SEQ ID NO: 50879 - DNA, 429 bp, Zea mays
  Clone ID: LIB3067-030-Q1-K1-G3
cggacgcgtgggcggacgcgtgggctgcagtacgctaaccagctgtgtgagcgtctgccgagccgggacggagagtcaacagtcagctgccaggagatctccaagatgcccagccttgcgttcaccatcgcaaacaagaccttcaccctaacacccgagcagtacattgtgaagctggagcaaggaggccaaaccgtctgcatcagtgggttcatggcgtatgacgtgccaccgccgcgtggtcctctctggattcttggggacgtcttcatgggagcttaccacacggtgttcgacttcggcaacgacaggattggcttcgcggaatctgcatgagtgtggagagcactctcatctttataaagacgataccctatgtattagggatgtgtaagttattgtctatccactacatgccaacagtacgct

SEQ ID NO: 50880 - DNA, 393 bp, Zea mays
  Clone ID: LIB3067-030-Q1-K1-G4
tcgcccacgcgtccgcccacgcgtccgctctcgcccaccaccacaccacaccaccggcggcggcggggacccagtcgagaacacgaaggcgatggcgacagcgctgaaccgcgggctccgctccgggctccgcctcctcgccgccggcgccgaggcgtccaagccagcttctcgtggattccatgccaccgtcgtgaagagaatgggagggcatggccatgatgagccatactacatccatgccaagcacatgtataacttgcacaggatgaagcatcagggtttgaaggtgacactctccgtgctgggagcggttggcatcggcgttggagtccctgtgtatgcagtcatattccagcagaagaagactgcctctggctgagatgatgcctc

SEQ ID NO: 50881 - DNA, 364 bp, Zea mays
  Clone ID: LIB3067-030-Q1-K1-G5
cgatagacctataactaataacagctatagaattatggacatcctgagccagattcagctgggtcatgcggtatatcacaaaggagatcgagattgttgcggaccctatccatgaacacctcggagagggcataaggctgggtgaggtgtgtccttcgataggcaaaaataatcacgtgccttgtttattattgttcttttctgttcgttttttcatttgcttctgcaagttctagctctagatcatacctgtaaaatatgcagaggtcttttgcggatgatattcttatatcgtttttgttagtcgcgctgtactgtaccgtgtgatgattatggagctgctttgtaagccgtttttaacctg

SEQ ID NO: 50882 - DNA, 412 bp, Zea mays
  Clone ID: LIB3067-030-Q1-K1-G6
cggacgcgtggtcggacgcgtggggttggattgggttcaaagttgggcttttggacaggtgtggtgtgcacggcagctctgtgacttgtgaggaggaagggaggaagaaagcggatccatggcgtcaaagcggatcctcaaggagctcaaggacctgcagaaggatcctcccacctcttgcagcgcaggccctgttgccgaagatatgttctactggcaggcgacgattatggggccatcagatagcccatacgctggtggcgtatttttggtcactattcactttccaccggactacccattcaaaccaccgaaggttgcattcaagacgaaggtttaccacccgaatatcaacagcaacgggagcatctgtcttgatatcttgaaggagcaatggagccctgcactgaca

SEQ ID NO: 50883 - DNA, 440 bp, Zea mays
  Clone ID: LIB3067-030-Q1-K1-G7
cggacgcgtgggattgtccatctttatccctttctcaaaggtttggctggaaggcaaaacaggacaccaacgatcgtcatcgtctggtccattctgctggcttcaatcttctcgctccttcgggttcggattgatcctttccttgcgaaggatgatggtccgcttcttgaggagtgtgggttggattgcaactaggatgtcagtgcatcagctcccgcaatcgtgcatatgcttgaagtactattttcaggtgtttgtacccatattcagtgtctgtcgataagagacatgaaatgtgccacgtctctattgatccatggtgaacctacttaatatctgagagacatactgggggataatggcggctgccgcaatccttgtgcagttgggccgtggaatacagcatatgcaagtgcttgactgtgcagcattcattatta

SEQ ID NO: 50884 - DNA, 428 bp, Zea mays
  Clone ID: LIB3067-030-Q1-K1-G8
cccacgcgtccgcccacgcgtccgtgagaatcaagatctcccgatgagcgagaccaacagtgtgtgtgaggcacaggaggatacagaggaccagccttcagagaaggatgcacctgttgcatgggaagaggatgagaataatgtaggttggatgcctgctgttagccgcagcacacacagaagatatttgcggaggaaggcaaggcgtgatgccctcaaagaatctggacaaagttttgagacgagttctgttgctgcatcaattgatagcgataaagttctctctgaaaatggagggttggagcatggtctgacttcaacaggtggcctctcttctgtccctgagaaaatcagtgcaagttctgatggtcttgaacttcaagcagatgctgaccctgaaattgctggagaacagttgcattctgacc

SEQ ID NO: 50885 - DNA, 371 bp, Zea mays
  Clone ID: LIB3067-030-Q1-K1-G9
cgtctcgctcgcctcggacctcgccgtgcggcacactcgcagcgcgttccacttgttgggtgctggtggatttgcgtccgggccccgaaccgatcgagtcttttgcgatggcagcagcggctagtctccaaggggccgggcgatcagctgggagacttcgtcaggccgcgtcactggccggcaaggccagcactacccgaggagggccgtgcacgcctcgtcgtacgacacgaacccggaggagcaggtgcgcccggcgttcgtgccggacgatgtgatcagcagtgcagggagccccgacaagtactggagcccacagcccaagaccggcgtgttctggccggcggttgtggacaccaaccagctgggcg

SEQ ID NO: 50886 - DNA, 386 bp, Zea mays
  unsure at all n locations
  Clone ID: LIB3067-030-Q1-K1-H10
cccacgcgtccgcccacgcgtccggatgaagagtgccgatttgctagggaacctgnaaggagtgtaccaggaaagaacgtgtcttggttactgctcttcgcagaagttggaagaatattgggaaaatgaaaatgtatcttctctcaactccagcagtttacaggcgggaaaaaagagaaagaaaagaagaggcaggaaaaagcacaatcgtcgcaagaaagctaatttacaggattctccagcatcaactgctgctgataattctggtttggtgacgttttctgagaactgtacttcatcccttaaactagaggaacagatgaagaagcaagatcaggacaagacatccatgactaacttacttttaatcaacaatgcaaagagat

SEQ ID NO: 50887 - DNA, 396 bp, Zea mays
  Clone ID: LIB3067-030-Q1-K1-H11
agcgccccgtagtgcagtgcagcgcagcagtgtgctaccctcctcagtcctctcactccgtcacaaacgctagtcttcctctaaagctcggagcgagtctcagaagcgatggcgtcaaagaggctgctgctggcggcgctgtgcgtggtggcggcggcgctgctcgccgtgcggtcggagtcccacggcctggaggacttcgcaagcagcgacgcgacgccggagatgcagaccttcttcaagcccgaggccgcggcgctcccggaggccctggacgcgtcctccatgcccgccgccaccatggccgcgaagccggaggccacgtcgatcccgaccaccaccaccggcaccacgccggcggctgcagctggcacctccgccgcggcaggcactact

SEQ ID NO: 50888 - DNA, 378 bp, Zea mays
  Clone ID: LIB3067-030-Q1-K1-H12
gacaagaagaagatcgaggacgccatcgacgcggccatcagctggctggacgccaaccggctcgccgaggcggacgagttcgatgacaagatgaaggagctggagagcctttgcaaccccatcatcgccaagatgtaccagggcgcgggtgccgacatgggaggctccggcggcatggacgaggacgctccggctggaagcggtggccctggccccaagatcgaggaggtggactaagcggtttgtgtcagtctcgtgtgtctgctgcagtggctggctggcccagtcgctgctcgatttatcgtcgtcgtcgcggtgtatccgcgttagaaccctttggtggtgaacaatattatcggggcacgcgttttaagtata

SEQ ID NO: 50889 - DNA, 366 bp, Zea mays
  Clone ID: LIB3067-030-Q1-K1-H2
cccacgcgttcgcaggctcaccccaccaacagcaagcgaaaatctcccgatcccctctggtctgcgcggcgaagatgtcggagcgcggcatgggcgggaagggcctgtgcaagggcggcgcgaagcgccaccggaaggtgctccgcgataacatccatgggatcacgaagccggcgatccggcggctggcgcgcaagggcggcgtgaagcgcatctccgggctcatctacgaggagagccgcggcgtcctcaagatcttcctggagaacgtgatccgcgacgccgtcacttacaccgagcacgctcgccgcacgaccgtcacagccatggacgtcgtctacgcgctcaagcgccatggccgtaccc

SEQ ID NO: 50890 - DNA, 411 bp, Zea mays
  Clone ID: LIB3067-030-Q1-K1-H3
cccacgcgtccgtggaaaactatttgatggttttgcagatggagtcctggctgccttgagagtatgatgcataacagtgatagcttcagtgcggagtctgctataattgaaactgatgttttcatggagaaatcaaccccgacagtgaagcttgagattcagctttacaaaacgagggatgagaagtaccttcttgacctgcaaagggtcagtggatcacatcttctatttctggactcgtgttccgcctttctaactcatctgaaagttctttgagcctgacatgattggcttcccaagcactccttgatgcacccagtggagtttcaagttacatttgagatgcacataatgaccatatataatcctccaatagattatattttctggagcatgtaatgtagacgttag

SEQ ID NO: 50891 - DNA, 365 bp, Zea mays
  Clone ID: LIB3067-030-Q1-K1-H4
cccacgcgttcggggcaccatctagcgcgccgtggtcgacggcaccgtcaaggtcatgcgggcgcgcggcttcatgcttttcaagatgataagcaagccgacgccggagacggtcgtgaacgagatcaacctgttcgtgctcatgcaccccgctggcaagtactagcagcacacaccttgatactcgagcgagtggctactaccgcattgtagatggacaaagtcttgtcgaagtgactatgtgcaatccaactctttcagatgtattactcttgtggaaacccaatgaacatgcaatttatctgtcctctgagcacaaatgtaagccattagcttggccttacccgctcataaagaccatatat

SEQ ID NO: 50892 - DNA, 436 bp, Zea mays
  Clone ID: LIB3067-030-Q1-K1-H5
gatttggaccagctaaagaaggaacaggacgaaatcgttgccgatatcaacaagattcacgggaagctcctcgcatccccagagatggttgataaaccagttgacaccattttgctcaagcttcgtggtttatatgcacgtgcaaaggagctctctgagaatgaaatcagtgcctcaaatgctttgattggattattagatggtttgttgcaatctggagcttcaactgcacaaaagaaaaagatagaagttggtgagcagaaaaagaagaggatcaagtctgatacagattctgcacgattttctgctgcatctatgaggaatcaacttgaccaagctgcaagccttaaaggagagcaggttgctgctagggtaaaatcagatgacgaaaaagatgagtggtttgtcgtgaaggtcatacatttcgataaggaaa

SEQ ID NO: 50893 - DNA, 451 bp, Zea mays
  Clone ID: LIB3067-030-Q1-K1-G11
gacccattaccaatgccaagaacaagaaaccagagaggacagccgcgaatacaatccgggtcccgtccaaaaacccaccataccgtctcccccatctgcaagaacaagatcaggagagcatcctagggggaagaaacaggagggggaaaaagaagcccagaaagaccaactgaccaaacaaaaaggtggcatctttgtgtcaccgaggcaccgccgatcacagaccaaagtccgctcctctggtccatcccaagcgtacagcagccgagatttcttcgatctgcgcttgcgtttttttttcttgtaaagattttagttttccccccttcaactgttgctagccttgagtcgctgagaagtttcgagaagggtggtgtgagtgtcggatagctcaagatggatccggtgttgcttgacgacgtcatacgccggcttctggaagtgaagaatc

SEQ ID NO: 50894 - DNA, 403 bp, Zea mays
  Clone ID: LIB3067-030-Q1-K1-E3
aaaagacagttatcagcacatgaactcagttttcctattcgaagccttgcacactgatgccggacgtgctcacaaaaatggacagagatagtgatttagcgttccaagttgcaagagttgggctcgatgacacagatgcaggacccgtcattgttacgccttgagaatgagtcgtaccagctgtgcctcagtatccttcagaacatatttctggacagctctgctgatcattgaagcacagaggtggtggaaagtcaccttattggcttgtgcaaggaggtccttgaagtatacttgttcacagcatgaccttctcagccttacagtggcacacagccgctttgccattggcttatccctgttggttcatcaatgcgaagggaacttgcggcaagatcacctc

SEQ ID NO: 50895 - DNA, 367 bp, Zea mays
  Clone ID: LIB3067-030-Q1-K1-E4
accacgcgtccgtccacgcgtacgaccacgcgtccggagaaagaaggcattactgccgtgcagcatacgctcatctatgctggtaagcagcttgctgatgacaagaccgcagaggactactacatcacgggtggatctgtcctgcatcttgtacttgctctgaagggtggttactagtctaaacctgatgaactagcagtcagataaactgacgtgtcggctgctaaatgtgcaggcctgatgttgaactggcacggagatgattacagcttatcagctctgcacctgtgcccaatggcaggggctgcctttcaagctatcgtctgatctggaactgttccacattatctaatccctgttggttcat

SEQ ID NO: 50896 - DNA, 438 bp, Zea mays
  Clone ID: LIB3067-030-Q1-K1-E5
ctgacacaagagagcacgctactactcatcactcgccaacgtgcagagatcagggaagcggcactccatccactgactgaccgctcatggcgaaggtccacctctacgtcgccgcggcctgcgccgtcgtcctcgcgctcgccaccccggccctcgccggtgaccccgacatgctgcaggacgtctgcccggctgactacgcctccccggtgaagctgaacgggttcgcgtgcaaggcgaacttttcggcggacgacttcttcttcgacgggctgaggaacccgggcaacaccaacaacccggcgggctccgtggtgacggcggccaacgtggagaagttcccgggcgtgaacacgctgggcgtctccatggcgcgcatcgactacgcgccgggcggccagaacccgtcgcacacgcacccgcgcgccaccgagatca

SEQ ID NO: 50897 - DNA, 416 bp, Zea mays
  unsure at all n locations
  Clone ID: LIB3067-030-Q1-K1-E6
cccactcgtccgagcacgctactactcatcactcgccaacgtccagagatcacgggagcggcactccatccactgactgaccgctcatggcgaaggtccacctctacgtctccgctgcctgcgccgtcgtcctcgcgctcgccaccccggccctcgccggtgaccccgacatgctgcaggacgtctgcccggctgactactcctgcccggtgaagctgaacgggttcgcgtgcaaggcgaacttttcggcggacgacttcttcttcaacgggctgaggaacccggacaacaccaacaacccggcgggctccgaggtgactgcggccaacgtggagaagttcccgggcgtgaacacactgagcgtctncatggcacgcatcgactacgcgccggtcggacagaacccgtcgcacacg

SEQ ID NO: 50898 - DNA, 441 bp, Zea mays
  Clone ID: LIB3067-030-Q1-K1-E7
gtccaacgcctcctagatggatgagggcaggctccgggccggcggcggctgcaccggagggcgcaagaaggccggcgcgagcggtaagcccaagcgccctccctccgctttcttcgtcttcatgtctgaattcaggcaggagtaccaggcgcagcaccctagcaacaagagcgttgcggccgtgagcaaggcagcaagtgaaaagtggcgctatatgtcagagcaagagaagcaaccctatgtggaccaagctgggcagaagaagcaggactatgagaagaccaaggcaaatattgagaaggagagcacaagctcaaagaaggctaacactgatgacgacgatggctcgaagtccgacgttgatgatgaggatggcggtagtgacgaggaaaacgacgacgacgagtaaatagtatctccgctgtcccgaggtaacaaatc

SEQ ID NO: 50899 - DNA, 435 bp, Zea mays
  Clone ID: LIB3067-030-Q1-K1-E8
gagggaccaatgtatactctcgttttcctgtggactcctgctctgagcccaaaggatgaggaaattcctcacggctgcatacttgctaccttcatgctctcctcgatgctgggtagctcaattgcttctcgtttgttagctaggaagctgaaggttgaaggttatatgcaaatcgtgttttcagtatcagcctttactcttttcctccccgttgtcaccaatttcctagtacctccctccggggagaaaggcggcagcatttcgttaggaggctgcttacagcttcttggcttctgtacctttgagtcatgtgttggcatattctggccatcaatcatgaagatgagatctcaatatattcccgaggaggcaacacgcacaatcatgaatttcttgcgtataccgctcaacctgtttgtttgcctggtactatac

SEQ ID NO: 50900 - DNA, 441 bp, Zea mays
  Clone ID: LIB3067-030-Q1-K1-F1
cttgcaaataactcagcactttctggtgaactggatgcattgagggagaagataaaagcactacaggcctcagaaaggtctctgaaggatgaaatttcctgttatgtttctgaaaaggttgttcttgcatcagaggtagagatccttggtaaaagtttatctgaggtttcagagaagaattctatcttggatacctcattatgtgatatgaaaactgagttagatgaattgagaacaaagctgaacgattctgaagaatcctgccagactcaccttacaaataattcagctctttctgctgaaaagaacaatctgttctctcagctggagagcattacattggccatgaaagcactagaaggtatgcacaccaatctggaacagatgcactcctctgtatcaagagagaaggattttgcatatgatcaagtaagggaactg

SEQ ID NO: 50901 - DNA, 294 bp, Zea mays
  Clone ID: LIB3067-030-Q1-K1-F11
cccacgcgtccgcccacgcgtgcgatgaggcggacatacgcagcaagccaagcatatacggatttaaatccgcacaccctatggtatctcggcgcggctgctatggcaagcggcagtcctgacgaaggggaatgcgcgcctaccgccggaagtgaaccgggtgctctacgtgcggaacctgtcgctcaacatttcgtgcgacgagatgtactacattttcggcaagcacagtgcgatccagtggatccgtctgggcaacgccaaggacacgcacaggaccgcttacgttgtcta

SEQ ID NO: 50902 - DNA, 383 bp, Zea mays
  Clone ID: LIB3067-030-Q1-K1-F2
cgccaccttggagagcgcgcggtggagcttctcgttcagggtcgccatggacagctccatctcggccagtctcctctggagccgcgccacctactgcctcgtcctggccgtctcgtcctccagcctgctgatggagctcatcacgacgaggtcggctgccttgcgctctagctcctcgtcgtcgccgtcgtcgctggccagcgaaagcgacgacgcgaagaacggcagtgaggacgggaccaggtacatcgtcacgtattctgcaaccggcggccttggcacgggcaccgtctgtaggcttggagcagcatgcttgctgctgacactactatgctcttacttggcattgcaggtgacattgacaacacttggcttggagtggc

SEQ ID NO: 50903 - DNA, 441 bp, Zea mays
  Clone ID: LIB3067-030-Q1-K1-F5
cggacgcgtgggcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccatgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactgggctgtgcatc

SEQ ID NO: 50904 - DNA, 422 bp, Zea mays
  Clone ID: LIB3067-030-Q1-K1-F6
caagcagatctaagctccaggcagcgtcgcgacagagtgagctagtgagtagcacgacagcaacaatggcttccctgaaggccgcgaagcccagcggagttgcggcgcaaggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgttccctcatgtgtgatgatgccagatgaatactacaaataagacgttgttgtgac

SEQ ID NO: 50905 - DNA, 438 bp, Zea mays
  Clone ID: LIB3067-030-Q1-K1-F7
cccacgcgtccgcaccccctcgcggggcgagggacgtggcgtctggccccacgcgccgcagggcgaggtgggccgaagcaggggctgccggcgaaccgcgccgggcgcaacacgtggtgggcgacatcaagttgttctcggtgcagcgtcacggctcgcgggcggacattcggccctatggacccatcgagcgaccgagcttgccctctgaccgcgaccccaggtcagtcgggactacccgctgagtctaagcatataaataagcggaggagaagaaacttacgaggattcccctagtaacggcgagcgaaccgggagcagcccagctcgagaatcgggcgtactcgtcgtccgaattgtagtctggagaggcgtcctcagcgacggaccgggcccaagttctctggatagggacgcctgtgatggtgagagccccgt

SEQ ID NO: 50906 - DNA, 121 bp, Zea mays
  Clone ID: LIB3067-030-Q1-K1-G1
cccacgcgtccgcccacgcgtccgcccacgcgtccgcccacgcgtccgcccacgcgtccgtgcacgcgttcgcccacgcgtccgcgatgatcctgtctctgttataaatatcattattatt

SEQ ID NO: 50907 - DNA, 421 bp, Zea mays
  Clone ID: LIB3067-030-Q1-K1-G10
gactagttctagctcgcgatctagaactagtccctgggcagattggcaacggctatgcgccagtgctggactgccacacctcccacattgctgtcaagtttgctgagctcattaccaagatcgacaggcggtctggcaaggagcttgagaaggagccaaagttcctgaagaacggtgatgctggtatggtgaagatgataccgaccaagcccatggtggtggagacgttctcagcgtatcctccccttggtaggtttgctgtccgtgacatgaggcagacggttgctgttggagttatcaagagtgtggagaagaaggacccgaccggcgccaaggtgaccaaggcggctgccaagaagaaatgatgcgatcctgcgcctgctttagcaatacctaggtttcatcatcacaaagttttgtt

SEQ ID NO: 50908 - DNA, 396 bp, Zea mays
  Clone ID: LIB3067-030-Q1-K1-E2
agaggacagttatcagcacagaacacagtaatcctcttcgaagccttgcacactgttgccgcacatgctcacaaaataaacagtgatagtgatttgcgttccaagttgcaagagttgggctcgatgacacagatgcaggacccgccattgttacgccttgagaatgagtcgtaccagctgtgcctcagtatccttcagaacatatttctggacagctctcctgatcatggaagcacagaggtggtggagagtcaccttattggcttgtgcaaggaggtccttgaggtatacttgagcacagcaagaccttctcagccttccagtggcacacagccgctaggccattggcttatccctgttggttcatcgaagcgaatggaacttgcggcaagagca

SEQ ID NO: 50909 - DNA, 266 bp, Zea mays
  Clone ID: LIB3067-030-Q1-K1-C6
gccacgcgtcctcccacgcgtgcgacctttgtatgttgtgtatctaatgcatgtgctagcgcgctgtgtctgtcgtgacacctggatcgtgagatgggttgtcaaacttgattgctttgttgagcttggctggaacaactgatagttatatatttggatcgtactgtccctgttgtatgtatctaaattctgaacgcgttgcaatctgagcatccgtgcaaagtatgaatgttccttctatgaatacacgagttcatgtccgacgg

SEQ ID NO: 50910 - DNA, 442 bp, Zea mays
  unsure at all n locations
  Clone ID: LIB3067-030-Q1-K1-C8
cccacgcgtccgcgctgttaggttctaccaggagaccttcggcgtccctccggccacgcgagctcgccgaaatggtcgcccacaggttccatcagtaccaggtggtgggtcgcgcgctgccgaccccaaccgatgagcaccccaagatctaccgcatgaagctctgggccaccaacgaggttcgcgccaagtccaagttctggtacttcctgagaaagctcaagaaggtgaagaagagcaatggccagatgcttgccatcaacgagatctttgagcgcaacccgaccaccatcaagaactatggcatctggctgcgctaccagagcaggactggttaccacaacatgtacaaggagtaccgcgacaccaccctgaacggcgcagtggagcagatgtacaacgagatggcctnccgccaccgcgtgaggtccccctgcataca

SEQ ID NO: 50911 - DNA, 392 bp, Zea mays
  Clone ID: LIB3067-030-Q1-K1-C9
acaacatctacctcaacttcgacgccttccacggcgacaaggcccacggcggcgtccagtgacggtaccgagatcgtgctctggaagtggtgcgagggcgacaaccagcgctggaagatcctcccttggtgaacgaacgaaagaaactactagctggtaccctaataataattctgctggctgcggcgatcccaaaataaaagaggccgggtgcgatgcatctcggacttctcgagtggtgtttgcgtcagacagccagccactgtggggctagtgttccaacatttgtcagcctgcttgcgcgaggaaggggggtcactgactcaagagaagggcctggtcataggctgctgcattatgaatttctgatgatgtcttatgtctgtactctg
